United States Patent 11,098,302 (IDENTIFICATION OF POLYNUCLEOTIDES ASSOCIATED WITH A SAMPLE) - sequence listing, part 35

SEQ ID NO: 117988 - DNA, 602 bp, Homo sapiens
  misc_feature: GYAE6OF01DQ20D.10.27.C05.1.454.CMB.1.raw
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggctattataaccttgtctcctggtatcaacaaccgccagacaaacgcccccacactcttgatttangaacgtcagtaagccggacctcgtacgggttctagtcgtcttctctcgacctcaagtctggacaacncggcctcctgactaattctcgtacgggcctccgaggctagacgacggaggctagaattactcgtcgcagctacgatatagtagtagttcggtctcctttcgttttacgtaacgggttttcgggaacgggtacggggtaccgacgggtccttacggtaccgttaccgttaaacgtcgaaacccggtacccgtaacgggtcccttacccggcccccgttcgggttaacccc

SEQ ID NO: 117989 - DNA, 642 bp, Homo sapiens
  misc_feature: GYAE6OF01C74GZ.10.27.C05.1.454.CMB.1.raw
  modified_base (308)..(308): a, c, t, g, unknown or other
  misc_feature (308)..(308): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcggtcaccatctcctgcactcggacccagcactgatggttgggctattataaccttgtctccgtgtatcaacaacgccagacaaaccgccccacactcttagtatttangaagtcaagtaacgccgcccttgacgggtttctagtcgtctttctctcgccctcgaagtctggacaacgcggtcctccgagacatcctacgtcggtctaccgacggtctacggaacgacggaggctagaattacttacgtcgtacgacgtacgtctaacgttatacggttaagtacgttgggtacgttaccctttcgttttacggttaacgggttttcggggaaccgggtacggggtaaccgtacggtaccggttaggtaacccggttaccgttaaacggtaccgaaccggtacccgaaacgggtccttacccggtcccccgttccggtacccg

SEQ ID NO: 117990 - DNA, 637 bp, Homo sapiens
  misc_feature: GYAE6OF01CLX0M.10.27.C05.1.454.CMB.1.raw
  modified_base (198)..(198): a, c, t, g, unknown or other
  misc_feature (198)..(198): n is a, c, g, or t
  modified_base (368)..(368): a, c, t, g, unknown or other
  misc_feature (368)..(368): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacngtcggtcaccatctcctgcactcggacccagcactgatggtggctattataccttgtctcctgtatcaacacgccagacaacgccccacactcttagatttatgaagtcagtaacgccggtccctgtagggtttctagtcgtcttctctcgcctccaagtctggacaacncgcctcctgactactctcgtggcctccgaggtctacggaccgacggtacggtctagtaaactttacttacgtcgacgtaacgcgttactaacgttagttagtaaggtacgtttagggttcttcccgtttacgtttaccggttaacggggttttcgggaccggggtaaccgggtaccgtaagggtccgtacgggtaaccccgttaccgttaacggttccgacccggtacccgtacgggtccgtaccccggtccccgttccggttaccccg

SEQ ID NO: 117991 - DNA, 710 bp, Homo sapiens
  misc_feature: GYAE6OF01AZOK8.10.27.C05.1.454.CMB.1.raw
  modified_base (227)..(227): a, c, t, g, unknown or other
  misc_feature (227)..(227): n is a, c, g, or t
tcagcatagtagtgcacgaccggtgctcgatttagacgcgatcgaagggtttggggggggtcacaagaggcagcgctctcgggacgtctccaccatggcctggctctgctgctcctcaccctcctcactcaggacacagggtcctgggccctgtctgccctgactcagcctgcctccgtgtcgtggtctccgtggacaggtcgtcaccatctcctgcactggacccngcactgatggttggctattactacttgtctcgtgtactcaacaaccgccagaaccaaccgccccactactcttgtactttagtacgaagtacaggtaacggccggtacccttacggtacggggttttcctacgttcgtctttcctcgtcgtcccgtaccgtaacgttcgtcggaacctaaccgtaccggtccccttacccgtagaacctaacgttcctacggtcgggtccctaccggaggtccgtacggaacgtacggtacgtacgtagtaaacttacttacgtagtccacgtacctacgtagttacgttaggtaacggtacgtttacgggtcctttccgtttacgttttacggttaacggggttttcccgggacgggtacgggaaccgtcgggtaccgttaccgggtaacccggttacgttaacgtacccggaaccggtccccgtaacggtccccttaccccggtccccgttaccggttccc

SEQ ID NO: 117992 - DNA, 694 bp, Homo sapiens
  misc_feature: GYAE6OF01EUGVO.10.27.C05.1.454.CMB.1.raw
  modified_base (199)..(199): a, c, t, g, unknown or other
  misc_feature (199)..(199): n is a, c, g, or t
  modified_base (313)..(313): a, c, t, g, unknown or other
  misc_feature (313)..(313): n is a, c, g, or t
  modified_base (679)..(679): a, c, t, g, unknown or other
  misc_feature (679)..(679): n is a, c, g, or t
tcagcatagtagtgcacgaccggtgctcgatttagacgcgatcgaaggggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacngtcggtcaccatctcctgccacgtggacccagccactgatggttggctatttaataccttgtctcctggtatcaacaccgccaagaaccaacgcccccatactcttgtatttanagtaagtcaagtaacgccgtacctcggtaacgggtttcagttcgtcttcctctcgtcctaccgtaagtcgtacggaccaaccacccggtccctcccgtacgtacctaacgttcccgttcgtccggtccgtaccgaggtcccgtacggaaccggtaccgaggtacccttaagtaacgtttaacttactacggtactaacggtccttactaagttaagttacggtaaggttaggttcggttcctttaccctttacgttttaacgggtaacggggttttccgggacggttaaccggggacgaccggttccggtaacgggtaccttacggtaaaccgcgtaaccggtaccccgtaaggtccccgttaccncccccgtggttcccc

SEQ ID NO: 117993 - DNA, 668 bp, Homo sapiens
  misc_feature: GYAE6OF01EHWOG.10.27.C05.1.454.CMB.1.raw
  modified_base (319)..(319): a, c, t, g, unknown or other
  misc_feature (319)..(319): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcacgtcggacccagcactgatggttggctattactaaccttgtctcgtggtactacaacaaccgccaagaaccaaacgcccccactacgtcctagtaatttanagtaactacaaggtaacgccggtcccttacggtaggggtttccaggtcctccgtttctccgtcgtccctaccgtaacgtcgtacggaccaaccgtccgtccctccctacgactaacgttcctcggtacggtccctaccggagtcctacgggtaacgacggacggtaccttaggtaaactttaacgttacgtcgactaacgtctaactaagttacgtagtaagtgtaccggttacctcgtttcgtttacggtagggtttccgggagggtaccggacgtacggtccgtacgtaacccgtacgtaacggtccaacggtaccccgaggaccctcccggtccccgtcggtaccc

SEQ ID NO: 117994 - DNA, 607 bp, Homo sapiens
  misc_feature: GYAE6OF01CMYQO.10.27.C05.1.454.CMB.1.raw
  modified_base (353)..(353): a, c, t, g, unknown or other
  misc_feature (353)..(353): n is a, c, g, or t
  modified_base (372)..(372): a, c, t, g, unknown or other
  misc_feature (372)..(372): n is a, c, g, or t
  modified_base (435)..(435): a, c, t, g, unknown or other
  misc_feature (435)..(435): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacaggtcctgggccctgtctgccctgactcagcctgcctccgtgtctgggtctcctggacagtcggtcaccatctcctgcactcggacccagcactgatgttggctattataaccttgtctctgtatcaacaacgcccagaacaacgccccactactcttgtatttatgaagtcaagtaagccggccctcgtacggggttctagtcgtcttctctcncctaccaagtctcgcaacncgtcctccctgacaactctcgtcggctccgaggctaggacgacgtaggctagaattattacgngacacgtctacattaagagtaagtagttggtcgttccttacgtttacgtaacgggttttccgggacggtaacggggtacccgagggtccgttacggtacccggttaacccttaacggtcctaacccggaccctaaacgggtcccgttacccgtcccccgttcggttaccccg

SEQ ID NO: 117995 - DNA, 600 bp, Homo sapiens
  misc_feature: GYAE6OF01CDZY3.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctgacagtcgtcaccatctcctgcactggacccagcactgatgtgggctattataaccttgtctcctgtatcaacaacgccagacaacgcccccacactcttgtatttatagaagtcaagtaagccggtccctcgtagggtttctagtcgtcttctctcgccctacgaacgtcgtgacaaccgccgtccctcccgtcgcctagtcgaggtcgggtccgtccgggtcggaggtactcggacgtcgtagtatttacttacgtggttagtacgtacgtaggttagggatcggactacggccttggtagtctagtttagtcgttacgtacgggtaacgtacgggaaccgtacggtcctacccggtccctacgtcaaccggtacccgaacggaccccaaccctcgtgtaccccg

SEQ ID NO: 117996 - DNA, 718 bp, Homo sapiens
  misc_feature: GYAE6OF01C3SIM.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtggacagtcggtcaccatctcctgctacgtggacccagcactgagttggttgggctaactttactaccttgttcctccgtggtatacaaccaaccgcccaagaaccaaaccgcccccactaccttcttagtatttactagtaacgtacgtaacgtaacggccggtacccgttcgtacggggttttctacggttcgtcctttacgtcctcggtaccctacgtaacgttcgtaccggacaaccggacccggtcccctacccgtgtaaacctaactcgttccggtcgggtacttccccgaaggtccgtcggaacggtaacggacggtactaagtaaattcgttacgcgctagtctactaagttgtaagtacgtagttcggtcgttcccgtttacgttttacgggtaaccgggttttcgggaaccgggtacggaaccgtacggtccggttaccgtacccggttacgtacgtacccgtaacggtccccgtaagggtcccttaccccgggccccgtttcgggtacccccg

SEQ ID NO: 117997 - DNA, 597 bp, Homo sapiens
  misc_feature: GYAE6OF01A2UB4.10.27.C05.1.454.CMB.1.raw
  modified_base (198)..(198): a, c, t, g, unknown or other
  misc_feature (198)..(198): n is a, c, g, or t
  modified_base (276)..(276): a, c, t, g, unknown or other
  misc_feature (276)..(276): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
  modified_base (589)..(590): a, c, t, g, unknown or other
  misc_feature (589)..(590): n is a, c, g, or t
  modified_base (592)..(597): a, c, t, g, unknown or other
  misc_feature (592)..(597): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccanactcttgatttatgaagtcagtaagcggccctcgtaggggtttctagtcgtctttctctgcctccaagtctggcaacncggcctcctgacaatctctgggctcgaggctgacgacgaggctgaattattaactgcagctcatatcgtagatggtgtccttctttcgtaagggttttcgggcgggtaacgggaccgtaggtcgtacggacccgttacgtaacgtaccgacggacccgaacggcccgtaccgtccccccgtcggttacctaccgttccgttaccgttccccccgtcccttccccgttacctaacccgttacgttaccgtcgtccgtacggtacggcgggtacgtcgggaccgtaacgggccgacgtagtacgtnacgtnagcnncnnnnnn

SEQ ID NO: 117998 - DNA, 620 bp, Homo sapiens
  misc_feature: GYAE6OF01DQ7OY.10.27.C05.1.454.CMB.1.raw
  modified_base (605)..(605): a, c, t, g, unknown or other
  misc_feature (605)..(605): n is a, c, g, or t
  modified_base (611)..(618): a, c, t, g, unknown or other
  misc_feature (611)..(618): n is a, c, g, or t
  modified_base (620)..(620): a, c, t, g, unknown or other
  misc_feature (620)..(620): n is a, c, g, or t
tcagcatagtagtgcacgaccggtgctcgatttagacgcgatcgaagggtcctgggccatgtctgccctgactcagcctgcctccgtgtctgggtctcctggacagtcggtcaccatctcctgcactggacccagcactgatgttgggcattataaccttgtctcctggtatcaacaacgccagacaaacgccccacactcttgatttatgaagtcagtaacgcggcctcgagggtttctagtcgcttctctcgccccaagtctggacaagtaccggcctccctgactaactcgtctcgggcctccgaggctgacgacggagctagaattactactgcagctacatatagtagtagtcggtctccttgtttacgtaaggggttttcggacgggtacgggtaccgaagggtccgtacggtaacccgttacgtaacgtcgaacgacccgtaaggtcctcccggtcccccgttcggtacctaccgttccgttccccggttccccgtccccgttccctaaccctaacgtttaccctaagttccggtaccgttacgggcgggtaccgggtaccgtacgggaccgaaacgggccgtaacctaggtacgtanctcgcnnnnnnnngn

SEQ ID NO: 117999 - DNA, 640 bp, Homo sapiens
  misc_feature: GYAE6OF01DGNUA.10.27.C05.1.454.CMB.1.raw
  modified_base (289)..(289): a, c, t, g, unknown or other
  misc_feature (289)..(289): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggaccagcactgatgttggctattataaccttgtctcctgtatcaacaacgccagacaacgcccccanactctgtatttatgaagtcagaacgccgcctacaggacgtcctgacgtcgttactctgccctcaagtcgtcgacacgacggccctccgtacgtaccgtctcgtacggtccgtaccgaggcctggagtagtagacgtctagtaacttacctacgtcgtacgacgccgactattacgttaccgaccgggtaccctaacgggtacgggttcggttacgggtacgggtaccgggtaaccgtaaacgggtccggtacccggttccggtagggtacccgaacggtaccccggaaacggttcccgttaacccgggtccccccgtaccggttacccacccgtttccggttaccccccgg

SEQ ID NO: 118000 - DNA, 629 bp, Homo sapiens
  misc_feature: GYAE6OF01DFLO5.10.27.C05.1.454.CMB.1.raw
  modified_base (453)..(453): a, c, t, g, unknown or other
  misc_feature (453)..(453): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtcgtgggtcctcctggacagtcggtcaccatctcctgcactcggacccagcactgatggtggctattactaaccttgtctctgtatacaacacgccagacaacgccccacactctagatttatgaatcagtaagtcgtccctagtagggttctagtcgtcttctctcgtccctacgtaagtctacggacaacgccggtccctcctagaactaacttcgtacgtcgggccttaccgaggtctacgacgacgacggtctagtaattacgttacngctagctactaattagtagtagtagtcggtcgttaccctttcgtttacggttaacgggttttccgggacgggtacgggtacccgtacggtaccgtacggtaacccgttacgtaaaccggttaccgaccggtaacccggtaacggtccccttacccggtcccccgttcggtaccccg

SEQ ID NO: 118001 - DNA, 588 bp, Homo sapiens
  misc_feature: GYAE6OF01C2Y22.10.27.C05.1.454.CMB.1.raw
  modified_base (304)..(304): a, c, t, g, unknown or other
  misc_feature (304)..(304): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgccacgtcggacccagcactgatggtggctattactaaccttgtctcctgtatcaacacgccagacaacgccccatactctatatttangaatcgagtaacgccgcctagaggttcttctagtctcttctctcgcctacgatcgacgacacacgcctcctnactatctcgnggcctacgnggctagacgaggngactagtaattacttacngcaggtctactagtacgtgtacgtagttcggttaccgtcctttcggtttacgttaaggggtttccgggaccgggtagggaccgtagggtcccgttacggttaaccccgtaccgtaacggtcgtaaccgggaccctaaggtcccgtcccgttccccggtaccg

SEQ ID NO: 118002 - DNA, 647 bp, Homo sapiens
  misc_feature: GYAE6OF01BVMRF.10.27.C05.1.454.CMB.1.raw
tcagcatagtagtgcacgaccggtgctcgatttagacgcgatcgaagggtttgggggggtcacaagaggcagcgctctcgggacgtctccaccatggcctggctctgctgctcctcaccctcctcactcaggacacagggtcctgggccctgtctgccctgactcagcctgcctccgtgtctggtctcctggacagtcggtcaccatctcctgcacgtcggacccagcactgatggttggctaattataaccttcgtctccgtggtatacaacaaccgccaagaacctaaacgcccccaacacctcttagtacttttagagtaacttcgaaggttaacggccggtaccccttaggtacggggttttctaggtccgtcttcgtcgtcgtcctaccgtaagtcgtcggacaaccgtaccggtcctacccgtacgtactaacgtccgttcgtcggtccgtccgacggtcgttacggaccggacgacgggtacctagtaacgttattacgtacgctacgtactacgattaacgtagtaaggcgttaggttcgtacctttcgttacggttaacggtttcgggacggtacggaccgtagcgtacaccggtctaaacgtcgacgtaccgtacgccgtccgtcccgtcgtacccg

SEQ ID NO: 118003 - DNA, 566 bp, Homo sapiens
  misc_feature: GYAE6OF01C769Z.10.27.C05.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
  modified_base (553)..(553): a, c, t, g, unknown or other
  misc_feature (553)..(553): n is a, c, g, or t
  modified_base (555)..(566): a, c, t, g, unknown or other
  misc_feature (555)..(566): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttggcattataaccttgtctctggtatcaacaacgcccagacaaacgcccccanactcttgatttatgaagtcagtaagcggccctnaggggtttctagtcgcttctctgcctcaagtctggacaacacgcctccctgacaatctcgtggcctcgaggctgacgacgaggctagaatatactgcagctcatatagtagtagtggtctccttcgtttacgtaagggttttcggacgggtaacgggtaccgtagggtacctacggtacccgttactaacgtacgaccgtacccgaacggtccgtcccgtacccccgtcggttaccaccgtccttccgttccccacccttccctaccctaacttacgtagtcgtacgtcggacggtcgggctgggacaacgggcacgagtagngnnnnnnnnnnnn

SEQ ID NO: 118004 - DNA, 575 bp, Homo sapiens
  misc_feature: GYAE6OF01A51EA.10.27.C05.1.454.CMB.1.raw
  modified_base (368)..(368): a, c, t, g, unknown or other
  misc_feature (368)..(368): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttgggctattataaccttgtctctggtatcaacaacgccagacaacgcccccacactctgtatttatagtagtcaagtaagcggccctacgtagggtttctagtcgtcttctctcgcctcagtctgacacncgcctcctgacatctcgtcggctccgagctgacgacgagactagaattagtactgacacgctacatagtagtaagtagttcggtcgttcccttcgtttacggttaacgggttttcgggacgggtacgggaccgtggtaccgttacgacccggttcgtaagtaccgaccggacccgtaacggtccgtcccgtcccccgtcggtacccc

SEQ ID NO: 118005 - DNA, 637 bp, Homo sapiens
  misc_feature: GYAE6OF01AED30.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccagcagtgacgttggtgttataactatcgtctcctgtaccaacaacaccagcaaacgcccccaaactcatgtattttgatgtcagtactccgcctcgtagggtttactaagtcgtcttctcgtgcctacaagtctaggactaaccgaccggtccctcccttcgacctagtcctacgtcgggtacctcccgaggtacctgggaacggtacgacgggtcttaggtaactttacgttaaccgtcgtacgacgtctactaacttaactaaccgaaccgagtccgacgtaccttacttacgtagttacggttccgggacggtaccggaacgtaacggtccgtacggtacccggttcgtaaccggtcgaaccgtaccccgtaaacggtccccttacccggtcccccgttcggtaccccg

SEQ ID NO: 118006 - DNA, 756 bp, Homo sapiens
  misc_feature: GYAE6OF01BUEBB.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctccgtggacagtcgtcaccatctctgcactcggaccagcactgatggttggctattactaaccttgtctctgtatacaacacgccaagaaccaaacgccccactactcgttagtactttatagtaacgtactaaggtaacgccggtacccttacggtagggtttactagtcgtccttctcgtacgtccctaccgtaacgtcgtacggaccaaccgaccggtccctaccgtagaacctacgttcctcggtacgggtacctaccggacggtacgttacggaaccggtaacggacgggtacttaacggtaaacgtttacgtttaaccgtgtaccgtaacggtctaaccgtaattaggttaacgttaacggtacgttacgggttaccgtttacccgttttaccgtttacgggtttaacgggggttttccgggaacgggggtaaccgggtaacccggttacggggtaccggtttaaccggtacccccggttaacggttaacccgtacccggaaccggtaaccccggtaacgggtccccttaccccgggtacccccggttacggttaacccccg

SEQ ID NO: 118007 - DNA, 607 bp, Homo sapiens
  misc_feature: GYAE6OF01ADE94.10.27.C05.1.454.CMB.1.raw
  modified_base (242)..(242): a, c, t, g, unknown or other
  misc_feature (242)..(242): n is a, c, g, or t
  modified_base (462)..(462): a, c, t, g, unknown or other
  misc_feature (462)..(462): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggnattataaccttgtctcctgtatcaacaacgcccagacaacgccccacactcttagatttatgaagtcagtaacgccggccctcgtagggtttctagtcgtcttctctcgccctcaagtctggaccaacgaccgtccctccctacgaacaacttccttcgtcgggcctccgaggtctacggacgacggaggctagtaaatattacgtgcctagctacattntagtagtagttcggtcgttccttcgtttacggttaacgggtttccgggacgggtacggggtaccgacgggtccgtacgtacccggtcccgtaacgtaccgaccggtaccccgtaacggtcccgtacggtcccctccggttcccgg

SEQ ID NO: 118008 - DNA, 680 bp, Homo sapiens
  misc_feature: GYAE6OF01AN4CP.10.27.C05.1.454.CMB.1.raw
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttgggctattactaaccttgtctcctggtatcaacacgcccagacaacgcccccacactcttgatttanagaagtcagtaacgcgccctnaggactcctgactcggttctctcgtccctcaagtctggacaaccgaccggtcctcccgtcgaccgttctccgtcggcctccgaggtctaggacgtagtggacggtctaggtaactttacgtactcggacgacgtccgactaattacgttccggaaccggtacccccgtaaagggttcggggtttacggtttccggggaccggggtaacgggtaaccggttaacgggtaccggttacccggtacccgggttagggtaacccgacccgggttacccccggaaagggttcccccgttacccgggtccccccccgttagggttaccccttaccccgttcccggtttacccccccggg

SEQ ID NO: 118009 - DNA, 582 bp, Homo sapiens
  misc_feature: GYAE6OF01E4R4F.10.27.C05.1.454.CMB.1.raw
  modified_base (306)..(306): a, c, t, g, unknown or other
  misc_feature (306)..(306): n is a, c, g, or t
  modified_base (410)..(410): a, c, t, g, unknown or other
  misc_feature (410)..(410): n is a, c, g, or t
  modified_base (431)..(431): a, c, t, g, unknown or other
  misc_feature (431)..(431): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggctattataaccttgtctcctggtatcaacaacgcccagacaaacgcccccacactcttgatttangaagtcagtaacgcggccctgacggggtttctagtcgctttctctcgcctccaagtctggcaacacgcctcctgacaatctcgtcggctccgagctgacgacgnggctagaatacttatcgacanctacatagtgtagagttggtcgtccgtttctttacgtaacgggttttcgggacgggtacgggacccgacgggtctacggtacccgttcccgtaaaggttcccgaacgccccgtaaacgggcccgttccggtccccccgttcgggtaccccg

SEQ ID NO: 118010 - DNA, 638 bp, Homo sapiens
  misc_feature: GYAE6OF01B2GXP.10.27.C05.1.454.CMB.1.raw
  modified_base (215)..(215): a, c, t, g, unknown or other
  misc_feature (215)..(215): n is a, c, g, or t
  modified_base (441)..(441): a, c, t, g, unknown or other
  misc_feature (441)..(441): n is a, c, g, or t
tcagcatagtagtgcacgaccggtgctcgatttagacgcgatcgaagggtttggggggggtcacaagaggcagcgctctcgggacgtctccaccatggcctgggctctgctattcctcaccctcctcactcagggcacgagggtcctgggcccagtctgccctgactcagcctgcctccgtgtcgtgggtcctccgtggacagtccaatcaaccntcctcctgcacgtcggacccactagttacattaggaataatagtaatagtcgttcctaccgtaggtaaccaaactacgtaacccgaaggaccaaaaccgtcccccaaaatgtaactgtaatttagagtatgtacaaggtaactccgtaccgtaggtacgggttctacgtactcgttactttcgttacgccttacaagttcgacggactaacgaccgtcctccgtanacctgtacgtcgtcggtactcgacgtacgtacgaggacgaggtctaggtaattacgttacgctacgacgtactactaaatacgtaacgaacggtccggacgtaggtccgggtttggccggtacgggacggacctacgcgtacgcgtacgtgacgtaccgcgtagtcctcccgtacccgtgccttcgtccgttacccg

SEQ ID NO: 118011 - DNA, 751 bp, Homo sapiens
  misc_feature: GYAE6OF01CBLYP.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcagtcaccatctcctgcactggaaccagcagtgtactttgtgacttataactatgtctctgtaccagccaccaccaggacaaacgacccctaaacttccttgttttcgacgtacagtaacgcggcctagacggtacgttccctagtacttcggttcctccgttacgcccttacgaacgttcgtacggacctaaaccgtccggtccctacccgtcgtacccgtcgtcgtcgggtccttccggacgtccgttaggacggtatgggaacgtcttaggtaactttaccgtaacgttcggacctacggtacgtactaacgttaaccggttaccgaaaccgggttacccccgtaaacgggttacgggggtttacggttttacgggggaacccgggggttacggtaaaccgggttaacggggtaacccgggtaccccggttaccgggttcgggttaaccgaacccgggtaccccggtaacgggtccccgttaacccgggtccccccgtttaacgggtccttaaacccgttccgttaccccgttcccccgttaaccccg

SEQ ID NO: 118012 - DNA, 612 bp, Homo sapiens
  misc_feature: GYAE6OF01D12IW.10.27.C05.1.454.CMB.1.raw
  modified_base (198)..(198): a, c, t, g, unknown or other
  misc_feature (198)..(198): n is a, c, g, or t
  modified_base (330)..(330): a, c, t, g, unknown or other
  misc_feature (330)..(330): n is a, c, g, or t
  modified_base (602)..(603): a, c, t, g, unknown or other
  misc_feature (602)..(603): n is a, c, g, or t
  modified_base (605)..(605): a, c, t, g, unknown or other
  misc_feature (605)..(605): n is a, c, g, or t
  modified_base (608)..(612): a, c, t, g, unknown or other
  misc_feature (608)..(612): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctctggtatcaacaacgcccagacaaacgcccccanactcttgatttatgaagtcagtaagcggcctcgaggggtttctagtcgtcttctctgcctcctaagtctggcaacaccggcctccctgacaatctcgtggctcaggcgtgacgacgagctagaatattacgngcagtctcatatgtagatggtcgtccttctttacgtagggttttcggacgggtacgggaccgaggtccgtacgtacccgttaaccgtaacgtacgacgtaccccgtaacggtcccgtaccccgggtaccccccttacgggtaccctaaccttcccgttacccgtttaccccctaccccgttaccctaccccgtaacttaccgtacgtccgtacgtcgggtacgccggggtacgtcgggaccgtaacggccgtaccgtaagtcggactgcacnntnacnnnnn

SEQ ID NO: 118013 - DNA, 646 bp, Homo sapiens
  misc_feature: GYAE6OF01C9X3N.10.27.C05.1.454.CMB.1.raw
  modified_base (290)..(290): a, c, t, g, unknown or other
  misc_feature (290)..(290): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatcctcctgcactcggacccagcactgattggttggctattataaccttgtctcctgtactacaacaccgccagaccaaacnccccacactcttgtatttatagaagtcaacggtaacgccggtccctcgtacgggtttctacgtccgtcttcctctcgtaccctaccgtaagtcctcggaccaacgtaccggtccctccgtagactactccgtacgtcggtctaccgaggtactggaacgacggaggtacgtagtaattacgttactgacgtcgtactactagtagtaggtagtacgttcggtactccgtttacgttacggttaacgggtttccgggacggtaccgggtacgtacggtaccgtacggtaacccgttccgtaacgttaccgaccggtacccgaacggtcccgtccccggtccccgttcggttaccccg

SEQ ID NO: 118014 - DNA, 651 bp, Homo sapiens
  misc_feature: GYAE6OF01CCYU3.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcgtcaccatctctgcactggacccagcactgatggtggctattactaaccttgtctccgtgtactacaacaacacccaagaaccaaacgcccccactactcttagtacttatagaagtacgaaggtaacgccggtccctacggtacgggtttcgtagtccgtacttctactcgtccctactaacgtcgtacggacaaccgccgtccctaccgtgaactacgtcctcggtcggtacctcgacgtacgtacggaacggacgacgtacgttagtaaacttctacgcgtacacgtctactatagtagtacgtgtacggtcgttacttacggtttacgtaacggggtttcggacgggtacggtaccgacggtccgtaccggttaccgtacgttaacccgtacgaacccggtacccggtaacgggttccctaccccgggtcccccggttggtaccccc

SEQ ID NO: 118015 - DNA, 686 bp, Homo sapiens
  misc_feature: GYAE6OF01BNF31.10.27.C05.1.454.CMB.1.raw
  modified_base (326)..(326): a, c, t, g, unknown or other
  misc_feature (326)..(326): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctctcactcaggacacagggtcctgggccctgtctgccctgactcagcctgcctccgtgtctggtctccgtggacagtcggtcaccatcctcctgccacgtcggacccagcactgatggtggactattactaaccttgtcctccgtaggtactacaaaccgaccgcccaagaaccaaaccgacccccacacttcttagtatttanacgtaagtacgaaggtaacgccggtccctacggtagggtttctacggtcgtcttacgtcgtcgccctacgaagttcacggacaacgaccggtccctacccgtagaacctaattccgtaccgtggaccctccgaggtcctacggaccgtacggacggtactagtaaacttacgttacacgactacgcgtacaagtttacgtagtacgtaagtcggttcgtacctttacgtttacgttaacggggtttccgggacgggtaacgggtaccgtacggtccgttaccgggtacccttacggttaaccgtaccgtaaccggaccccgtaaggtccccgtaccccggtcccccggttccggtacccg

SEQ ID NO: 118016 - DNA, 698 bp, Homo sapiens
  misc_feature: GYAE6OF01BP7JM.10.27.C05.1.454.CMB.1.raw
  modified_base (293)..(293): a, c, t, g, unknown or other
  misc_feature (293)..(293): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcggtcaccatcctcctgcactcggacccagcactgatggttggctattataaccttgtcctcgtgtatcaacaacgccagacaaacgcccccanactctgtattatgaagtcagtaacgccggccctacgtaggggttttctaggtccgtcttctcgtcgtcctacgaagtcgtacgcaaccgccgccctccgtagaactacgtctacgtcgggacctcgacggtcgtcgaacgacgaggtctaggtaaacttaacgtttacgtcgaccgtacgtccttactaagtttacgtaacggttaaggtaaccggtttcgggttaccgttcccgtttaccgttttaaccggttaacgggggtttttcccgggaacggggtaccggggtaacccgtcgggtaccgtacccgggttaacccggtttaaccgtaaccggtaccgtaacccgggtaacccccgtaacgggttccccgttcccgtacccccccggttgggttaaccccc

SEQ ID NO: 118017 - DNA, 637 bp, Homo sapiens
  misc_feature: GYAE6OF01AWQJ3.10.27.C05.1.454.CMB.1.raw
  modified_base (261)..(261): a, c, t, g, unknown or other
  misc_feature (261)..(261): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctcgggccctggtctgccctgactcagcctgcctccgtgtctggtctccgtggacagtcgtcaccatctctgcactggaccagcactgatgttggctattataccttgtctctgtancaacaccgaccagacaacgccccacnctctgtattanagtagtacagtaacgcggtccctacgtacgggttctacgtcgtcttctctcgacctacgtagtacgtcggaccaaccgtaccggtccctccgtacgaacctaacttccgtcggtcgggtaccttacccgaagggtccgtcgtaaccggaacggtacggtaccttaaggtaacttaacgttaccgtcgaccctagttaacctacgtaactaagtcgtaaggtagtttcggtccttacgtttcgttacgtacgggtttcggacgggtagggacccgtggacctacgggtacctcgtaacgtcccgacgacccgacggtaccctccggtccccgtcgtcccg

SEQ ID NO: 118018 - DNA, 668 bp, Homo sapiens
  misc_feature: GYAE6OF01B4EWY.10.27.C05.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (656)..(656): a, c, t, g, unknown or other
  misc_feature (656)..(656): n is a, c, g, or t
  modified_base (660)..(661): a, c, t, g, unknown or other
  misc_feature (660)..(661): n is a, c, g, or t
  modified_base (663)..(665): a, c, t, g, unknown or other
  misc_feature (663)..(665): n is a, c, g, or t
  modified_base (667)..(667): a, c, t, g, unknown or other
  misc_feature (667)..(667): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctgtatcaacaacgcccagacaaacgcccccanactcttgatttangaagtcagtaagcggccctcgaggggtttctagtcgctttctctgcctccaagtctggcaacaccggcctccctgacaactctcgtgggctccaggctgacgaccgaggctagaattattactgcagtcctcgaattatggtagagttggtcgtcctttcgtttacgttaaacgggtttttcgggacgggtaacgggtacccgaacgggtccgtacggtaaccgttaccgttaacgtcgtaaccgacccgaacgggtcccttacccggacccccgttaccgggtcctaaccgttcccgttccggtttccccccgtaccccgtttacccctacccgtaacccctttaaccttaacgttcggtacccgtgggtaacggtacccggggtcgttacggggaacccgtaacggggtaccgtacccggtaagttaacggcacgtacgcgcncgtnnannngng

SEQ ID NO: 118019 - DNA, 905 bp, Homo sapiens
  misc_feature: GYAE6OF01BNDX1.10.27.C05.1.454.CMB.1.raw
tcagcatagtagtgcacgaccggtgctcgatttagacgcgatcgaagggtttggggggggtcacaagaggcagcgctctcgggacgtctccaccatggcctggctctgctgctcctcaccctcctcactcaggacacagggtcctgggccctgtctgccctgactcagcctgccctccgtgtcgtgggtcctccgtggacagtccggtcaccactctcctgccacgtcggacccagcactgagttggttggactaagttaacttaaccttcgtccttccgttaggtaactaccaaaccgaaccgacccaacgaacccaaacccgacccccctaacctaccttacgtttagttaatttagtacggtaacgtacgtaacggtaaccggcccggtacccgttacgggttacggggttttacctacggttccttccgtttccgttaccgttccgtacccttaccgtaacgttccgtaccggaacctaacccgtaccccggtcccttacccgtacgtaaaccctaaccgttccgttccggtccgggtaccctacccggtacggtccgtaccggaaccggtaacggtacgggtaccgttaacgtaacgtttaacgttaccgtacgtaccgtacgtaccgtaacgttaacgttacgttaggttaaacgggtacggtttacgggtttacccgtttacccggtttttaaccggtttttaccgggtttaaacccgggggttttaccgggggaaccgggggttaaccggggtaaacccggttaccggggtacccgttaacccggggttaaccccggtttaaacccggttaacccggttacccggtaaaccccgggtaacccggtaacccgggttccccgttacccccgggttccccccggttccggttaccccccg

SEQ ID NO: 118020 - DNA, 818 bp, Homo sapiens
  misc_feature: GYAE6OF01CAGTT.10.27.C05.1.454.CMB.1.raw
tcagcatagtagtgcacgaccggtgctcgatttagacgcgatcgaaggggtttgggggggggtcacaagaggcagcgctctcgggacgtctccaccatggcctgggctctgctgctcctcaccctcctcactcaggacacagggtcctgggccctgtctcgccctgactcacgcctcgcctccgtgtcgtgggtcctccgtggacacgtcggtccacctactcctccgtcgcctaccgtaccgggacccaggcctacgtgtagttgggttacggactaatttaacttaaccttcgttccttccgttaggttaactaaccaaaccgaaccgacccgaagaaacccaaaccgtacccccaactaacttcttagttaatttacgtaggtaacgtacgtaacggtaaccggccgggtacccgttacgggttacgggttttaccgtacggttccgttcctttcgtcgttccgtccctacgtaacgtcgtacggaccaaccgtcccgtacccttaccgtacgaactactcgtcggacggtacctccggaacggtctacgggaacgtacggacgtctaagtaacttacgttacggctccgaacttccgtaattacgttaacggttaggtaacggttacgtttccgggttacctttccggttttaccggttttaaaccggggtttacggggtttacccgggggaacgggtttaccggggacccggttacgggtacccgttaccggttacccttaaccggttaaccgtaccgacccggtacccgtaccgggtccccgttacccccggtccccggttcgttacccccg

SEQ ID NO: 118021 - DNA, 701 bp, Homo sapiens
  misc_feature: GYAE6OF01AVQ0P.10.27.C05.1.454.CMB.1.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctcgtgtctggtctcgtgacngtcggtcaccatctctgacacgtcggaccngcactgtatggttggactattacttaccttgtctcgtgtactacaacaccgcccaagaaccaaccgcccccanacctcttagtattatagagtcgaaggtacgccgtcctaggttacgggtttctacgtccgtcttactcgtcgtccctacgtagtcgtacgacctaaccgacccgtcctacccgtacgaacctaacttccgtacgtcggtcctacggacggccgtaacggaccggtacggacgtactacgtaatttacgtaccgtagacctacgtacctaactaaggttacgttacgggttaaggttcgttcgggtttccgttacccttttcggtttaacgggtttaccggggtttaccggggacgggtacccgggtacggtacgggttacccgttaccgggacccgttaccgtaacgggtaccacccggtacccgtaacggtacccttcccccgggtccccgttagtaccccg

SEQ ID NO: 118022 - DNA, 725 bp, Homo sapiens
  misc_feature: GYAE6OF01B8WU5.10.27.C05.1.454.CMB.1.raw
  modified_base (306)..(306): a, c, t, g, unknown or other
  misc_feature (306)..(306): n is a, c, g, or t
tcagcatagtagtgcacgaccggtgctcgatttagacgcgatcgaaggggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttgggctattataaccttgtctcctgtatcaacaacgccagacaacgcccccacactcttgatttangaagtcaagtacgccggcctacgtagggtttctagtcgtcttctctcgcctacctaacgtctcggaccaacaccggtccctcccgtacgaactaacgtccttacgtcgggtcctccgacggctacggacggacggacgggtactacgtaaattacttacgtacgtacgacgtaccttacgaacttaagtaggttaaacgtcggtttagggttcccttacccggttttaccgtttttaccggttaaaccgggggttttttccgggggaacccgggggtacgggtaaccccgggtaacgggtacccggttacccgggttaaccccggttacccgttaaacgggtaccccgtaaaccgggtaacccccggtaaacgggccccgttacccccgggtcccccccgttaccggggttaacccccg

SEQ ID NO: 118023 - DNA, 664 bp, Homo sapiens
  misc_feature: GYAE6OF01BL9B2.10.27.C05.1.454.CMB.1.raw
  modified_base (251)..(251): a, c, t, g, unknown or other
  misc_feature (251)..(251): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggaccagcactgatgtggcattataccttntctcgtgtactacaacaaccgccaagaccaaacgcccccacactcttagtattatagaagtcaaggtaacgccgtcccgttgtacgggtttctacggtcgtcttctctcgccctaccagtcgtacggacaacgaccgtaccctccgtacgtactactcgtacgtcgggtcctaccgacggtcgtacggaaccgtacggacgtacgttaagtaacttacttacgtacgacctacgtactaacctaattaacgttacggttaaggacgtttacgggtacctttacccgtttacgtttacgggttaacgggtttccggggacgggtacggtaacgcggtacgtaccggtaacccgttaccggtaaggtcccgaaccggtcccgtaacgggtccctcccggtcccccgttgtacccg

SEQ ID NO: 118024 - DNA, 836 bp, Homo sapiens
  misc_feature: GYAE6OF01EL1W9.10.27.C05.1.454.CMB.1.raw
  modified_base (198)..(198): a, c, t, g, unknown or other
  misc_feature (198)..(198): n is a, c, g, or t
  modified_base (274)..(274): a, c, t, g, unknown or other
  misc_feature (274)..(274): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctccgtggacngtcgtcaccatctcctgcactcggacccagcactgagtggttggactattactaacttgtctctggtatcaacacnccagacaaacgccccacactcttgtatttatagaagtcagtaacgccggtaccctcgtacgggtttctacgtcgtctttactctcgcccttaccaacgttccgtacggacctaaaccgtcccgggtaccccttacccgtacggtaaaccctaacgtttcccgttaccggttccggggtaccccttacccggaacggggttacccgttacgggtaaacccgggaaccgggtacggggttaccttaacggggttaaaacttttacccggtttaaaccgtcggtaaccctaacggttacccttaaaccgtaattttaacgggttagggtttaacggtagggtttaccgggtttaccgtttacccttttacccgggtttttaacgggtttaaaccgggggtttttacccgggggaacggggttaaccgggggtaaacccgtacggggtaacccggtttaccgggtaaaccccggtttaccggttaaaaccggtcccgtaaacccgggtaccccggtaaaccgggttcccgttcccccgggtcccccccggtttacggttacccccg

SEQ ID NO: 118025 - DNA, 782 bp, Homo sapiens
  misc_feature: GYAE6OF01BK1MY.10.27.C05.1.454.CMB.1.raw
  modified_base (624)..(624): a, c, t, g, unknown or other
  misc_feature (624)..(624): n is a, c, g, or t
tcagcatagtagtgcacgaccggtgctcgatttagacgcgatcgaagggtttggggggggtcacaagaggcagcgctctcgggacgtctccaccatggcctggctctgctgctcctcaccctcctcactcaggacacgagggtcctgggccctgtcctcgccctgactcacgcctcgtcctcgtcgtcgttcggtcctcgtcggactacgtccgtcacctctcctccgtcgacctacgtccggacccacgccactgtagtggttcggtactaacttacttacttcgtcctccgttagtactaacaaccgaaccgaccgaacgaaccaaccccgaccccctactactttcgttagttactttacgtacggtaacgtagtaacgtaacggtcccgtcccgttaggttacggtttacgttacgttccgtccttccgtcgtccgtacccttaccgtacgtccgtacggaccaacccgtacccgtacccctcccgtacgaaccgttaacttcgggttacccgtcggggttccctaccgggtccggtgacccgggaacgtaacgggtacgttaccgtaaggttaaactttaccgttcgtacgtaccacgtacttacggtaattaaggttnttaacgggttggttcggttaccctttcgtttacggtttacgggttacggggttccgggaccggggtacggtaccgtcggtaccgttaccggttacttaccgaacgtaccggttacggtacctacccgggtcctcccgggttcccctcggttaaccccg

SEQ ID NO: 118026 - DNA, 689 bp, Homo sapiens
  misc_feature: GYAE6OF01DMO5Z.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtccacatcctcctgcacgtcggacccagcactgagttggttggctattataaccttgtctcctgtatacaacacgccacgacaacgccccacacttcttagtatttactaggaactcaggtacgcgcccttcgtaggttctagtctcttctctcgtccctaccgtagtctcggacctaaaccgaccggtcccctacccgtacgactaacttccgtcgtacggaccttccgacggtccgtacggaaccgtaacggaacggtcctaagggtaaacttacgttacgtccgctacgttacctactaagttaacttagggttacgtaggtttcggttcgttcccgtttacgttttacggttaacgggggttttcccgggacgggtaccggggttaaccgcgggtaccgttcggtaaccccgttaccgtaaacgtacccgaacggtacccccggaacggtcccgtttcccgccccccggttgggttaacccc

SEQ ID NO: 118027 - DNA, 591 bp, Homo sapiens
  misc_feature: GYAE6OF01BOTLC.10.27.C05.1.454.CMB.1.raw
  modified_base (317)..(317): a, c, t, g, unknown or other
  misc_feature (317)..(317): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagtcactgatggttggactattactaaccttgtactcctggtactacgaacaacgcccagaaccaaacgcccccacactcttgtatttangtaatcagtaacgcgcctcgtaggtttctagtcgcttctctcgcctcgaagtcgtcggacctacgaccggtccctccgtacgaactaacttccgtcgtacggtcctccgaggtctacgacgacggtagctacgtaattattacgtgcacgtactactatgtagtagtagttgtcgtccttcgtttacgtaggttcggacggacggtacgacggtcctacggtacccttacgtacgtacgaccgccgtaacgccgtcccgtccccgtcggtaccc

SEQ ID NO: 118028 - DNA, 633 bp, Homo sapiens
  misc_feature: GYAE6OF01EQ2C6.10.27.C05.1.454.CMB.1.raw
  modified_base (312)..(312): a, c, t, g, unknown or other
  misc_feature (312)..(312): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctcgtgtctgggtctccgtggacagtcggtcaccatcctcctgcactcggacccagcactgatggttggactattactaaccttgtctcctgtatacaacacgaccagaaccaacgccccactactctatactttangtaactcacgtaagccgtcctcgtagggttctaggtctcttctcgtcgccctactaagtcgtacgacaaccgaccggcccttcctacggtacaagttctcggtcgggtccctcgaacgtctacggaacggacggtacggcttaagtaattacttacgcgtacagccttacagttaacgtagttagtagttcggtccttcgtttacgttacggttaaggtttccgggacgggtacggtacgcggtccgtacggtaccggttaccgtaacggttcccaaccggtaccctacgggtaccctccccggtccccgtcggttacccg

SEQ ID NO: 118029 - DNA, 737 bp, Homo sapiens
  misc_feature: GYAE6OF01BRO8G.10.27.C05.1.454.CMB.1.raw
  modified_base (199)..(199): a, c, t, g, unknown or other
  misc_feature (199)..(199): n is a, c, g, or t
  modified_base (245)..(245): a, c, t, g, unknown or other
  misc_feature (245)..(245): n is a, c, g, or t
  modified_base (270)..(270): a, c, t, g, unknown or other
  misc_feature (270)..(270): n is a, c, g, or t
  modified_base (371)..(371): a, c, t, g, unknown or other
  misc_feature (371)..(371): n is a, c, g, or t
  modified_base (699)..(699): a, c, t, g, unknown or other
  misc_feature (699)..(699): n is a, c, g, or t
  modified_base (706)..(706): a, c, t, g, unknown or other
  misc_feature (706)..(706): n is a, c, g, or t
  modified_base (709)..(709): a, c, t, g, unknown or other
  misc_feature (709)..(709): n is a, c, g, or t
  modified_base (714)..(714): a, c, t, g, unknown or other
  misc_feature (714)..(714): n is a, c, g, or t
  modified_base (718)..(718): a, c, t, g, unknown or other
  misc_feature (718)..(718): n is a, c, g, or t
  modified_base (724)..(724): a, c, t, g, unknown or other
  misc_feature (724)..(724): n is a, c, g, or t
  modified_base (726)..(726): a, c, t, g, unknown or other
  misc_feature (726)..(726): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatggttggactattataaccttgtctcctggtactcaacaccgccagacaacgccccanctctagtattatgaacgtcagtacgccggtcctggtacgggtttcngtcgtcttactctcgacctcagtcncggacaaccgccggtccctcgtacgaactactcgtaccggttcggccgtcgacggtcctaggaccggtaacggtcggtacgttagtaaacttgtttaaccnggtaccgtacgtcttactaagttagtacgtaaggtcgttggtacccgttacggtttactttacgggttaacgggtttccggacggggtaaccggtaaccgcgggttaccgtaccgttaacccggtacgttaacgtaccgtaaccgggtacccggtaacggttcccgtaccccggtaccccgtttacggtaccccttacccgtttaacccggttcccccgtttaccccgttaacccccgttcccttaaccgtacccgttacgtacccgtcggtaccgttaaccgggccggttaccgggtaccgcgggttaccgaaccggtgtaaacccnggttacncgnggtcnggtncgtacngngacctgctaag

SEQ ID NO: 118030 - DNA, 574 bp, Homo sapiens
  misc_feature: GYAE6OF01DJNDL.10.27.C05.1.454.CMB.1.raw
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (367)..(367): a, c, t, g, unknown or other
  misc_feature (367)..(367): n is a, c, g, or t
  modified_base (428)..(428): a, c, t, g, unknown or other
  misc_feature (428)..(428): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgcccccanactcttgatttangaagtcagtaagcggccctcgtagggtttctagtcgcttctctcgcctcaagtctaggcaacncggcctcctagacaatctcgtggcctccgaggctagacgacgaggctagaattacttacgngcagctacatagtgtaagtagtggtctccttacgtttacgtaacgggtttccggacgggtacgggaccgtacgggcctacggtacccgttccgtaacgtccgaacggtcccgtaacgggccttcccggcccccgttcgggtacccc

SEQ ID NO: 118031 - DNA, 575 bp, Homo sapiens
  misc_feature: GYAE6OF01CI8DW.10.27.C05.1.454.CMB.1.raw
  modified_base (319)..(319): a, c, t, g, unknown or other
  misc_feature (319)..(319): n is a, c, g, or t
  modified_base (428)..(428): a, c, t, g, unknown or other
  misc_feature (428)..(428): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctgtatcaacaacgcccagacaaagcccccaacactcttgatttatgaatcaagtaagcgcctnagggtttcagtcgtcttctctgcctccaagtctggacaacacggcctccctgacaatctctggctcgagctgacgacgaggctagaatattactgcagctcatatgtanagtggtcgtccttcgttttacgtaaacgggttttcggaccgggtaacgggaacccgaagggtccttaggaaccccggttccttaaaaccgggttccaaccggaccccgaaacgggtcccgtccgtccccccccgttcggggttaccc

SEQ ID NO: 118032 - DNA, 555 bp, Homo sapiens
  misc_feature: GYAE6OF01BB3UP.10.27.C05.1.454.CMB.1.raw
  modified_base (226)..(226): a, c, t, g, unknown or other
  misc_feature (226)..(226): n is a, c, g, or t
  modified_base (417)..(417): a, c, t, g, unknown or other
  misc_feature (417)..(417): n is a, c, g, or t
  modified_base (504)..(504): a, c, t, g, unknown or other
  misc_feature (504)..(504): n is a, c, g, or t
  modified_base (546)..(546): a, c, t, g, unknown or other
  misc_feature (546)..(546): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctctgcacgtggaaccngcagtgtactttgttgcttataactatgtctcctggtaccagccaccacccaggccaaacgcccccaaacttcctttgttttcgaggtcagtaacgccgccctgacggcgtcctgactcggttctcgtgcctccaagtctggacaacgaccggccctccctgaccgttctcgtcggcctcgacgctggagntggagtctgacttactactgcagcgatactatcgacgtcccagtagggttcgttgggcggtcggacgaggtcgaccgtcgtgggtcncgaccgaggcctacgccccgtcggtcaccttcgtccttcccncccgttccc

SEQ ID NO: 118033 - DNA, 761 bp, Homo sapiens
  misc_feature: GYAE6OF01BB4PT.10.27.C05.1.454.CMB.1.raw
  modified_base (199)..(199): a, c, t, g, unknown or other
  misc_feature (199)..(199): n is a, c, g, or t
tcagcatagtagtgcacgaccggtgctcgatttagacgcgatcgaagggtttggggggggtcacaagaggcagcgctctcgggacgtctccaccatggcctggctctgctgctcctcaccctcctcactcgaggacacagggtcctgggccctgtctcgccctgactcagcctgcctccgtgtctgggtctcctggacngtcggtcaccatcgtcctgcactcggaccagcactgatggttgggctaattactaacttcgtctcgtgtactacaacaccgccaagacaaaccgccccacgtacttacttgtattacgtagtaacgtacgtaagtaacggccgtcccgtacggttacgggtttacctaacggttccgtccttacgttccgtaccgtccccttaaccgtaacggtccttacgggaaccctaacccggaacccggttcccccgtaccgtaacgaaccgttaaccgttccgtccgtcgggtaccccgtacgtcggtcgttaacggaaccggtacggtacggtacgtagtaacttaacgttcgtacgtacgacgttccgtaacgttaatcggtacggtacgtaaggtttccggtacgttcccgtttacggtttaaccgttaccggggttttacggaccgggttaccgggaacgttaccgggttccggtaacccggttaccgttaccgtaacggttaccgaaacccgggtaccgtaaccccgcggtttaacccccggtcccgtaccgggttaacccc

SEQ ID NO: 118034 - DNA, 612 bp, Homo sapiens
  misc_feature: GYAE6OF01BN24G.10.27.C05.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (471)..(471): a, c, t, g, unknown or other
  misc_feature (471)..(471): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacagtcgtcacctatctcctgcactcggacccagcactgatggttggctattataccttgtctctgtatcaacacgccagacaacnccccatactntgtattatagaacgtcaggtacgccgtcctacgtagggttctagtcgtcttctcgtcgtcctacgagtcgtcggaccaacgaccgtccctcctagacctactcgtcgtacgggtcctccgacggtctacggaaccgacggtaacggtcttagtaacgttacttaccgtgaccagtacctanaacgtagtggtaagtgttagggttctaccttcgttacgtacgggtttcggacggtacgggacccgtggtaccgtacggtaccgttacgtaacggtccgaccgtacccgtaacggtcccgtcccggtcccccgtcggtaccc

SEQ ID NO: 118035 - DNA, 590 bp, Homo sapiens
  misc_feature: GYAE6OF01B7WGG.10.27.C05.1.454.CMB.1.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctgacngtcggtcaccatctcctgcactggacccagcactgatgttggcattataaccttntctctgtatcacaacgccagacaacgccccacactcttgatttatgtaagtcagtaacgccgtccctgtaggttgttctagtcgtcttctctgcctcaacgtctcgcaacgaccggtcctccctagactaactcctcgtcgggcctccgaggtcgtacgacgacggaggtctagtaatagttactgacncgtactanagttagtaggtagtagttggttcgtccttacgtttcggtaacgggtttccggacgggacgggtaccgacggtcgtaccggtacccgttaccgtaacgtccgtaccggacccgaacgggtcccgtcccggtccccccgtacgg

SEQ ID NO: 118036 - DNA, 726 bp, Homo sapiens
  misc_feature: GYAE6OF01CWL9U.10.27.C05.1.454.CMB.1.raw
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (331)..(331): a, c, t, g, unknown or other
  misc_feature (331)..(331): n is a, c, g, or t
tcagcatagtagtgcacgaccggtgctcgatttagacgcgatcgaagggtttggggggggtcacaagaggcagcgctctcgggacgtctccaccatggcctgggctctgctgcctcctccaccctcctcactcaggacacgagggtcctcgggtccctgtcgtcgccctgactcagcctcgcctccgtgtcgtcggtctccgtgacacgtcgtcaccntctcngcacgtccggaccagcacgtgtgttacggtcggacttaacgtttacttaaccgtttcgtaccttccgtgttaactaccaaaccaaccgcccgaacaaccgaaaccccncccccgtaactactttccttagtaactttagtaacgagtacgtaacggtacggtcccgtaccggttacggttacggtttcgtacgtccgttccgttctccgtctcccgtacgtacgtcgtacgaccgtaaacccgtccgtaccctacccgtacgaaaccgttccttcgtccggtcggtacccctacccggtaggtacccggtaccggaacgggtaccggtaggtctttaacgtaacgtttacgtaacgtcgacgttaactccttaattagttagtaagtacggtggttccgttaccgttacgttttcgttacggttacggggttccggaacgggcgtacgtcggtaccgtctacgtacgtacaccgcgacctcgcccgtccgtcgttcccgtccg

SEQ ID NO: 118037 - DNA, 642 bp, Homo sapiens
  misc_feature: GYAE6OF01BFLQF.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtcctctggacagtcggtcaccatctcctgcactggacccagcactgatggttggctattataccttgtctcctgtatacaacaccgccagacaacgcccccacactcttagtatttatagtaagtcaagtaacgccgtaccctcggtacgggtttctaggtctccttcgtctcgccctcgtacgtcgtcggaccaacgtaccggcccttacctcgaactaacgttcttccgtcgggtcctaccgacggtcctacggaaccgacggacggtccgtagtaacttacgttaccgtcgactacgtctactaattagttaggagttcgtaggttccgtcctttacgtttacggttagggtttccggacggggtacggaccggtggtaccgtacgggtacccgttaccgtaagtcccgaacggacccgtacggtaccctcccgtcccccggttcggtcccc

SEQ ID NO: 118038 - DNA, 612 bp, Homo sapiens
  misc_feature: GYAE6OF01CILDY.10.27.C05.1.454.CMB.1.raw
  modified_base (226)..(226): a, c, t, g, unknown or other
  misc_feature (226)..(226): n is a, c, g, or t
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (549)..(549): a, c, t, g, unknown or other
  misc_feature (549)..(549): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgcctgactcagcctgcctcgtgtctgggtctcctggacagtcggtcaccatctcctgcactcggacccngcactgagtgttggcattatacttgtctctgtatcaacacgaccagacaacgccccanactcttagtatttangtaagtcaagtaacgccgccctcgtaggttcgtttcgtagtcgtcttcttctcgcccttacgacgttcgcggaccaaccgaccggtccctcccgtacgtactaacgtcgtaccgtggcccgtaccgaggcctaggaaccgtacggaggtactaagtaattacgttacgngacngtacttacaatacgtagaagtcgttgggtcctacgtttcgtttacggttaacgggtttcggaacgggacggtaccgnggtcctacggtacccgtacgtaagtccgaacgtaccccggagccctcccggtccccgttacgg

SEQ ID NO: 118039 - DNA, 297 bp, Homo sapiens
  misc_feature: GYAE6OF01E3SVW.10.27.C05.1.454.CMB.1.raw
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (289)..(297): a, c, t, g, unknown or other
  misc_feature (289)..(297): n is a, c, g, or t
tcagcatagtagtgcacgaccggtgctcgatttagacgcgatcgaagggtttgggggggtgtggtggtctccactcccgccttgacggggctgctatctgccttccaggctgacgacgaggctgaatattactgcagctcatatgtagatggtgcctctttcaaggttttcggcggagggaccaggctgaccgtcctaagtcagcccaaggctcgccccctcggtcactctcgttcccaccctcctccactactatcgcgtggagcgggcgnggacgacggcgcanagnnnnnnnnn

SEQ ID NO: 118040 - DNA, 600 bp, Homo sapiens
  misc_feature: GYAE6OF01CYQEG.10.27.C05.1.454.CMB.1.raw
  modified_base (205)..(205): a, c, t, g, unknown or other
  misc_feature (205)..(205): n is a, c, g, or t
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
  modified_base (453)..(453): a, c, t, g, unknown or other
  misc_feature (453)..(453): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacgaggtcctgggccctgtctgccctgactcagcctgcctcgtgtctggtctctggacagtcgtcaccntctctgcactcggacccagcactgactggtggactattactaaccttgtcttccgtggtactacaaccaacgcctaacgaacaaaccgcccccactactctttacgtatttatagaacgtctaaggtacgccggtccctacgtacggggtttctacgtcgtctttctctcgtcctaccaagtctgccaacgccgcctcctnacactctcgtcggccncgacgcagacgacgacgtctgtaactatcgngcacgctacattactaggtacgtagtggtcttccgttctttacgggttaacggtttcgggacggtaccggtaccgacggtcctacggtacccgttcgtaaccgtacgaccggtaccgacggtcccgtcccgccccgttcggtacccg

SEQ ID NO: 118041 - DNA, 747 bp, Homo sapiens
  misc_feature: GYAE6OF01D83ED.10.27.C05.1.454.CMB.1.raw
tcagcatagtagtgcacgaccggtgctcgatttagacgcgatcgaagggtttggggggggtcacaagaggcagcgctctcgggacgtctccaccatggcctggctctgctgctcctcaccctcctcactcaggacacagggtcctgggccctgtctgccctgactcagcctgcctccgtgtctcgggtctcctggacagtcggtcaccactcctcctgcacctcggacccacgcactgtagtggttgggactattattaacctttgtccgtccttggtactaccaaccgaaccgaccaagaaccaaaccgcccccacactcttagtatttatagaacgtacgagtaacgtccgcccgtcgtacgggtttctacggtccgtcttctcctcgtcctcctaacgtccgtcggtaccaaccgaccggtcccctcctacgacctaactcgtacgtcgggtccctaccgaggcgtaggaccgtaacggacgacgttagtaaacttacttacgtacgtcaaccgttcctactaacgttagtaggttacgtaaggttcgggttccttacccgttttacgtttaccgggtttaacggggttcccggggtaaccggggtaccggggttaacccgacgggttccggttaaccgggttaaccccggttcccggtttaaacggaccccggttaaccggtacccggtaaaccggttccccggttcccccggttaacccccgggttcccggttaacccccgg

SEQ ID NO: 118042 - DNA, 771 bp, Homo sapiens
  misc_feature: GYAE6OF01ESBQG.10.27.C05.1.454.CMB.1.raw
  modified_base (339)..(339): a, c, t, g, unknown or other
  misc_feature (339)..(339): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctcctgcacgtcggacccagcactgagttggttggactattaacttaaccttcgtccttccgtaggtaactaccaaacctaaccgacccaagaaccaaaccgcccccactaccttcgttagtattttangtaacgtacgaggtaacggccggtccccttcgtacggggttttactacggtcgtctttacctcttcgcccttaccaacgttcgtacggaccaaccgtaccggtacccctccgtacgaacctaacgttccgtaccggtcggtccctaccggacggtcctacggaccgtacggtacggtactaacgttaaattaccgttacgtacggactaacgtccttaacgtaagtttacgtaacgggttagtacgggttcggttaccgtttacccgtttacggttttaaccggttaacgggggtttaccgggaccgggttaaacggggtacccgtacgggttacccggtaacccggttacccggttaccgtaaacggttcccggaaacccggtacccgtaaccgggttaccccgtcccggttcccccggtcgtttaccccg

SEQ ID NO: 118043 - DNA, 692 bp, Homo sapiens
  misc_feature: GYAE6OF01EDY6T.10.27.C05.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (252)..(252): a, c, t, g, unknown or other
  misc_feature (252)..(252): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacgacgggtcctgggccctgtctcgccctgactcagcctgcctcgtgtctgggtctcgtgacngtcgtcacntctctgctacncgccagcactgagtgtggactagttactacttntctcgtgtatacaacaccgaccaagtaaccaaccgcccctactacgttcttacgtaatttacgagtaacgtcgtaacggaacgtcccggtacccttacggtacggggtttctacgttccgtacttccgtcgtaccgtccctacgtacgtcgtacgacaaccgtcgcccttaccganaaccgtntccgtacgtcggtcctcgacggtacgtacggacggtacggcgtacgtaagtaattacgttacgtacgacgtacgtcttactaattacgttaaggttacggtaacggttcggttacccttaccgttttaccgttacgggtttaaccgggtttacggggacgggtaaccggaccggtacggtaccggtaccgttaccggtacgttaaccgtacgaccggtaaccgacggtcccgttcccggtacccctcggttaccccg

SEQ ID NO: 118044 - DNA, 665 bp, Homo sapiens
  misc_feature: GYAE6OF01AUUS5.10.27.C05.1.454.CMB.1.raw
  modified_base (226)..(226): a, c, t, g, unknown or other
  misc_feature (226)..(226): n is a, c, g, or t
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
tcagcatagtagtgcacgaccggtgctcgatttagacgcgatcgaaggggtttggggggggtcacaagaggcagcgctcggggggggtcggacgtctccaccatggcctgggctctgctgctcctcaccctcctcactcaggacacgagggtcctggaccctgtctcgccctgactcagcctgcctccgtgtcgtggtctcgtggacagtcggtcacatctctgcnctcggaccagcactgtatggtggctattataacttgtctctggtactcaacacgccanacaacgccccacactctgtattangatcagtacgcgcctgtacgggttctagtcgcttctctcgccctacgaacgttcgtacggacgaaccgtccggcccttacccgtacgaacctaacttccgtacgtcgggtaccctccggacggtcgtacggaccggaacgggtaggtccgtaagtaacgttaacgttactcggtaccacgtacgttacctaagttcgtaacgtacggtagttacggttccgttcctttacgtttaccggttaagggttccgggtacggtaaccgggaccgttacggtccgtaccggtacccggttaccgttaaccgccgaaccggtcccgaacggtccccgtaaccgtccccggttacgttaccccg

SEQ ID NO: 118045 - DNA, 693 bp, Homo sapiens
  misc_feature: GYAE6OF01C24W7.10.27.C05.1.454.CMB.1.raw
  modified_base (247)..(247): a, c, t, g, unknown or other
  misc_feature (247)..(247): n is a, c, g, or t
tcagcatagtagtgcacgaccggtgctcgatttagacgcgatcgaaggggtttggggggggtcacaagaggcagcgctctcgggacgtctccaccatggcctgggctctgctgctcctccaccctcctcactcagacacagggtcctgggccctgtctgccctgactcagcctgcctccgtgtcgtgggtctcctggacagtcggtcaccatcctcctgcactcggacccagacactgagtggtggntattataaccttgtctccgtgtactacaacaaccgccaagaaccaaccgcccccactacctcttagtactttatagaaacgtcgtaaggtaacggccgtacccgttacgtacggggtttacttacgtcgtccttctacgtcgtaccctacgtaacgtctacggactaacccgaccggtccctaccctacgaacctaacgttccgtaccgtcgggtccctaccggaagtccggtacgaacggaacgtaaggacctagtaattacgttacgcgacctagtacctactaattacgtaggtagtaggttggttaccgtaccgttttacgtttacggttaaccgggggtttccggaacgggtaaccgggacgtacggtccgtaccggtacccggtaacgtaacgtacccgacggacccgaacgtcccgtacccggtccccgtcggtaaccc

SEQ ID NO: 118046 - DNA, 885 bp, Homo sapiens
  misc_feature: GYAE6OF01EPPWZ.10.27.C05.1.454.CMB.1.raw
  modified_base (537)..(537): a, c, t, g, unknown or other
  misc_feature (537)..(537): n is a, c, g, or t
tcagcatagtagtgcacgaccggtgctcgatttagacgcgatcgaagggtttggggggggtcacaagaggcagcgctctcgggacgtctccaccatggcctggctctgctgctcctctacctcctcactcgaggacacgtacgggtccgtcggtccctgtcctcgccctgactcacgcctcgcctcgtgtcgtggtctcgtggactggtccgtacaccgtactcctcgtacgaccgtacgtacggaaccctgccgtaagttgtacgttcggtaggtacttaatttaaccgttaaccttcgttaccgttcgtacggtaactacccgtaaaccaccgaacccgtaagaaaccgaaccgaccccctaacttaccgttacgttgttaactttaacgtacggtaacgtcgtaacggtacggcccgtacccttaggttaggtttccgtttaacgtcggttccgtacgttaccgttccgtacccgtaccgtttaacgtacgttaccggtacgaacccttaaaccggcccgttccgtaccgtaanaacttaccgttccggtcgttacccggtcggtaacctcgggtacccgtaacgggttaaccacggggtaacctacgtaaacttaccgttaatacccgggtcttaaaccggttacgtccttaaattaccgtttaacgtacgggtttacgtttaccggtaccgggtttacttaacccccgggttaggtttttaaacccggttaaccgggggttcggaaacccggtttaccggggtaaaccgttcgggtaaacccgtttacccgggttaacccgtttaacgggtaacctacccgggtaaccggttaaccccggttccgggttaacccgtcccgttccccgggtttaacccggg

SEQ ID NO: 118047 - DNA, 690 bp, Homo sapiens
  misc_feature: GYAE6OF01EMLS6.10.27.C05.1.454.CMB.1.raw
  modified_base (201)..(201): a, c, t, g, unknown or other
  misc_feature (201)..(201): n is a, c, g, or t
tcagcatagtagtgcacgaccggtgctcgatttagacgcgatcgaaggggtttgggggggggtcacaagaggcagcgctctcgggacgtctccaccatggcctgggctctgctgctcctcaccctcctcactcaggacacagggtcctgggccctgtctgccctgactcagcctgcctccgtgtcgtgggtctcctggacngtcgtcaccatctcctgcactcgaccagcactgatggttggactattactaccttgtcctctgtactacaaccaccgccagaaccaaccgcccccactactcttagtatttagtagtaacgtactaggtacggccgtcccgtacggtacgggtttacctagttccgttccttcctccgttcgtaccctaccgtaacgtcgtacggaccctaaccgtcccggaccccttccgtacgacctaacgttccgttcggtccggtacccgtacggtacggtcgtacggaacggaccgtacgggactaagtaactttacgttactcggactacgtacctactaagttagttacggtaagtacggttcggttaccgttaccgtttcgtttaccgggttaagggtttccgggaccgggtacgggaccgtaggtccgtacggtaccgtacgtacgacccgaccggacctacggtccctcccggtccccgtcggtacccc

SEQ ID NO: 118048 - DNA, 704 bp, Homo sapiens
  misc_feature: GYAE6OF01A183C.10.27.C05.1.454.CMB.1.raw
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtcctgccctgactcagcctgcctcgtgtctgggtctctggcagtcggtcacatctctncactgaccagcactgngtggttggactattaactaccttgtctcgtggtactacaaccaacgccaacgaccaaaccgaccccacacttcttagtatttatagtagtacaaggtacgccggtccctacggtacggggtttctaggtcgtccttctcgtcgtccttaccgaacgttcgtacggacctaaccggaccggtccccgtaccctacgtaacctaaccttccgtaccgtaccgggtcctaccgacgggtccgtaacggtaaccggacgggtacggtacctaagtaacttacgttaccgtcgtaccgtctacgtactaagtagtacggtagtaggttcgttcgttccgttacgtttacggtttacgggttccgggaccgggtaacggtaccggtacggtaccgtacccggttaacccggtaccgttaacgtaccgacccggtaaccggtaccgttacccgacccccggttccccggttccggttacccg

SEQ ID NO: 118049 - DNA, 749 bp, Homo sapiens
  misc_feature: GYAE6OF01CTLHU.10.27.C05.1.454.CMB.1.raw
tcagcatagtagtgcacgaccggtgctcgatttagacgcgatcgaaggggtttggggggggtcacaagaggcagcgctctcgggacgtctccaccatggcctgggctctgctgctcctcaccctcctcactcaggacacgacgggtccgtcggccctgtctcgccctgacctcacgcctcgcctcgtcgtcgtcggtctcgcgacgtacggtcgacacctactcctcgtgccacgtcggaaccagactacgtgtagtggtcggactattaacgtacgttcgtctcgtagtaactacaaccaccaccgaacaaccaacccgcccaactaccttagtacgttattacagaacgtacgaagtaccggccgtaccgtagggttacggttctaccgtcgttacgtttccacgttacccgtccgtaaacgttacgtcgaaccgtaacgaaccccgtccgtaccccgtacaacgtactaccggttccgtccgggtacggtaccctacggacgaccgtacggtaaaccggacggtaacgtacgtaaatttaacgttaaccgtaccgtcgaaccgtacgtacttaatacggttaagtacggtaagtccggttcggccttttacccggtttaacgttacggggtttaccgggttacggggcccgggtaaaggtccgtacggtcccgtaaccggtaaccggttaccgtacggtacccgtaacccggacgtaccgcccggtccccgtccggtccggtaccc

SEQ ID NO: 118050 - DNA, 766 bp, Homo sapiens
  misc_feature: GYAE6OF01D3JW9.10.27.C05.1.454.CMB.1.raw
  modified_base (200)..(200): a, c, t, g, unknown or other
  misc_feature (200)..(200): n is a, c, g, or t
tcagcatagtagtgcacgaccggtgctcgatttagacgcgatcgaagggtttgggggggggtcacaagaggcagcgctctcgggacgtctccaccatggcctggctctgctgctcctcaccctcctcactcaggacacgagggtcctcgggccctgtctcgccctgactcagcctgcctccgtgtctggtctccgtgacngtcgtcaccatctctgcacgtcggacccagcacgtgagttggttcggactaatttacttaaccgttcgtccttccgtaggtaactaccgaaacgtaaccgacccgaagaacccgaaaccgcccccctaataccttcgttaagttaattttaagacggtaaacgtacgaacggttaaccgccggtaccccgttacggtaggggttttcctacggttccgtccgtttctccgtccgtcccttacgaacgtcgtacgaccaacccgtcccggtccctaccgtagtaactacgttccgttcgtcgggtacctccggagtacgtacggaaccgtacggagtacctaagtaaactttacgttaccgtgacacgtctactaacgtagtaggtaggttacgtttgggttaccctttacgtttaaccggttttggggtttaaccggggttaccgggacggggtaacggtcccgggtaacggtaccggtacccggttaaccgtcggttaaccgacccggtaccggtaaccccggtaacgggacccgttacccccggtcccgggtttccgtaccccg

SEQ ID NO: 118051 - DNA, 830 bp, Homo sapiens
  misc_feature: GYAE6OF01EROD2.10.27.C05.1.454.CMB.1.raw
  modified_base (198)..(198): a, c, t, g, unknown or other
  misc_feature (198)..(198): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggcccagtctgccctgactcagcctgactccgtgtctgggtctcctggacngtcgatcactatctccgtgcctacgtcggaaccagcagtgtacggtttggtagtttaataacgtatcgtcttccgtaggtaacccaaaccaaccgaccaacggaaccaaacccgacccccaaaacttcaagttagttacttttgacgttcgtacgtaacgttacgtccggtacctttcggttaaggggtttaccttaacgtccgttactttccgtaccgttcggtccttaaccgtaagtaccgtcggtaaccaacccggacccggtcccctacccctaacggtaaccctacgttccgttccggtccggtaccctaccggacggtacgttaacgggacgggtaaccggtacggtctttaacgttaacgttttacgttaaccgtccgttacgaaccggtttaaccttccttaaacttaaacgtaaccccgtaaaccgtaccgacgtaaccgttaccgttaaccgtttacggttaccgggtttaccgggtaccgggggttaacccgggggaaaccgtaaaccccgtaaacgggtcgttaaccccgggtaccggttaccggttaccgggtaccggtaacccggaccccgggttaaacgccccggttacccccgggttccccgtccggtttaacccg

SEQ ID NO: 118052 - DNA, 682 bp, Homo sapiens
  misc_feature: GYAE6OF01D9SO0.10.27.C05.1.454.CMB.1.raw
  modified_base (303)..(303): a, c, t, g, unknown or other
  misc_feature (303)..(303): n is a, c, g, or t
tcagcatagtagtgcacgaccggtgctcgatttagacgcgatcgaagggtttggggggggtcacaagaggcagcgctctcggaacgtctccaccatggcctgggctctgctgctcctcaccctcctcactcaggacacagggtcctgggccctgtctgccctgactcagcctgcctccgtgtctgggtctcctggacagtcggtcaccatctcctgcacgtcggacccagcactgagtgttggcattataaccttgtctctgtatcaacacgccaagacaacgccccacactcttgtatttangaagtcagtaacgccgcctagtagggtttctagtcgtcttctctcgccctcaagtcgtacgacaacgaccgggtcctacccgtacgaactaacgttcctacggttcgggtccctaccgacggtaccgtacggaccggtacggaaggacttagtaaacttacttaccgtcgacgtacgtctacgtaacttagtacgttagtaacgttcggttaccgttaccgtttccgtttacgggttaaccggggtttttccgggaaccggggtaaaccgggtacccgggtacggtaccgttacccggtaacccggttacccgtaacggtcccgtaaaccggtaccccgaacgggttcccgtaccccgtcccccggttcgttaaccccg

SEQ ID NO: 118053 - DNA, 685 bp, Homo sapiens
  misc_feature: GYAE6OF01BRTVN.10.27.C05.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (433)..(433): a, c, t, g, unknown or other
  misc_feature (433)..(433): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtggacagtcggtcaccntctcctgcacgtggacccagcagtgtactttgtnacttatactatgtctcctggtaccagccaccaccaggaccaacgaccccctaaacttctttggtttttcgaggtcagtaacgccggcctacgacggtacgtccctggtacgttcgggttcctctcgtcctacctagtccgtaggaccaccgaccggtcctcccgngtacccgtntcgtcgggctaccgnggtctaggacgtatcggacggcttagtaacttactaacgtcgaccgtaagcgcttaactacgttcgaaccggtaccccaaggtcggggtttacgttcggggaccgggtacgggtaccgttaaggtaccggtacccgttcggaccggttcgaaccggtaccccggtaacggtccccgttacccgggtcccccccgttaccggttaccctacccggtttccttaccccggtttaccccgcccccgtttaccccg

SEQ ID NO: 118054 - DNA, 683 bp, Homo sapiens
  misc_feature: GYAE6OF01DNHY1.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgccactcggacccagcactgatggtggctattataacttgtctcctgtatacaacaccgaccagacaaacgcccccacactcttgtactttagtgaagtcgagtaacgccgtcctacgtacgggttctacgtcgtcttctctcgtccctctaacgtcgtcggaccaaccgaccggtccctcccgtacgtacctaacttccgtacgtcgggtcccgtaccgacggtaccgtacggaaccggaacggtacggtaccgttagtaaattaacgtttaccgtcggtacctacggtactacctattaacgttaggtaacggttagttcggttccgttacccgtttaccgtttacggttaaccgggttttacgggaccggggtaccgggacggtacggtacgtacggtaccccggttacgtaaccgtccgaccgtacccgtaacggtcccgtacccggtccccgtccggtaacccg

SEQ ID NO: 118055 - DNA, 634 bp, Homo sapiens
  misc_feature: GYAE6OF01CWL0Y.10.27.C05.1.454.CMB.1.raw
tcagcatagtagtgcacgaccggtgctcgatttagacgcgatcgaaggggtttggggggggtcacaagaggcagcgctctcgggacgtctccaccatggcctgggctctgctgctcctcaccctctcactcaggacacgagggtcctgggccctgtctcgccctgactcagcctgccctcgtgtcgtggtctccgtggactagtcggtcacctatcctctgccacgtcggaccagcacgtgagtgtaggctaattataacctttgtccttccgtaggtaactaccaaaccgaaccgacccaacgaaccaaacccgccccctaatactttcgttatactttagagaacgtcaaggtacgccgtccctgtaggttcttactacgtcctcttcctactcgaccctacgtaagtcgtacgaaccacccgccggtccctacctacgactactcgtccggtcggtcctccgacggctacggacggaacgtacgactacgtaattactacgacactatactataatagtagtagtggttcgtcttccttcgttacggtacggttacgggcggtacgacgtcggtacgtcggtcccgtacgtaacgtcgaaccggtaccgaggtccctccgtccccgtaccg

SEQ ID NO: 118056 - DNA, 966 bp, Homo sapiens
  misc_feature: GYAE6OF01E0JDD.10.27.C05.1.454.CMB.1.raw
  modified_base (273)..(273): a, c, t, g, unknown or other
  misc_feature (273)..(273): n is a, c, g, or t
tcagcatagtagtgcacgaccggtgctcgatttagacgcgatcgaaggggtttgggggggggtcacaagaggcagcgctctcgggacgtctccaccatggcctgggctctgctgcctcctccacccctcctcactcaggacacagggtcctcgggccctgtctcgccctgactcacgcctcgcctccgtgtcgtgggtctccgtggactagtcggtacacctatcctcctgcctaccgtcggacccagacctacgtaggtagtggttacgggnttaacgtttaacttaaccttcgtccttaccgttagtactaacaaaccaaccgaaccctaacgaaacccgaaacccgtcccccctaactacctttacgttagttaactttaagtacggtaaagtaccggtaaacgggtaaaccggtcccggtaccccgtttaacggggttacggggtttttaccgtaacggttcccgttacctttacccgttccgttacccggtaccccgttaaccgtaaacgggtttccgtaaccgggtaaaccctaaacccgggttccccgtacccctttacccggtaaacgaaaccctttaacgttcccgtttaacccgggcccgggttaccccttaaccgggaccggttaccgtaaaccgggtaaccgggtaaccgggtccgggttacttaaaacgttaaaccgttttaggttaaccgtcggtaacctaccgggttaccttaaacttaaggttaacggttttaacggtacggtttaagttaccgggtttacccttaccggttttaacggtttttaaccgggggttaacggggtttaccgggggaaccggttaaccggggaaccgttacggggtacccgtaacccgtaaacccgggtttactaaaccgggttacccgaaacccgggtaaccccgtacgggttaccccgtaccccccggttaccccgggtcgtttaaccccg

SEQ ID NO: 118057 - DNA, 734 bp, Homo sapiens
  misc_feature: GYAE6OF01EYZAH.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctcgcctcgtgtctgggtctcctggactaggtcggtcaccatctcctgccacgtacggacccagccactgatggttgggactattacttaccttgtctcgtgtactacgaacaccgaccaacgaaccaaccgcccccactactcttagttatttagtagtaacgtcgtaaggtacgccggtcccgttacggttcgggtttctacgtccgtcttcgtctccgtccctacgacgtcgcgacaccgaccgcctccacgactactctcgtcggtcctcgagtcgacgacgtacggacgtacgtaagtaactttaacgttacgtcgtaccgtacgttacctaacgttaagtacgttaggtaacggtcggttagggtttacccgtttaccgttttaccggttttaaccggggttaccggggtttaccgggggaccggggttaacgggtaacccggttaccggtcccggttaacggttaacccggttaccggtaaaccggtcccgtaacccgggaacccggtaacccggttcccggtttacccccggtccccgttccccgggttaacccc

SEQ ID NO: 118058 - DNA, 869 bp, Homo sapiens
  misc_feature: GYAE6OF01DI3E3.10.27.C05.1.454.CMB.1.raw
  modified_base (239)..(239): a, c, t, g, unknown or other
  misc_feature (239)..(239): n is a, c, g, or t
tcagcatagtagtgcacgaccggtgctcgatttagacgcgatcgaaggggtttggggggggtcaacaagaggcagcgctctcgggacgtctccaccatggcctgggctctgctgctcctcaccctcctcactcaggacacagggtcctcgggccctgtctgccctgactcagcctgcctccgtgtcgtgggtctccgtggacaggtccggtccaccatcctcctgacctctcggacccngccactgattggttcggatattactaccgttgtaccttcgtagtactaccgaaacgaccgacccgacgaaccaaacccgtcccccaacgttaacctttcgtttaagttacgttaacgtagaaaacgttcgtaaagggtaacccggtccggtccccgtttagggttacggggttttaccttaccgggtaccggtttccttttccggtaacccggttaccgtccccgttaaaccccgtaacggttttcccgtacgggaaccctaaaccccggtcccggggttaccccctttaccctaacggaaacccttaacggtttcccgtccggttaacccggggccttaaccccgggaggtcccgttaccgggaaacggttcccgggaattaccgtttaaagggtaacgtttacgtttacgaccggacgtaacctccttaagtaagtttagttacccgtaaggtacgtttcggttaccgtccctttttacggtagggtttacccggggttacgggaccgggtaaaccgggtatccggggtaaaccttcccgggggttaaacctaccgtttaacgggaaccctccggaaaccgggtttacccggtcctttaacccccgggccccgtttaacggttccccg

SEQ ID NO: 118059 - DNA, 600 bp, Homo sapiens
  misc_feature: GYAE6OF01EZL7Q.10.27.C05.1.454.CMB.1.raw
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (584)..(584): a, c, t, g, unknown or other
  misc_feature (584)..(584): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctctggacagtcgtcaccatcctctgcacgtcggacccagcactgatggttggctattactacttntctctgtatcaacacnccaagacaaacgcccccacactcttagtactttagtacgtaagtacaaggtaacggccgtcccgttagtacggggtttctaggttcgtcttctctcgccctacaagtctcggacaacgaccggtcctccgtagaactacttcgtcgtcggtcctccgaggtcgtacggaacggacgacggtactacgaatttacttacgtcgactaacgtcctacattcgtggtactaggttcgttcgctttcggttacgttagggttcggcggtaacggcgaggtcgtacggtacctacgttacgacacgtacccgacgtccncccgtcccgtggtacc

SEQ ID NO: 118060 - DNA, 619 bp, Homo sapiens
  misc_feature: GYAE6OF01A53BK.10.27.C05.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacgagggtcctgggccctgtctcgccctgactcagcctgcctccgtgtctggtctcgnggacngtcgcacntctcngcacgtcggaccagcacgtgtatggtggctattactacttgtctcgtgtactacaacacgccagaccaacgccccatctctntattangagtanacgtacgccgtctggtacggttcagtcctcttctcgtcgtcctacgtagtcacggacaaccgtcccgtccctaccgtacgactactccgtcggtcggtccctacgacggcgtacggaaccgacggtacgacttacgtaaattacgttacncgtacgngtacctataagtgttaggtacgtacggttcgttcgttacctttacgggtttacggttacgggtttccgggaagggtccgacggtacgtcgtaccggtaaccggttactacggacctacggtacccgtacgtcccgtcccgtcccgtacgtacccg

SEQ ID NO: 118061 - DNA, 734 bp, Homo sapiens
  misc_feature: GYAE6OF01C4PX0.10.27.C05.1.454.CMB.1.raw
  modified_base (705)..(705): a, c, t, g, unknown or other
  misc_feature (705)..(705): n is a, c, g, or t
  modified_base (710)..(710): a, c, t, g, unknown or other
  misc_feature (710)..(710): n is a, c, g, or t
  modified_base (730)..(730): a, c, t, g, unknown or other
  misc_feature (730)..(730): n is a, c, g, or t
  modified_base (732)..(732): a, c, t, g, unknown or other
  misc_feature (732)..(732): n is a, c, g, or t
tcagcatagtagtgcacgaccggtgctcgatttagacgcgatcgaagggtcctgggccctgtctgccctgactcagcctgcctccgtgtctgggtctcctggacagtcgatcaccatctcctgcactggaaccagcagtgacgttggtgttataactatgtctctagtaccaacaacaccagacaaacgccccaaatcatgtattttcgatcgtactagtaactccggccctgtaagggtttactaatccgtcttacgtcgttcggacttaccgtaagtcgtacgggacctaaaccgtacccggtcccttacccgtacgaccctatccgttccgtcgggtcccttaccgacggtacgttacggaacggtaaccgtcgggtcttagtaaacttttacgtaacgtcgacgtacgcttaacgactaaccgtaaaccacgacggtacactaccgttaactttccggtagttacgggtccggaacggtaaaccgggacctacggtcgttaccgacccggtttacgtacggtccgaaccgtacccgaacggtcccgtaccccggttccccgtacggtaccctacccggttcccttcccgttaccccctacccgttaccctaactaccgttacgttaacgtcccggttcgaccggtaccggtcccgggtactacgggaaacccggagacccgttaacgaacggtgctacggnacganacgtacggaactgtaaaccngncg

SEQ ID NO: 118062 - DNA, 786 bp, Homo sapiens
  misc_feature: GYAE6OF01CRVP8.10.27.C05.1.454.CMB.1.raw
tcagcatagtagtgcacgaccggtgctcgatttagacgcgatcgaaggggtttggggggggtcacaagaggcagcgctctcgggacgtctccaccatggcctgggctctgctgctccctccaccctcctcactcaggacacgacgggtcctcggggccctgtcctcgcccgtagactcacgcctcgtccgtccgtgtccgtgggtcctccgtaggactaggtccggtccacctcttccgtcctcgccacgtcggaccctagcactgtagttggtggactattactaccttctcctcgtgtacgtaccaacaccgaccaacgaaccgaacccacccccactaccttcttagttattagtaacggtacgtacgtacggtaaccgtccggtacccgtaggttacgggttactcggtcgtcctttacgtccgtaccgtccctaccgtacgtccgtaggacccgtaaccgcccggtaccctaccgttaacgacctacgttccgtccgtgggtccctaccgggtacgttccggacggtaaccggaacgggtacgaccgttaagtaacgtttaacgtcgtacgtacccgtacgtaccttagtacgttacggttaggttaccggtaacgggttcgtttccgttacccggttttaacggtcgggttttaaccggggtttccggggaaccgggttagggacccgttacgggtaccggtacccggttaccgtaccgttaacggtacccacccggtaacggtaaccgtcccgtcccccgtcccggtccgttacccccg

SEQ ID NO: 118063 - DNA, 620 bp, Homo sapiens
  misc_feature: GYAE6OF01EAB0O.10.27.C05.1.454.CMB.1.raw
  modified_base (125)..(125): a, c, t, g, unknown or other
  misc_feature (125)..(125): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (367)..(367): a, c, t, g, unknown or other
  misc_feature (367)..(367): n is a, c, g, or t
tcagcatagtagtgcacgaccggtgctcgatttagacgcgatcgaagggtttgggggggtcacaagaggcagcgctctcgggacgtctccaccatggcctggctctgctgctcctcaccctcctnactcaggacacagggtcctgggccctgtctgccctgactcagcctgccctccgtgtctgggtctccgtggacagtcggtcaccatcctcctgcactggacccagcactgatggtggctattataaccttgtctcgtgtatacaacacnccagacaacnccccacnctctntattagtgagcagtaagccgtcctgtaggtttctagtctcttctctcgaccctacacgtcgtacgtacaacnccggccctaccaggacctaatcgtcgtcggcctaccgacggtcgtacgacgaacggtcgtaccgtagtaagttacgtactggtctacgtctacgtaacgttatgaagttacgtggttaccgtccgttttcgttacggttaacgggtttcggaacggggtaccggtacggtacggtacgttacccgggaccgttaccgtaacgtcgaaccggtacggtaacggtaccccttccggacccccggttggtaacccc

SEQ ID NO: 118064 - DNA, 676 bp, Homo sapiens
  misc_feature: GYAE6OF01D9VCC.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgtcaccatctctgcactcggaccagcactgagtgtggctattactaaccttgtctccgtggtatacaaaccacgacccacaacaaccgcccccactactcttgttatttatcgaagtctagtaacggccggtccctacgtagggtttctagtcgtccttctctcgcccttaccaacgtctcggtaccaacgcccgtacccctcccgtagacctaacgttccttcggtccggtacccttccggacggttcgtacggtaacggacccggaaggtccgtaagtaacgtttacttacggtacgacgtacgtacctcgtaatcgtaaggttcgtagggttcgttccgtcctttacgtttacggttacggtttccgggacggggtaccggacggtaacgtccggttacgtaaccggttaccgtaacggtacctaccggaccccgtaaggtccctccggttccccccgtcgttaaccccgg

SEQ ID NO: 118065 - DNA, 792 bp, Homo sapiens
  misc_feature: GYAE6OF01B5KIO.10.27.C05.1.454.CMB.1.raw
  modified_base (139)..(139): a, c, t, g, unknown or other
  misc_feature (139)..(139): n is a, c, g, or t
  modified_base (727)..(727): a, c, t, g, unknown or other
  misc_feature (727)..(727): n is a, c, g, or t
tcagcatagtagtgcacgaccggtgctcgatttagacgcgatcgaagggtttggggggggtcacaagaggcagcgctctcgggacgtctccaccatggcctggctctgctgctcctcaccctcctcactcaggacacgnggtcctcggccctgtctcgccctagactcgacgtcctcgccttccgtgtccgttcgggtcctccgtaggacgtacggtccggtaccacctacttcctccgtgacctaccgtacggacccagtcctaacgtggtacgttggttacggacttaacgtttaacttaaccgttgtccgttaccgttaggtaactaaccgaaaccaccgtacccaaagtaacccaaacccgtcccccaataccgtttcgttacgttaatttacgaacgtaacgtacgaacggttaaccggccgtacccgtttacggtacggggtttactaccgttccgttcttacctccgtacgtaccctcgtacgttccgacggaacctaacggcccgtccctaccgtccggtacccttcgtaccggtcggtcctaccggtacgcgtagggacggtacgtacggtacgcgttaacggttaacttaccgtacgtacgcgaaccggtcaacgttacttaccgaacccggtaccggtaccccgtaaagggttcggttacgggtcggacgggtaacccggtagttaaccgggtccgttaccggtcgttacggaacnccccggtacgaaccggtcccgtaccccgtactcccggttaccacgttcccgtacccgttcccccg

SEQ ID NO: 118066 - DNA, 824 bp, Homo sapiens
  misc_feature: GYAE6OF01A1ZSP.10.27.C05.1.454.CMB.1.raw
  modified_base (137)..(137): a, c, t, g, unknown or other
  misc_feature (137)..(137): n is a, c, g, or t
tcagcatagtagtgcacgaccggtgctcgatttagacgcgatcgaaggggtttggggggggtcacaagaggcagcgctctcgggacgtctccaccatggcctgggctctgctcgtcctcctaccctccctcctcacncgacgaccacgtcgggtccgtcggtccgtgtctccgtccgagtactcgctccgtccgtccgttcgttcgtcggtcggtccttcggacgtacgtcggtccgtaccactctccgtccgtacgcgtaccgccggaaccacgtctacgtgtacggttcggtacggtacttaactttaccgttaccgtttccgtccgttacggttaacttacaacccaaaccgtaacccggaccaaacggaaaccccgtaccccacctaccttcttacttagtttacttaggtacggtactaaggaaccggtcggtcccgtaccggttacgggttcggttacgttaccgtcgttccgttctcttacccgtacctacgtaagtccgtacgaaccgaccgtcccccggactacccgtacgtaacctacggttccgtccggtccgccggtaccgtacggtcgaacggtaccggtacggtcgtaacgttacgtaagtttaccgtaacgtcgtacgtaccttactacttaagtagttacggagttcgggtaacgttccctttacgtttacggttaaccgggtttcggggtacccggggtaaggacccggtacgggtaccgttcggttaacccggtcggttaaccgtaccggcgtaacccgcccggtaacccgttcccgtccccggttcccgttaaccgttcccccgg

SEQ ID NO: 118067 - DNA, 636 bp, Homo sapiens
  misc_feature: GYAE6OF01EGJFG.10.27.C05.1.454.CMB.1.raw
  modified_base (201)..(201): a, c, t, g, unknown or other
  misc_feature (201)..(201): n is a, c, g, or t
  modified_base (443)..(443): a, c, t, g, unknown or other
  misc_feature (443)..(443): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctcgccctgactcagcctcgcctccgtgtcgtgggtctcctggacngtcggtcaccatctcctgcacgtcgacccagcactgatggtggctattactacttgtctcgtgtactacaacaccgccaagaaccaaccgcccccatacttcgttagtatttagtagaagttacaacggtaacgtccggtcccgttaggttacgggtttctcgtcgtccttcgtctcgtcctaccgtagtcgtacgaccaacgtccgtcctccagtacctactccgtcgtcggtcccaccgngtacgtacggaccgaggacgtctagtaactacgttcgcgtactcgtactactaagtacgttagtacgtgttcggtcgtttaccgtttacgtttaccggttagggttccggaccgggtaagtccggtaacgtccgtacggtacccgtagtaacggcctaccgaccgtacgcccctccgtccccgtcggtacccg

SEQ ID NO: 118068 - DNA, 613 bp, Homo sapiens
  misc_feature: GYAE6OF01EQNWH.10.27.C05.1.454.CMB.1.raw
  modified_base (216)..(216): a, c, t, g, unknown or other
  misc_feature (216)..(216): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
  modified_base (423)..(423): a, c, t, g, unknown or other
  misc_feature (423)..(423): n is a, c, g, or t
tcagcatagtagtgcacgaccggtgctcgatttagacgcgatcgaagggtttgggggggggtcacaagaggcagcgctctcgggacgtctccaccatggcctgggctctgctgctccctcaccctcctcactcaggacacagggtcctgggccctgtctgccctgactcagcctgcctcgtgtctgggtctctggacagtcggtcaccatcctccngcacgtcggaccccagcactgattggttggctaatttacttaaccttgtcctcgttggtaataccaaacaaccgcccaagaaccaaaccgaccccccacaccttcttagtatttatgaagtcaagtaagccgtcctgtagggttttcagtcgcttctctcncctcagtncggcacgccgcctccagactattcgcgtcggtcaccgngcgtgaacgagagtctagtaattagtactgacagtctcaattaagtgtaagaggttgttccttacgttacgttttcggtaacgggtttcgggacgggtacgggacgaggttaccgtaggtaacccgttcgtaacgtccggaaccggtacccgtaacgtccccggtccccgtcccccgtacggttaccccg

SEQ ID NO: 118069 - DNA, 838 bp, Homo sapiens
  misc_feature: GYAE6OF01EVWRB.10.27.C05.1.454.CMB.1.raw
tcagcatagtagtgcacgaccggtgctcgatttagacgcgatcgaagggtttggggggggtcacaagaggcagcgctctcgggacgtctccaccatcggcctgggctctgctgctcctcacctctcactcaggacacgagggtcctgggcctgtctcgccctgactcagcctgcctcgtgtctgggtctcgtggactacgtccggtacacctacttctcgtcgcacgtcggacccagacctaacgtgagttcggtaggtactagtttaacttaaccgttcgttccgttcgttacggtaactaccgaaaaccgaaccgtacccgaaacgtaaaccgaacccgcccccaactaccgttactttcgtaactttagacggtaacgtacgtacggtaaccggtccggtaccctaaccgggttaggttttacgtaaccggtccttacgtttcctaccggttccgtacccgttaacccgaacgtttaccggtaaccgtaacccgtaaaccggacccggttaccccttaaccccgtacggttaaacccgtaacgtttcccttaccgggttccgggttaaccccgtaccggtaacggtacggtaaccggacggtaaccggtcggttaacggttaacttaaacgtttacgttacgtacggtactacggtactactacgtagtaacggtacggtgttaacggttctttaccttaccgggttttacggtaacgggttttcgggaaccggggtacggaccggcggttacgtacccggttacggttaaccgtaccggtacgacccgtaaccggtaccgttacccgtcccggtaccccggttccgttaccccg

SEQ ID NO: 118070 - DNA, 739 bp, Homo sapiens
  misc_feature: GYAE6OF01DQJPH.10.27.C05.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (445)..(445): a, c, t, g, unknown or other
  misc_feature (445)..(445): n is a, c, g, or t
tcagcatagtagtgcacgaccggtgctcgatttagacgcgatcgaaggggtttggggggggtcacaagaggcagcgctctcgggacgtctccaccatggcctgggctctgctgctcctcaccctctcactcaggacacgagggtcctgggccctgtctgccctgactcacgcctgcctcgtgtcgtggtctcgtggacngtcgcacnctctctgcacgtcgacccagcacgtgtagttggtacggcttacttaagttaccttcgtacctccgtagtaactaccaaccgaaccgacccgaacaacccgaacccgtccccctaatacctttcgttagttaatttagacggtaacgtacgaacggtacggcccgtcccgtgggttacggttcctacggtcgtccttcgctactccctacgagtcgcgacaaccgtcccgccctacganaacctcgttcgtccggttcggaccctaccgggacggttccgaacgggtaaccgggtaccggtaggttaacgtttaacggttaaactttacgggttaccgtaggaaccgttcgttacgtaactttaagtcgggtttaacgtaggttaccgggttcggtttacccgtttcggttttacgttacggggtttaacgggttccgggaccgggtaacgtaccgtcggtaaccggttcccgaacggttaccaccggtacgaacccgtaccggtacgtcccgttccccgcccgtgttacccc

SEQ ID NO: 118071 - DNA, 700 bp, Homo sapiens
  misc_feature: GYAE6OF01A4D8N.10.27.C05.1.454.CMB.1.raw
  modified_base (321)..(321): a, c, t, g, unknown or other
  misc_feature (321)..(321): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcggtcaccatcctctgcacctggacccagcactgattggttaggtattataaccttgtcctccgtggtactcaacctaccgcccaagaaccaaacgccccccaactactctttagtatttanagaagtcaagtaacgccgcctcgtagggtttcagtctcttctctcgcctaccagtctggaccacgacgccctcctgactatcgtacgtcggtcctccggagcctacggaacggaccggtaggtcctaagtaacttatttacgcgaccgtacgtactactagttaacgtggtaacgtagttcgggttacccttcccgtttacgtttaacccggttagggggttttccggacggggtaaccgggtaacccgtgggtaacccgttaccgggtacccccgtttaaccggttaaacccggttacccggtaaccccggtaccccggtaaacgggttcccccttaccccgggtacccccccgtttacggtaaccccgttaccccgg

SEQ ID NO: 118072 - DNA, 970 bp, Homo sapiens
  misc_feature: GYAE6OF01E2XCO.10.27.C05.1.454.CMB.1.raw
  modified_base (199)..(199): a, c, t, g, unknown or other
  misc_feature (199)..(199): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacgacgggtcctgggccctgtctgccctgactcagcctcgcctcgtgtcgtggtctcgtgacngtcgtcaccatctcctgcacgtcggacccagcctacgtgtagtggttagggctagtttaaccttaccttcgtcctacgtagtactaccaaaccaccgtacccaagaaccaaccgaccccctactaccgttcttagtattacgtagtaacgtacgaaggtaacgccgtaccctagggttacggtttccgtacgtccgtccgttacctcgtcgtcccttaaccgtaacgtcgtacggaccgaaccgtacccgtcccgttacccgtaggtaaacctaacgttcccgttaccggtcgggtaacccctaccggtaacgggttacccgtaacgggtaaaccgggtaaccggtacgggttaacctttaaacggtaaaaccggttttaacgtttaaacccggtacggaacccggttacgttttaaccctaaccgtttaaacggtttaacgggtttaaccgggttaaagggtttacccgggtttcgggtttttaaccccgtaaccgtttttttaacccggggttttaaccggggtttttaacccggggggttttaaaccggggggacccggggggtttaaaaccccggggttaccccggtaaaacccgggggtttaccccgggttaaacccgggtttaaaccccccggggtttaccggtttaaaaacccgggtaacccccgggttaccccgggtaaaaccccccgggttacccgggggttttacccccccggtaacccccggggtttccccccccggttaaacccggggttacccccggg

SEQ ID NO: 118073 - DNA, 597 bp, Homo sapiens
  misc_feature: GYAE6OF01BWM56.10.27.C05.1.454.CMB.1.raw
  modified_base (308)..(308): a, c, t, g, unknown or other
  misc_feature (308)..(308): n is a, c, g, or t
  modified_base (575)..(575): a, c, t, g, unknown or other
  misc_feature (575)..(575): n is a, c, g, or t
tcagcatagtagtgcacgaccggtgctcgatttagacgcgatcgaagggtttggggggggtcacaagaggcagcgctctcgggacgtctccaccatggcctggctctgctgctcctcaccctcctcactcaggacacagggtcctgggccctgtctgccctgactcagcctgcctccgtgtctgggtctctggacagtcggtcaccatctcctgcactcggacccagcactgattggttggctattactaaccttgtctcctggtatcaacaacgcccagacaaacgcccccacactcttgtatttanagaagtcaggtaacgcggccctcgtacggggtttctagtcgtcttctcgtgcctccaagtctcggacaacgaccggccctcctgaacctaactctacgtcggtcctaccgaggctacgacggacgaggctagtaacttagttactgctacgtctacgtaatgtagtaggattcggtcgtccctttacgttacggttacgggttcgggacgggtccggacggtcgtacgttcggaccgttactacgacgtaccgaccggtacgacccnccccggtacccgttcgtacccg

SEQ ID NO: 118074 - DNA, 934 bp, Homo sapiens
  misc_feature: GYAE6OF01EMB3T.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacgagggtcctgggccctgtctcgccctgactcagcctgcctcgtgtcgtgggtctccgtggactaggtccggtccaccactccttccgtcgccgaccgtccgggacccgagacctacgtagtagttgggttacggactaatttacgtaccgtttcgtccttaccgttaggtaactaaccgaaaccgaacccgtacccgaaacggtaacccaaaccccggaccccccctaaacgttaccgtttacgtttaagtttaacgttttaacgtaaggttaaccggtaacgtaaacgggttaaccgggtccccggttaccccggtttaacgggttaccggggttttttaaccgtacgggtttcccgttccgttttacccgttaccgttacccggttaccccgttaaccgttaacggtttcccggttaacggaaccccgttaaaccggtcccccggtacccctttaaccccgtacggttaaaacccttaacggtttcccgttacggggttccggttaacccccgtacggtaacccgggttcggtaaacccgggaaaccgggtaaccgggtaggttaaccgtttaaacgttaacttaaccggtttacgccgtacgtaaccgttaccgtattaagttacgtgggtaacgttagggttccgtacgttacccttttaggtttaacgggtcccgggggttacggacgggtacccgaggttaccggtacgttacccgggtaaccttcgggaaccgtccggtaaaccccggtcgtacccggacccttcccccgggtacccgtgttacccccg

SEQ ID NO: 118075 - DNA, 848 bp, Homo sapiens
  misc_feature: GYAE6OF01E4F4P.10.27.C05.1.454.CMB.1.raw
tcagcatagtagtgcacgaccggtgctcgatttagacgcgatcgaaggggtttggggggggtcacaagaggcagcgctctcgggacgtctccaccatggcctgggctctgctgcctcctccaccctcctcactcaggacacgacgggtccgtcgggccctgtctcgccctgactcacgcctcgcctccgtcgtcgtcggtctcgtggactacgtcgtacacctactcctctcgctaccgtcggacccagcacgtgtagttggttacggtacttaacttttaaccttaaccgttcgttcctaccgttacggttaacaacccgaaaccgaacccgaacccgaacgaacccaaaccccacccctactacttcgttatagtttaacgagtacgtacgtaacgtaccggtccgtccgttacggttacggttacgtcgttccgttcgttaccttccgtccgtacccgtaacggtacgtacgggttaccgaacccggaacccgtcccggtaccccttaccgtaacggtaaccttaccgttccggttaccgggtcccggtaacccgttacggacggtaccgtaccgggaaccggtacggttaacgtaacgttaacgttaaacttcggttaaccgtcgaacctaccgttattaaccttaaggtaggttaacggttaaccggttcgggttacccgtttacgtttccgggttttaaccggtttacgggggttaaccgggttaccgggaccggggttaccgaaccgggttcccgtaccgttaccaacccgggtttacacccggttcccgaacccggtccggtacccggtcccctcccccggttacgttcccgttaccccg

SEQ ID NO: 118076 - DNA, 667 bp, Homo sapiens
  misc_feature: GYAE6OF01AFHTH.10.27.C05.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (409)..(409): a, c, t, g, unknown or other
  misc_feature (409)..(409): n is a, c, g, or t
tcagcatagtagtgcacgaccggtgctcgatttagacgcgatcgaagggtttggggggggtcacaagaggcagcgctctcgggacgtctcaccatggcctgggctctgctgctcctcaccctctcactcacggacacgacgggtcctcgggccctgtctcgcctgactcacgcctcgcctcgtgtcgtcggtctcgngcgtacgtcgtcactatctctcgacncgtacgaccacgcactgtcgtggttacggacttaacttaacttaccttcgtcgttccgtagtaactaccaaaccgaaccgaccgaacaaccgaaccgaacccctactacttacgttactatttacgtacgtacgacgtaacgacgtccggtaccgtacggttcgggttactacgtcgtctcgtacncgtacctcgacgtcgacgacgaaccgcctaccacgtacgactactcgtacgtcggactcgtacgccgtgacgacggtagctataacgtctacgtacgcgtaactctacgtacttacgtagtaacggtcgtacgtttccgttaactttccggtttacggtacgggtacggcgggtaacggtacgacgtaccggtacgtacggttaaactcgtaacccgtacgacccggttacgtccccggaccgttcccgttcgtaccg

SEQ ID NO: 118077 - DNA, 905 bp, Homo sapiens
  misc_feature: GYAE6OF01CO3NY.10.27.C05.1.454.CMB.1.raw
tcagcatagtagtgcacgaccggtgctcgatttagacgcgatcgaagggtttgggggggggtcacaagaggcagcgctctcgggacgtctccaccatggcctggctctgctgctcctcaccctctaactcagacacgagggtcctggccctgtcctcgccctgacctcacgcctgcccttccgtgtcgtcggtcctccgtggacgtacggttccggccacctacttccgtcctgtacctaccggtccggaacccgagacctaacgttggtacgttcggttacggtaccttaacttttaccgttaccgtttcggtcccttaccggtaacggtaacctaacccgtaaaaccgacccgaacccgaaggaaaccccaaccccgtccccaacttactttacgttagttactttagaacggtaacgtaccggtaacggtaaccggtccccggttaccggtttacggggtttaacggttttcccgtacggttcccgttccgtttccgttaccgtaccgtaaccccgttacgtaaaccggtcggttaccggaaccgtaacccgtacccgtcccttacgaacgtaacctacgttcccggtacggtaccggtccgtaccggtacgggtaccgtaacggacccgggtacgttacggtaacgttaacgttaacgtttaccgtacggtacgaaccgttacgtaccgtacttacggttaacggtcgttaacggtaccggtttccggttaccgttttacccggtttacggttttaacggggttccgggtttaaccggggaccgggttaaccgggtccggtaccgtaccggttccggtaacccgttaccggtaccgtccggtaacccgtacccggtaccgttacccggtaccccgttacccggtccgttaccggttccccg

SEQ ID NO: 118078 - DNA, 736 bp, Homo sapiens
  misc_feature: GYAE6OF01BTBH7.10.27.C05.1.454.CMB.1.raw
tcagcatagtagtgcacgaccggtgctcgatttagacgcgatcgaagggtttggggggggtcacaagaggcagcgctctcgggacgtctccaccatggcctggctctgctgctcctcaccctcctcactcaggacacagggtcctgggccctgtctgccctgactcagcctgcctcgtgtctggtctcctggacagtcgcaccatctctgcactcggaccagcactgagtggtggctagttactaccttgtctctgtatacaacacgccagacaaccgccccactactcttagtatttactagaacgtcgaaggtacgccggtccgtacggtagggtttctacgtcgtcgttctactcgtccctaccgtaacgtcgtcgtaccaacccgtaccggtccccttaccgtacgtaacctacttccgttacggtccgggtccctaccgtacggtactaacggaaccggtacggacggtacgttaggttaacttacgtttacccggtagtacccgtaggtcctttaaccgtaagttacggtttaacgggtaacggttcggttccggggtttactttacccggttttcgtttaccgggtttaacgggggtttccggaaccggggtaaccgggtaacccgtacgggtccggttaccggtaaacccggttaccgttaaccggtaacgtacccggtaaccccggtcgggtacccgtcccccgggttccccgttccggttaccccg

SEQ ID NO: 118079 - DNA, 809 bp, Homo sapiens
  misc_feature: GYAE6OF01BLTEY.10.27.C05.1.454.CMB.1.raw
  modified_base (105)..(105): a, c, t, g, unknown or other
  misc_feature (105)..(105): n is a, c, g, or t
  modified_base (132)..(132): a, c, t, g, unknown or other
  misc_feature (132)..(132): n is a, c, g, or t
  modified_base (190)..(190): a, c, t, g, unknown or other
  misc_feature (190)..(190): n is a, c, g, or t
  modified_base (797)..(797): a, c, t, g, unknown or other
  misc_feature (797)..(797): n is a, c, g, or t
  modified_base (802)..(802): a, c, t, g, unknown or other
  misc_feature (802)..(802): n is a, c, g, or t
  modified_base (804)..(804): a, c, t, g, unknown or other
  misc_feature (804)..(804): n is a, c, g, or t
  modified_base (806)..(806): a, c, t, g, unknown or other
  misc_feature (806)..(806): n is a, c, g, or t
tcagcatagtagtgcacgaccggtgctcgatttagacgcgatcgaagggtcctgggccctgtctgccctgactcagcctgcctccgtgtctgggtctcctggacngtcggtcaccatctctgcactggaccngcactgatgtggctattataccttgtctcctgtatcaacacgccagacaacgccccanactcttagatttatagtaacgtcgaagttaacgcccggtacccttggtaacggggttttcctaggttccgtcctttcgtacctcgtccctaccgtaacgtcgttcggaccgaaactacccggtcccttcccgtatacctaactccgttaccgtcgggcctaccgtacggccgtacggtaacccggacggtacggtacttaagtaaacgtttaactttaccgacggtacgtaccgttactaccttaaaggttacgttacgggtaagttaacgggtttcggtttaccgggtttacccttttaacgggtttttaccgggtttaaacggggttttccgggaaccggggttaaccgggtaccggttacgggtacccgtacggttacccgttaaccgtaaaccggttaccgaaccccggtaaccgtaaccggtccgtacccccgtaccccgttcggtaacctaccgtttcccggttaccctacccccttcccgtacccttaacccgttaaccgttaacttaacccggttcgaccgtacgggttcccggacgggtaccgttaccggacggttaaccggcccgaaagttgaaccgtgtaacgtggaaccttcagngacgncngngtg

SEQ ID NO: 118080 - DNA, 706 bp, Homo sapiens
  misc_feature: GYAE6OF01A6XAD.10.27.C05.1.454.CMB.1.raw
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgactccgtgtccgtgtctcgagncgagcnctactctcctcgtcncctgtcgaccacgcacgtaggtacagtaggttaggtnttaacttaacgttacgttcgttccgtacccttaccggtaacccaaaccctaaaccaacccccgaccgggtccccggaacccgaccccccgaaccgtactacctactactaaccttttcttacgatcggttcacggtagtaccgttccggttcccggtttacggtagtttaccttacgtaccgtcctttccgtctccgtcccgtaccgtagtacctcggacctaaacccgccggtaccctttccctaccgtcctaacctcggtacccccgggtcctacccgaccggtacgtcggtaaccgggacgtaacgtacccgtactaccgtttacttacgttccgcgcgtactactacgtacctaccgacccgacggctacctcgtcgtactagtccgttacggcgggtaggaccgttcgacgtccacccggtacacctccggacgcccgtaccgtcccg

SEQ ID NO: 118081 - DNA, 704 bp, Homo sapiens
  misc_feature: GYAE6OF01DY524.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcacgtcggacccagcactgatggttggactattactaaccttgtctctggtatacaacaaccgccagaacaaacgcccccatacctcttagtactttatagaagtacagtaacgccggtccctacgacgggtaccctacgaccgtattctcgtcggtacctaccacgtcgtacggccacccgtcgaccgtaccccgttcccgtcgtaccctaacgtcggtaacgggtccggggaccccgttacccggggtacccggagggtacgtacggaccgttcgtacgttaagtttacctttacggtgttaggtacggtcgtaaggttacgggaatacggaaccgacggttaccggtaggtacggttacttacgtttagttcccggttacggttaccggtaacggttacgggaacccgtaacgggttccctaccccgttacccgtacgtacccgaaccggtacccaaccggtaacccccaccccgtcgttacccg

SEQ ID NO: 118082 - DNA, 718 bp, Homo sapiens
  misc_feature: GYAE6OF01AWF0Q.10.27.C05.1.454.CMB.1.raw
  modified_base (346)..(346): a, c, t, g, unknown or other
  misc_feature (346)..(346): n is a, c, g, or t
  modified_base (693)..(693): a, c, t, g, unknown or other
  misc_feature (693)..(693): n is a, c, g, or t
tcagcatagtagtgcacgaccggtgctcgatttagacgcgatcgaagggtttgggggggggtcacaagaggcagcgctctcgggacgtctccaccatggcctggctctgctgctcctccaccctcctcactacgagacgacgacgggtccgtcgggtccctgtcctcgcctacgtacctcacgcctcgtccgttcgtcgtcgtcggtcctcgtcggacgtgtccgtcacctactcctctcgctacgcggaccacgcacgtgtgttggtaggactacttacgttacgttcgtcttcgtagtactaccaactaccgaccaacgaccgaacccgaccctacgtaccttnttacgtacttagtaggtagtacgtacggtaacggtccgttaccgttacgggttacggtttcgtacgtccgttcgtttccgtccgtcgtaccctacgttacgtaccgtacgaaccgaccgtaccgtcccgtactacgtactacgtccggttacggtccggtacgtccgtacggtagacccggacgtacggtacgtacgttacgtacgttactacgcgtacgtctacctaggttacttagtaacgtcgttcggttacgttccggttacttacggttcgggtttacggtcgggtacgtacggacccgtcgtaccggtcgtaccgtacgtccgaccgtaccgaccggtacncccgttcccggttccggccttccgg

SEQ ID NO: 118083 - DNA, 726 bp, Homo sapiens
  misc_feature: GYAE6OF01ENDZ0.10.27.C05.1.454.CMB.1.raw
  modified_base (307)..(307): a, c, t, g, unknown or other
  misc_feature (307)..(307): n is a, c, g, or t
tcagcatagtagtgcacgaccggtgctcgatttagacgcgatcgaagggtttcggggggggtcacaagaggcagcgctctcgggacgtctccaccatggcctggctctgctgctcctcacctcctcactcaggacacagggtcctcgggccctgtcctgccctgactcagctcgcctccgtgtcgtcggtctccgtggacctaggtccgtcaccacttctcctgcacgtacggaccagctactgacttggtcggactattactactttcgctacgtcgtactacaactaccggccaagaaccaaccncccctagctttacttatacttttagagtacgtacgagtaaccgccgttacccgttaggttccgggtttacctcgtcctacctttcgcgtaccgtccctaacgtacggttccgtacgacccgtaaccgtcccggtaccctcgtaacgaaacttaccgttcgtacggtaccgtcctacggcgtacgtacgaacggacgtacggtacctaggtaacttaaccggttctacggctacgaccttagtacgttatacggttagcttaccgggtaccttaccgtttacggtttaccggttaacggtttccgggaaccggttaacgggaccgtttaacggtcgttaaacccggaccggtttaaccgttaccgaacccggtacccgtaccggttacccgacccttcccggttcccccgtagttccccg

SEQ ID NO: 118084 - DNA, 628 bp, Homo sapiens
  misc_feature: GYAE6OF01B0LJ2.10.27.C05.1.454.CMB.1.raw
  modified_base (210)..(210): a, c, t, g, unknown or other
  misc_feature (210)..(210): n is a, c, g, or t
  modified_base (265)..(265): a, c, t, g, unknown or other
  misc_feature (265)..(265): n is a, c, g, or t
  modified_base (494)..(494): a, c, t, g, unknown or other
  misc_feature (494)..(494): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctcgccctgactcagcctgcctccgtgtcgtggtctcctggacagtcgtcaccntcctctgccacgtcggacccagcactgatgtggctattactacttgtctctgtanacaacacgaccaagaccaaccgccccactacttcgttagtatttagtagaagtacaggtacgccgtacctcgtagggttctacgtcgcttctctcgcctcacgtcgtacggaccacgaccggtcctacctgactacgtctacggtcggccttaccgaggtccgtacgaacggacggaggtctaagtaacttagttacgcggactgtccttataagttcgtaggttacgngtttacggtcgttacccgtttgtttaacgggtacggggttttccggaaggggtaccgaccggtaggtccctaaggtaccctacgttacgaacccgtacggtacccgtacggtcccgtcccgtccccgtgtaccc

SEQ ID NO: 118085 - DNA, 907 bp, Homo sapiens
  misc_feature: GYAE6OF01BV5K1.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcgaggacacgagggtcctgggccctgtcctgccctgactcacgcctgcctccgtgtctgggtcctccgtggactaggtccgtacacctacttcctccgtgccacgtaccggacccaagtccgaacgtggtagttgggtttcgggacttaactttaacgttaaccgtttcggtccttccgttaggtaactaccgaaaccgaccgtacccgaaacggaacccaaacccgtcccccaactaccgtttccgtttaagtaacttttacgtaacggtaacgtaaccgaacggttaaccggcccgggttccccgtttaacgggttacggggttttacctaccggttccgtttccgtttaccgttacggttacccgtacccgtttaacccggtaaacggtttcccggtaaccgggtaaaccctaaacccgggtaccccgggttacccccttaacccggttaagtaaacccgttaaccgttccggttaacccggttccgggtaccccgtttacccggaacggggttcccgttaaccgggaaaccggtaaccgggtacgtaaacccgttaaggtaaacctttaccggtttaaccgcggtaaccgtacgtttacggtaaccttaaggttaccgtaagggttaacgttcggttaccggtccgtttaccgtttacgttaacgggttacgggttaccggacgggttacggaccttagggccttacgggacccttcgggtaaacaccgggacgtacccggaacggtccctccccgttcccggtcgttacccg

SEQ ID NO: 118086 - DNA, 669 bp, Homo sapiens
  misc_feature: GYAE6OF01AXSX2.10.27.C05.1.454.CMB.1.raw
  modified_base (522)..(522): a, c, t, g, unknown or other
  misc_feature (522)..(522): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctcgcctccgtgtctgggtctcctggaccagtcggtcaccatccgtcctgcactcggacccagccactggattggttggctattactaaccttgtcctctggtactacaacaaccgccagacaacgccccacactcttgtatttatgaagtacagtaacgccggtcccgtgtacgggttcctacgtcgtccttactcgtcgtccctaccgaagttccgtacggacctaacccgaccgggtccccttacccgtacgtaaacctacttaccgtccgtccgggaccttccgacggtcgtacggaacccggacggtaggtaccgtagtaaacgttacgtttaccgtacgacgtacnccgttataagttaggtagtaacgtagttccgggttactccttttacggtttacgtaacgggtttcgggacggtacggacgtacggtcgtacgtaccggtcctaacgccgacgtacccgacggaccgtcccgtccccgtcggtacccg

SEQ ID NO: 118087 - DNA, 177 bp, Homo sapiens
  misc_feature: GYAE6OF01D0YZU.10.27.C05.1.454.CMB.1.raw
  modified_base (127)..(127): a, c, t, g, unknown or other
  misc_feature (127)..(127): n is a, c, g, or t
  modified_base (148)..(177): a, c, t, g, unknown or other
  misc_feature (148)..(177): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctnactcaggacacgaccgggttnnnnnnnnnnnnnnnnnnnnnnnnnnnnnn

SEQ ID NO: 118088 - DNA, 715 bp, Homo sapiens
  misc_feature: GYAE6OF01AX710.10.27.C05.1.454.CMB.1.raw
  modified_base (214)..(214): a, c, t, g, unknown or other
  misc_feature (214)..(214): n is a, c, g, or t
tcagcatagtagtgcacgaccggtgctcgatttagacgcgatcgaagggtttggggggggtcacaagaggcagcgctctcgggacgtctccaccatggcctggctctgctgctcctcaccctcctcactcaggacacacgggtcctgggccctgtctcgccctgactcacgcctcgcctccgtgtctcgggtctcctggacagtccggtcaccntcctcctgctacgtcggacccagctaactgagttggttcgggacttaagttacttacctttggtccttccgtaggtactaaccgaaaccgaaccgcccaagaaccaaacccgtcccccaactacgtttgttacgttatttaacgagtaacgtacgtaacggtaaccggccggtaccccgttgggttaacgggtttctacgtccgttcttctacgtcgtacccgtaactaacggtcgttcgaacctaaccgacccgtacccgttcctaacgtaactacgttcgacgtcggacctcggacggtctaccggacggtacggtaagtacttaacgtaactttactaacgtctacgaacgtcctaatacgttagtacgtaagttcgtacgtacgttcctttacgttacgggtacgggttacgggccggtacgtaccggtagtccgttaccggacccttacgaagtcccgacgtaccgaacgttcccgtcccgacccgttcggtaccc

SEQ ID NO: 118089 - DNA, 858 bp, Homo sapiens
  misc_feature: GYAE6OF01ARBYW.10.27.C05.1.454.CMB.1.raw
  modified_base (282)..(282): a, c, t, g, unknown or other
  misc_feature (282)..(282): n is a, c, g, or t
  modified_base (681)..(681): a, c, t, g, unknown or other
  misc_feature (681)..(681): n is a, c, g, or t
tcagcatagtagtgcacgaccggtgctcgatttagacgcgatcgaaggggtttgggggggggtcacaagaggcagcgctctcgggacgtctccaccatggcctgggctctgctgctcctcaccctcctcactcgaggacacgtacgggtccgtcgggccctgtcctcggtccctagacccttcgacgtccctcgtcccttccggttgttccggtgggttcctccgtaggtaccgtggttcggtaccacctacgtcgtcctggaccttacggaccggaacccngtccgtagtgttaggtttacgggtcggtacttaactttacctttaaccgtttcgttaccgttcggttattacgtaccgtaaaccgttaacccgaccgaacgtaaccccaaaccggacccccctaacgtacctttgttaacgtttacttacgtaacggtactaaccggacgtaacggtcccggttacccgttcggttaaaccgggtttcttacggtaccttctttacccgtcggtactttcccgaccgtaagttccggttacggaacccgtaccggtacccgttccccgttacccgttaaagtaaccttccggttaccttcgggtccgtacccgtaccggttcggtacggtacggtaaccgggaacggttacggtacggtaacttaacttacggttaacncggtacgtcaccttagtacttaacggttagtacgtaggtttccgtaacgttcttttaaccgggttcggttaaacggggttcggtaccggggttaccggacgtacgggtccgttaaccgggacgtttaccgacgtaacccgcggtacgtaccggtccctccggtccccgtgttacccg

SEQ ID NO: 118090 - DNA, 910 bp, Homo sapiens
  misc_feature: GYAE6OF01DA7MZ.10.27.C05.1.454.CMB.1.raw
tcagcatagtagtgcacgaccggtgctcgatttagacgcgatcgaaggggtttggggggggtcacaagaggcagcgctctcgggacgtctccaccatggcctgggctctgctgcctcctccaccctcctcactcagacacgacgggtcctcgggcctgtctcgccctgactcacgcctcgtcccgtcgtgtcgtcgggttcctaccgtggacgtacggtccggtaccaacctacttccgtcctcgaccgtaccggtaccggaacccagtcctacgtaggtacggttcggttacgggactttaacgttaactttaaccgtttcgttaccgttaccgttaacggtaacctaaccctaaaacccgaaacccggtaacccaaaacggtaaaacccgaaaaccccgtacccccctaaacgttaccgtttaccgtttaagttaacgtttaacgtaacggtaaaaccggtaccggtaaacgggttaccggtaccccgggttacccggtttacggggttacgggttttaccgtaacggttccgttaccgtttccgtaccgttacccgttacccgttaccggtaacggttccggttaaccgaaccgtaacccggccggttaccctaccgtaacgtaacctacgttcggtacgtacgggtcctacggtacggaccgtacgacggtacggtacgtcgttaacgtacttaacgtcgtacgaccttacgacttaactaggtaacgttaggtaacgtgggttacctccggtttaaccctttacgggttttaccggggttaaacgggttccgggaaaccgggtcggtaacgtacgggttacctaaccggtacccttaacggaacgtaccccgtacggtaaaccccggtcgtacccccgttcccggtccccgttaaggttaccccg

SEQ ID NO: 118091 - DNA, 701 bp, Homo sapiens
  misc_feature: GYAE6OF01BX3WO.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgcctcctcaccctcctcactcaggacacgagggtcctgggccctgtctcgccctgactcagcctcgcctccgtgtcgtgggtctccgtggacacgtcgtcaccatctcctgcactcgaccagccactgagttggttggactaattacttaccttgtacctcgtagtactaccaaccaaccgaccaagaaccaaccgccccctactacttacgttattactttagcgtaagtacgacggtacgccggtcccgtacggttacgggtttctacggtcgtcctttctacctccggtaccctacgtaacgtccgtacggacctaacccgtacccgtccctaccgtacgaaccttacgtccgtcgtacgggtcctaccggacgtccgtacggaccgacggtacggtactagtaacttacgttacacggactacggtctacgttattagtacgtaggtacggttcgtcgtttccgtttacggtttacgggttaccgggtttcggggaccgggtacggaccggtaggtccggtacgttacccggtacgtacgaaccggtaccgacccgtaccggcccttcccggccccgttcgtaccc

SEQ ID NO: 118092 - DNA, 509 bp, Homo sapiens
  misc_feature: GYAE6OF02G116W.10.27.C05.1.454.CMB.1.raw
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgccttctttcaaggttttcggcggagggaccaggctgaccgtcctaagtcagcccaaggctcgcccctggtcc

SEQ ID NO: 118093 - DNA, 480 bp, Homo sapiens
  misc_feature: GYAE6OF02GHQNO.10.27.C05.1.454.CMB.1.raw
  modified_base (471)..(472): a, c, t, g, unknown or other
  misc_feature (471)..(472): n is a, c, g, or t
  modified_base (474)..(480): a, c, t, g, unknown or other
  misc_feature (474)..(480): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgcccctcggtcactctgttcccaccctcctccactactatgctgagcggctggcaaggcgcatgnngnnnnnnn

SEQ ID NO: 118094 - DNA, 282 bp, Homo sapiens
  misc_feature: GYAE6OF02G2181.10.27.C05.1.454.CMB.1.raw
  modified_base (279)..(282): a, c, t, g, unknown or other
  misc_feature (279)..(282): n is a, c, g, or t
tcagcatagtagtgcacgaccggtgctcgatttagacgcgatcgaagggtttgggggtgtggtggtctccactcccgccttgacggggctgctatctgccttccaggctgacgacgaggctgaatattactgcagctcatatgtagatggtgcctctttcaaggttttcggcggagggaccaggctgaccgtcctaagtcagcccaaggctgccccctcggtcactctgttcccaccctcctccactactatgctgagcgggctggcaaggcgcatagnnnn

SEQ ID NO: 118095 - DNA, 534 bp, Homo sapiens
  misc_feature: GYAE6OF02G83KQ.10.27.C05.1.454.CMB.1.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (370)..(370): a, c, t, g, unknown or other
  misc_feature (370)..(370): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttangaagtcagtaagcggccctnaggggtttcagtcgcttctctgcctccaagtctggcaacacggcctccngacaatctctgggctccaggctgacgacgaggctgaatattactgcagctcatatgtagatggtgccttctttctaaggttttcggcggtagggacccgagggtccgtacggtaccgtaccgtacgtacgaccgaccgacgtccgtcccgtcccgtcgtacccg

SEQ ID NO: 118096 - DNA, 506 bp, Homo sapiens
  misc_feature: GYAE6OF02JBMFV.10.27.C05.1.454.CMB.1.raw
  modified_base (442)..(442): a, c, t, g, unknown or other
  misc_feature (442)..(442): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctcaggctgacgacgaggctgaatattactgcagctcatatgtagattggtgccttntttcaaggttttcgcggaggaccaggctgaccgtctaagtcagcccaaggctcgcccctggtcc

SEQ ID NO: 118097 - DNA, 514 bp, Homo sapiens
  misc_feature: GYAE6OF02G96MK.10.27.C05.1.454.CMB.1.raw
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcacttatgttgggcattataaccttgtctcctggtatcaacaacgcccagacaaagcccccacactcttgatttatgaagtcagtaagcggccctcagggtttctagtcgcttctctgcctccaagtctggcaacacgcctcctgacaatctctggctccaggctgacgacgagctgaatattactgcagctcatatgtagatggtgccttctttcaaggttttcggcggtagggaccaggctgaccgttctaagtcagcccgaaggcctcggccccctggtctaccg

SEQ ID NO: 118098 - DNA, 526 bp, Homo sapiens
  misc_feature: GYAE6OF02ISJMY.10.27.C05.1.454.CMB.1.raw
  modified_base (324)..(324): a, c, t, g, unknown or other
  misc_feature (324)..(324): n is a, c, g, or t
  modified_base (441)..(441): a, c, t, g, unknown or other
  misc_feature (441)..(441): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatgttgggcattataaccttgtctcctggtatcaacaacgcccagacaaagcccccacactcttgatttatgaagtcagtaagcggccctnaggggtttctagtcgcttctctgcctccaagtctggcaacacggcctccctgacaatctctgggctccaggctgacgacgaggctgaattattactgcagctcatatgtagatggtnccttctttcgtaaggttttcggcggtagggaccaggactcgaccgtcctaagtccacgcccgaaggcctcggcccccgtggtacc

SEQ ID NO: 118099 - DNA, 514 bp, Homo sapiens
  misc_feature: GYAE6OF02FJ0O2.10.27.C05.1.454.CMB.1.raw
tcagcatagtagtgcacgaccggtgctcgatttagacgcgatcgaagggtttgggggttcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagcgcatattcaggccccaagagggttgttggcggcgggactaaggtgaccgtcgtgggtcagcccaaggctcgcccctggtcactctgtccccg

SEQ ID NO: 118100 - DNA, 282 bp, Homo sapiens
  misc_feature: GYAE6OF02FY81X.10.27.C05.1.454.CMB.1.raw
  modified_base (279)..(282): a, c, t, g, unknown or other
  misc_feature (279)..(282): n is a, c, g, or t
tcagcatagtagtgcacgaccggtgctcgatttagacgcgatcgaagggtttgggggtgtggtggtctccactcccgccttgacggggctgctatctgccttccaggctgacgacgaggctgaatattactgcagctcatatgtagatggtgcctctttcaaggttttcggcggagggaccaggctgaccgtcctaagtcagcccaaggctgccccctcggtcactctgttcccgccctcctccactactatgctgagcgggctggcaaggcgcatagnnnn

SEQ ID NO: 118101 - DNA, 280 bp, Homo sapiens
  misc_feature: GYAE6OF02GHLMI.10.27.C05.1.454.CMB.1.raw
  modified_base (279)..(280): a, c, t, g, unknown or other
  misc_feature (279)..(280): n is a, c, g, or t
tcagcatagtagtgcacgaccggtgctcgatttagacgcgatcgaagggtttgggggtgtggtggtctccactcccgccttgacggggctgctatctgccttccaggctgacgacgaggctgaatattactgcagctcatatgtagatggtgcctctttcaaggttttcggcggagggaccaggctgaccgtcctaagtcagcccaaggctgccccctcggtcactctgttcccaccctcctccactactatgctgagcgggctggcaaggcgcatagnn

SEQ ID NO: 118102 - DNA, 563 bp, Homo sapiens
  misc_feature: GYAE6OF02I0V2O.10.27.C05.1.454.CMB.1.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttangaagtcagtaagcggccctnagggtttctagtcgcttctctgcctccaagtctggcaacacgcctccctgacaatctctggctccaggctgacgacgaggctagaattatactgcagctcatatgtagatggtgtcccttcttttacgtaagggttttcgggacgggtacgggaccgacgggtcttacggtacccgttaccgtaagtccgaacggtaccccgtaaaggtccgtcccggtaccccccgttccgggttaccc

SEQ ID NO: 118103 - DNA, 279 bp, Homo sapiens
  misc_feature: GYAE6OF02I8OHA.10.27.C05.1.454.CMB.1.raw
  modified_base (278)..(279): a, c, t, g, unknown or other
  misc_feature (278)..(279): n is a, c, g, or t
tcagcatagtagtgcacgaccggtgctcgatttagacgcgatcgaagggtttgggggtgtggtggtctccactcccgccttgacggggctgctatctgccttccaggctgacgacgaggctgaatattactgcagctcatatgtagatggtgcctctttcaaggttttcggcggagggaccaggctgaccgtcctaagtcagcccaaggctgccccctcggtcactctgttcccaccctcctccactactatgctgagcggctggcaaggcgcatagnn

SEQ ID NO: 118104 - DNA, 589 bp, Homo sapiens
  misc_feature: GYAE6OF02I4RVK.10.27.C05.1.454.CMB.1.raw
  modified_base (319)..(319): a, c, t, g, unknown or other
  misc_feature (319)..(319): n is a, c, g, or t
  modified_base (369)..(369): a, c, t, g, unknown or other
  misc_feature (369)..(369): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatgttgggcattataaccttgtcctccgtggtatcaacaacacccaggcaaagcccccaaactcatgattttgatgtccagttaancggccctgaggggtttcagtcgcttctctgtcctccaagtctaggcaacnccggctccctgacaatctctgggcctccaggctgacgacgaggactgaattagttactgacacgctcatagtggtagagttggtgcccttacggtttcctaaggggtttttccgggacgggtacgggtacccgtagggtcctacggtacccgttaccgtaacggtcccaaccggtccccgaaacggtcccgtaccgggtcccccccgttcgggttacccc

SEQ ID NO: 118105 - DNA, 534 bp, Homo sapiens
  misc_feature: GYAE6OF02HK7J1.10.27.C05.1.454.CMB.1.raw
  modified_base (290)..(290): a, c, t, g, unknown or other
  misc_feature (290)..(290): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccanactcttgatttatgaagtcagtaagcggccctcaggggtttctagtcgcttctctgcctccaagtctggcaacacgcctccctgacaatctctggctccaggctgacgacgaggctgaattattactgcagctcatatgtagatggtgccttctttcgtaaggttttcggcggtagggaccgagggtctacgaccggtccgttaagtcgacgacccgaacggtcctacggccccctcggtaccc

SEQ ID NO: 118106 - DNA, 309 bp, Homo sapiens
  misc_feature: GYAE6OF02IS6H8.10.27.C05.1.454.CMB.1.raw
  modified_base (280)..(284): a, c, t, g, unknown or other
  misc_feature (280)..(284): n is a, c, g, or t
  modified_base (286)..(309): a, c, t, g, unknown or other
  misc_feature (286)..(309): n is a, c, g, or t
tcagcatagtagtgcacgaccggtgctcgatttagacgcgatcgaagggtttggggggtgtggtggtctccactcccgccttgacggggctgctatctgccttccaggctgacgacgaggctgaatattactgcagctcatatgtagatggtgcctcttttcaaggttttcggcggagggaccaggctgaccgtcctaagtcagcccaaggctgccccctggtcactctgttcccaccctcctccactactatgctgagcgggctggcaaggcgcatagnnnnncnnnnnnnnnnnnnnnnnnnnnnnn

SEQ ID NO: 118107 - DNA, 568 bp, Homo sapiens
  misc_feature: GYAE6OF02ITU7P.10.27.C05.1.454.CMB.1.raw
  modified_base (447)..(447): a, c, t, g, unknown or other
  misc_feature (447)..(447): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgccccacactcttgatttatgaagtcagtaagccggccctcgtaggggtttctagtcgcttctctgcctccaagtctggcaacacggcctccctgacaatctcgtggctccaggctgacgacgagctagaattattactgcagctcatatagtagagtggtcncctttctttcgtaaagggttttcggcgggtacgggaccgtagggtcttacggtacccgttaccgtaacggttccgaaccggtacccgaaagggtccctacccggtccccccgtacggtccc

SEQ ID NO: 118108 - DNA, 575 bp, Homo sapiens
  misc_feature: GYAE6OF02GZS4M.10.27.C05.1.454.CMB.1.raw
  modified_base (304)..(304): a, c, t, g, unknown or other
  misc_feature (304)..(304): n is a, c, g, or t
  modified_base (404)..(404): a, c, t, g, unknown or other
  misc_feature (404)..(404): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttangaagtcagtaagcggccctcaggttgtttctagtcgtcttctctgcctcaagtctggcaacacggcctccctgacaatctctggctccgagctgacgagnggctagaatattactgcagctacatatgtagagtggtcgtccttgtttaccgtaagggtttttccgggacgggtaacgggtacccgtaagggtaccgttacggtaacccgttacccgttaaacgttccgaacggtaccccgaagggtccctaccggtccccccgttacggg

SEQ ID NO: 118109 - DNA, 483 bp, Homo sapiens
  misc_feature: GYAE6OF02GSS4K.10.27.C05.1.454.CMB.1.raw
  modified_base (272)..(272): a, c, t, g, unknown or other
  misc_feature (272)..(272): n is a, c, g, or t
  modified_base (473)..(483): a, c, t, g, unknown or other
  misc_feature (473)..(483): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacncggcctccctgacaatctctgggctccaggctgacgacgaggctgaatattactgcagctcatatacaaccagcagcacttctgtattcggcggaggaccagctgaccgtcctaggcagcccaaggctcgcccctcggtccactcctcgttcccaccctcctccactactatcgctgacgcggctggcacggcgcgatagnnnnnnnnnnn

SEQ ID NO: 118110 - DNA, 542 bp, Homo sapiens
  misc_feature: GYAE6OF02HEEOV.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatgttgggcattataaccttgtctcctggtatcaacaacgcccagacaaacgcccccacactcttgatttatgaagtcagtaagcggccctcaggggtttctagtcgcttctctgcctccaagtctggcaacacggcctccctgacaactctctggctccgaggctgacgacgaggctagaattattactgcagctacatatgtagtatggtgtccttctttcgtaagggttttcggcggtacgggaccagggctacgaccgttccgtaagtccgacgcccgaaggccgtccgtccccgtcggtaccc

SEQ ID NO: 118111 - DNA, 489 bp, Homo sapiens
  misc_feature: GYAE6OF02I51JP.10.27.C05.1.454.CMB.1.raw
  modified_base (475)..(476): a, c, t, g, unknown or other
  misc_feature (475)..(476): n is a, c, g, or t
  modified_base (478)..(479): a, c, t, g, unknown or other
  misc_feature (478)..(479): n is a, c, g, or t
  modified_base (481)..(489): a, c, t, g, unknown or other
  misc_feature (481)..(489): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgccttctttcaagggtttttcggcggagggaccaggctgaccgtctaagtcagcccaaggctcgcccctcggtcactctgttccccgcctcctccactactatgctgagcggctggcaaggcgcagtgnngnngnnnnnnnnn

SEQ ID NO: 118112 - DNA, 574 bp, Homo sapiens
  misc_feature: GYAE6OF02JHQTT.10.27.C05.1.454.CMB.1.raw
  modified_base (288)..(288): a, c, t, g, unknown or other
  misc_feature (288)..(288): n is a, c, g, or t
  modified_base (321)..(321): a, c, t, g, unknown or other
  misc_feature (321)..(321): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgcccccanactcttgatttatgaagtcagtaagcggccctnaggggtttctagtcgcttctctgcctccaagtctggcaacacggccctcctgacatctctggctccagctgacgacgagctagaatattactgcagtatcatatgtagtatgggtctcccgttctttacgtaaaggttttccgggacgggtacgggtaccaggggtccttacggtaccccggttaccgttaaacggttccaacggtcccccgaaagggtcccttacccggtacccccccgttcgggttacccc

SEQ ID NO: 118113 - DNA, 482 bp, Homo sapiens
  misc_feature: GYAE6OF02GJTAS.10.27.C05.1.454.CMB.1.raw
  modified_base (198)..(198): a, c, t, g, unknown or other
  misc_feature (198)..(198): n is a, c, g, or t
  modified_base (472)..(482): a, c, t, g, unknown or other
  misc_feature (472)..(482): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccanactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcgaaggttttcggcggagggaccaggctgaccgtctaagtcagccaaggctcgcccctggtcactctcgttcccaccctcctccactactatcgctgagcggctgcaggcgcagtagnnnnnnnnnnn

SEQ ID NO: 118114 - DNA, 621 bp, Homo sapiens
  misc_feature: GYAE6OF02G1SGF.10.27.C05.1.454.CMB.1.raw
  modified_base (608)..(608): a, c, t, g, unknown or other
  misc_feature (608)..(608): n is a, c, g, or t
  modified_base (611)..(614): a, c, t, g, unknown or other
  misc_feature (611)..(614): n is a, c, g, or t
  modified_base (616)..(621): a, c, t, g, unknown or other
  misc_feature (616)..(621): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccgtctcctgcactggacccacgcactgatgttgggcgattataaccttgtctcctggtatcaacaacgcccacgacaaacgacccccaccactcttgatttatgaagtcagtaagcggccctcaggggttcgtagtcgcttctctgcctccaagtctggcaacacggcctcctgacaatctctgggctccaggctgacgacgaggctgaatattactgcagctcatatgtagatggtcgccttctttacgtaaggggtttttccgggcgggaacggggtacccagggtcgttacggtacccggttccttaaacggttcacggaccccgtaaacgggtccttccggccccccgttccgggtctacccttccgtttcccggttcccccggtcccccttccccttcccgtacctttaacccgttacttacggtccttacgggacgggccgggggtccgttacgggaccgaaacgggccggtacctaagttaggcgancgnnnncnnnnnn

SEQ ID NO: 118115 - DNA, 555 bp, Homo sapiens
  misc_feature: GYAE6OF02FPHBD.10.27.C05.1.454.CMB.1.raw
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggtgtttctagtcgcttctctgcctcaagtctggcaacacggcctccctgacatctctgggctccaggctgacgacgaggctgaatattactgcagctcatatgtagatggtcgccttcttttcgaagggtttttccggacgggtacgggaccgtagggccttcggtacccgttacccgtaagtccgtaacggacccccgaagggtcccgtccggtccccccgttaccggg

SEQ ID NO: 118116 - DNA, 559 bp, Homo sapiens
  misc_feature: GYAE6OF02HEZ6M.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttggcattataaccttgtctcctggtatcaacaacgcccagacaaacgcccccacactcttgatttatgaagtcagtaagccggccctcgtaggggtttctagtcgtcttctctcgcctccaagtctggcaacgaccgcctcctgacaatctcgtggctcgaggctgacgacgagctagaattattactgcagctcatatgtagatggtcgtccttctttacgtaacgggttttccggacgggtacggtaccgacggtctacggtacccgtacgtaacgtacgacgacccgaaggtcccgtaccgtcccccgtcggtacccg

SEQ ID NO: 118117 - DNA, 281 bp, Homo sapiens
  misc_feature: GYAE6OF02FKLNI.10.27.C05.1.454.CMB.1.raw
  modified_base (279)..(281): a, c, t, g, unknown or other
  misc_feature (279)..(281): n is a, c, g, or t
tcagcatagtagtgcacgaccggtgctcgatttagacgcgatcgaagggtttgggggtgtggtggtctccactcccgccttgacggggctgctatctgccttccaggctgacgacgaggctgaatattactgcagctcatatgtagatggtgcctctttcaaggttttcggcggagggaccaggctgaccgtcctaagtcagcccaaggctgccccctcggtcactctgttcccgccctcctccactactatgctgagcgggctggcaaggcgcatagnnn

SEQ ID NO: 118118 - DNA, 519 bp, Homo sapiens
  misc_feature: GYAE6OF02GT8X5.10.27.C05.1.454.CMB.1.raw
  modified_base (434)..(434): a, c, t, g, unknown or other
  misc_feature (434)..(434): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcgccctcaggggtttctagtcgcttctctgcctcaagtctggcaacacgcctcctgacaatctctggctccaggctgacgacgaggctgaattatactgcagctcatatgtagatggtnccttctttcgtaaggttttcggcggtacgggaccgaggtcgtcgacccgtcctaagtcacgcccgaaggcctcgccccgtggtcc

SEQ ID NO: 118119 - DNA, 520 bp, Homo sapiens
  misc_feature: GYAE6OF02JG7S4.10.27.C05.1.454.CMB.1.raw
  modified_base (323)..(323): a, c, t, g, unknown or other
  misc_feature (323)..(323): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggtcctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctnaggtgtttctagtcgcttctctgcctcaagtctggcaacacggcctccctgacaatctctgggctccagctgacgacgaggctgaatattactgcagctcatatgtagatggtgccttctttcgaaggttttccggcggtacgggaccgaggcctgacccgttacctaagtcacgacccaaggcctcgccccctcgg

SEQ ID NO: 118120 - DNA, 587 bp, Homo sapiens
  misc_feature: GYAE6OF02HWQM5.10.27.C05.1.454.CMB.1.raw
  modified_base (322)..(322): a, c, t, g, unknown or other
  misc_feature (322)..(322): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgtactggacccagcactgatgttgggcattataaccttgtctcctggtatcaacacgcccagacaaagcccccacactcttgatttatgaagtcagtaagcggccctnaggtgtttctagtcgtcttctctgcctccaagtctggcaacaccgcctccctgacaatctctgggctccgagctgacgacgaggctagaactattactgcagctcatagtgtagattgtcgtccttctttacgtaacgggttttcgggaccgggtacggggaccgtaacgggtcgttaccggtacccggttaccgttaaacggttcccgaacggtcccccggtaaacggtcccgttacccggtcccccccgttacgggttacccc

SEQ ID NO: 118121 - DNA, 527 bp, Homo sapiens
  misc_feature: GYAE6OF02GC77P.10.27.C05.1.454.CMB.1.raw
  modified_base (292)..(292): a, c, t, g, unknown or other
  misc_feature (292)..(292): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccanactcttgatttatgaagtcagtaagcggccctcaggagtccctgatcggttctctgcctcaagtctggcaacacggcctccctgaccgtctcgtgggcctccgaggctgaggatggaggctgattactactgcagcgcatattcacggccccaagagggttgttgggcggcgggactaggtcgaccgtcgtgggtcacggcccaaggcctcggccccctggtccacctcgtcccg

SEQ ID NO: 118122 - DNA, 517 bp, Homo sapiens
  misc_feature: GYAE6OF02I9EY1.10.27.C05.1.454.CMB.1.raw
  modified_base (414)..(414): a, c, t, g, unknown or other
  misc_feature (414)..(414): n is a, c, g, or t
tcagcatagtagtgcacgaccggtgctcgatttagacgcgatcgaagggtttggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacacgcccagacaaagcccccacactcttgatttatgaagtcagtaagcggccctcaggggtttctagtcgcttctctgcctccaagtctggcaacacgcctccctgacaatctctggctccaggctgacgacgaggctgaatattacngcagctacatatgtagatggtcgccttctttctaaggttttcggcggtagggaccgaggctggaccgtcctaagtcagcccgaaggctcggccccctggtccc

SEQ ID NO: 118123 - DNA, 509 bp, Homo sapiens
  misc_feature: GYAE6OF02FK7YI.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacatctctggctcagctgacgacgaggctgaatattactgcagctcatatgtagatggtgcctctttcaaggttttcggcggagggaccaggctgaccgtcctaagtcacgcccgaaggctcgcccctggtcc

SEQ ID NO: 118124 - DNA, 483 bp, Homo sapiens
  misc_feature: GYAE6OF02JA597.10.27.C05.1.454.CMB.1.raw
  modified_base (212)..(212): a, c, t, g, unknown or other
  misc_feature (212)..(212): n is a, c, g, or t
  modified_base (352)..(352): a, c, t, g, unknown or other
  misc_feature (352)..(352): n is a, c, g, or t
  modified_base (419)..(419): a, c, t, g, unknown or other
  misc_feature (419)..(419): n is a, c, g, or t
  modified_base (473)..(483): a, c, t, g, unknown or other
  misc_feature (473)..(483): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgattttangaagtcagtaagcggccctcaggggtttctagtcgcttctctgcctccaagtctggcaacacggcctccctgacaatctctgggctccaggctgacgacgaggctgaatattactgcagctcatatgtagatggtgcctntttcaggttttcggcggtagggaccaggctgaccgtctaagtcacgcccaaggctcgcccctggtcnctctctcccgaccctcctccacctactatcgctgacgcggctggcagcgcatgnnnnnnnnnnn

SEQ ID NO: 118125 - DNA, 588 bp, Homo sapiens
  misc_feature: GYAE6OF02H5WQF.10.27.C05.1.454.CMB.1.raw
  modified_base (418)..(418): a, c, t, g, unknown or other
  misc_feature (418)..(418): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattataaccttgtctcctggtatcaacaacgcccagacaaacgccccacacctcttgtatttatgaagtcagtaagccggccctctaggggtttctagtcgcttctctgcctcaagtctgcacacggcctccctgacaatctcgtggcctcaggctgacgacgagctagaatattacngcagctacatatgtagagtggtgtccttcgtttacgtaaacgggttttcgggacgggtacggggacccgtagggtccttacggtacccggttacccgttaaacggtcccggtaaccggaccccgtaaacgggtcccgttacccggtaccccccggttaccggttaccccg

SEQ ID NO: 118126 - DNA, 560 bp, Homo sapiens
  misc_feature: GYAE6OF02GB87L.10.27.C05.1.454.CMB.1.raw
  modified_base (292)..(292): a, c, t, g, unknown or other
  misc_feature (292)..(292): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatgttgggcattataaccttgtctcctggtatcaacaacgcccagacaaagcccccanactcttgatttatgaagtcagtaagcggccctcgaggggtttctagtcgcttctctgcctcaagtctggcaacacgcctccctgacaatctcgtgggctccgaggctgacgacgaggctagaattatactgcagctcatatgtagatggtcgtccttctttcgtaacgggttttcggcgggtacgggaccgagggtccttacggacccggttacctaacggtccacggaccccgaaggtcccgtccggtaccccccgttcggtacccg

SEQ ID NO: 118127 - DNA, 580 bp, Homo sapiens
  misc_feature: GYAE6OF02HZL5M.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagccggccctcgagggtttctagtcgcttctctgcctccaagtctggcaacacgcctcctgacaatctctggctccgaggctgacgacgaggctgaattattactgcagctcatatagtagtatggtcgtccttcgtttacgtaacgggttttcggcgggtacgggaccgtagggccgttacggtaacccggttaccgttaacggtccgaaccggaccccgtaaacgggtcccgttacccggtacccccccgttcgggttaccccg

SEQ ID NO: 118128 - DNA, 571 bp, Homo sapiens
  misc_feature: GYAE6OF02GMFTO.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgatttatgaagtcagtaagcggccctcgagggtttctagtcgcttctctgcctccaagtctggcaacacgcctccctgacatctctgggctccgaggctgacgacgaggctagaattattactgcagctacatatgtagattggtcgtcccttctttacgtaacgggtttttccgggacgggtagggacccgtagggtccttacggacccgttacccgttaacgtccgacggaccccgaacgggtccctccggtccccccgttcggtaccccg

SEQ ID NO: 118129 - DNA, 585 bp, Homo sapiens
  misc_feature: GYAE6OF02H8P3O.10.27.C05.1.454.CMB.1.raw
  modified_base (424)..(424): a, c, t, g, unknown or other
  misc_feature (424)..(424): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgtatttatgaagtcagtaagccggccctcgtagggtttctagtcgcttctctgcctcaagtctggacacgacgcctccctgacaatctctgggctccaggctgacgacgaggctagaatatttacngacagctacattaatgtaagagttcggtcgtccctttcttcgttaaacgggttttcgggacgggtagggacccgtagggtcctacggtacccggtaccgttaaaggtcccgaacggacccccgaaaggggtcccttaccggtcccccccttacgggtaccc

SEQ ID NO: 118130 - DNA, 694 bp, Homo sapiens
  misc_feature: GYAE6OF02H0FVR.10.27.C05.1.454.CMB.1.raw
tcagcatagtagtgcacgaccggtgctcgatttagacgcgatcgaagggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgacttttgtgcttaataactatgtctctggtaccagccaccaccaggacaaacgccccaaacttccttgttttgaggtcagtaacgccgcctcgaggtacgtccctgactcggttctctcgccctaccaagtctggccaaccgaccggcccttcccgtacgtacccgtcttccgtcgggtcctccgaggctggaggagtcggaggtctagtaactttacgtacgtcgacgtacgcgtactaagttacttacccgaaccgggtacccccaaagggttacggggtttcggtttaccggggaccggggtaccgggtaaacggttaaacgggtccggtaacccgttccggtacggggtaccaccgggtaacccggaacggtcccgtaccccggtccccccgttcgggttaccctacccgttccccgttacccggtttaccccctacccccgttaccctaaccccg

SEQ ID NO: 118131 - DNA, 575 bp, Homo sapiens
  misc_feature: GYAE6OF02I9M4D.10.27.C05.1.454.CMB.1.raw
  modified_base (371)..(371): a, c, t, g, unknown or other
  misc_feature (371)..(371): n is a, c, g, or t
  modified_base (427)..(427): a, c, t, g, unknown or other
  misc_feature (427)..(427): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatgttgggcattataaccttgtctcctggtatcaacaacgcccagacaaacgcccccacactcttgatttatgaagtcagtaagccggccctcgaggttgtttctagtcgtcttctctgccctcaagtctggcaacncggcctccctgacatctcgtggctccgaggctgacgacgagctagaatacttacgngacagtctacattatagtagtagtggtcgtccctttcgtttacgtaacgggttttccggacgggtacggtacccggtggtaccctaggtaccccgttaccgttaagtccgacggtaccccgaagggtccctccggtccccccgttcgg

SEQ ID NO: 118132 - DNA, 596 bp, Homo sapiens
  misc_feature: GYAE6OF02GT78F.10.27.C05.1.454.CMB.1.raw
  modified_base (340)..(340): a, c, t, g, unknown or other
  misc_feature (340)..(340): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgatttatgaagtcagtaagcggccctcgagggtttctagtcncttctctgcctccaagtctggcaacacggcctcctgacaatctctgggctccaggctgacgacgaggctagaattattactgcagtctcatacgtagtagtagttggtcgtccttcgttttacgtaagggtttttccgggcgggtaacgggtacccgtagggtcccgtacggtaaccccggttaccgttaaacggttccgaaccggtaccccgtaaacgggtcccttaccggtaccccccgttacgggttaccccg

SEQ ID NO: 118133 - DNA, 546 bp, Homo sapiens
  misc_feature: GYAE6OF02GP18N.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgcccccacactcttgatttatgaagtcagtaagcgcctcagggtttctagtcgcttctctgcctcaagtctggcaacacgcctccctgacaatctctggctcaggctgacgacgagctagaatattactgcagctacatatagtagatggtcgtccttcgtttacgtaagggttttcggacgggtacggaccgacggtctacggtacccgtaccgttaagtccgacgacccgtaacggtcctccggtcccccgttcggtaccc

SEQ ID NO: 118134 - DNA, 650 bp, Homo sapiens
  misc_feature: GYAE6OF02J2LWY.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctgtatcaacacgccagacaaacgccccacactctgattatgaagtcagtaacgcggtcctcgtagggtttcagtcgtcttctctgcctcgtaagtctggcaacacggccctccctagacaactcctcgtcggcctaccgaggtctggaaccgtacggacggtactagaattaacttcgtacgtccgagtacctacctagttaacgtaggtaacgtaaggtttcggtaacgttccctttacgttttaaccggtaaagggttttcccgggacgggtaccggggaaccttaggggtccgttaaccgtaacccggttaccgttaaacgtaccggtacccggtaacccccggaagggtccccgttaccccggtaccccccggttcggttaaccccg

SEQ ID NO: 118135 - DNA, 650 bp, Homo sapiens
  misc_feature: GYAE6OF02F4QKY.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattactaaccttgtctcctggtatcaacacgcccagacaacgccccacactcttgtactttatgaagtcagtaacgccggccctgtacgggtttctagtcgtcttctctcgcctaccaagtcgtggaccaaccgaccggtcccttacccgtagaacctaactccgttccgtcgggtccctaccgacggtcgtacggaacgacggtacggtcgtaagtaattacgttacgtgaccgagtctacaagttacgtagtagtagttggtcgtaccgtttctttacggttaacgggttttccgggacgggtaccgggaaccgtacgggtaccgtaccggtaaccggttcccgttaagtcccgtaaccggtacccgtaacgggtcctaccccggtccccccgtacgggtaccccg

SEQ ID NO: 118136 - DNA, 499 bp, Homo sapiens
  misc_feature: GYAE6OF02HD73G.10.27.C05.1.454.CMB.1.raw
  modified_base (239)..(239): a, c, t, g, unknown or other
  misc_feature (239)..(239): n is a, c, g, or t
  modified_base (478)..(478): a, c, t, g, unknown or other
  misc_feature (478)..(478): n is a, c, g, or t
  modified_base (480)..(482): a, c, t, g, unknown or other
  misc_feature (480)..(482): n is a, c, g, or t
  modified_base (484)..(485): a, c, t, g, unknown or other
  misc_feature (484)..(485): n is a, c, g, or t
  modified_base (487)..(489): a, c, t, g, unknown or other
  misc_feature (487)..(489): n is a, c, g, or t
  modified_base (491)..(499): a, c, t, g, unknown or other
  misc_feature (491)..(499): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggaaccagcagtgactttgttgcttataactatgtctcctggtaccagcaccacccaggcaaagcccccaaactccttgttttgaggtcagtaagcggcctcaggagtcccngatcggttctctgcctccaagtctggcaacacggcctccctgaccgtctctgggctccaggctgaggatgaggctgattacatgcagcgcatattcacggccccaagagggttgttcgggcggcgggactaaaggtcgaccgtcgtgggtcagcccgaaggctcgccccctggtcactctcgttaccccacctcctaccactactatcgctgacggcggcgtaggcgaaggcacatagntnnngnngnnngnnnnnnnnn

SEQ ID NO: 118137 - DNA, 584 bp, Homo sapiens
  misc_feature: GYAE6OF02GBPUI.10.27.C05.1.454.CMB.1.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggcccagtctgccctgactcagcctcctccgcgtccgggtctcctggacagtcagtcaccatctcctgcactggaaccngcagtgactttgtgcttataactntgtctcctggtaccagcaccaccaggcaaacgcccccaaactccttgttttgaggtcaaggtaagcggcctcgaggacgtccctgactcggttctctcgcctcgaagttctcggacaacacggtcctccgtcgacccgttccttcgtcgggcctccgacggcgtcggaggagtggacggtcgtacgtacttactactcgcgacgcgacatatcgacgacccaacgaggtgttcggcggtcggtacgtaggtcgaccgtcgtcggtcgacggccgaacgcgtccgtaaaccccgtccggtacgtccgtaccgtccgtcccctaccctccctaccc

SEQ ID NO: 118138 - DNA, 560 bp, Homo sapiens
  misc_feature: GYAE6OF02JE0DE.10.27.C05.1.454.CMB.1.raw
  modified_base (300)..(300): a, c, t, g, unknown or other
  misc_feature (300)..(300): n is a, c, g, or t
  modified_base (362)..(362): a, c, t, g, unknown or other
  misc_feature (362)..(362): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacacgcccagacaaagccccacactcttgatttangaagtcagtaagcggccctcgaggggtttctagtcgcttctctgcctccaagtctggcaacncgcctcctgacatctctggctccgagctgacgacgngctgaattattacngcagctcatagtagtagagtggtgtccttcgtttacgtaagggttttccggacgggtacgggtaccgagggtccgttacggacccggttaccgtaacgttccgacggtaccccgtaacggtcccgtccgtccccccgttggtaacccc

SEQ ID NO: 118139 - DNA, 577 bp, Homo sapiens
  misc_feature: GYAE6OF02H889Z.10.27.C05.1.454.CMB.1.raw
  modified_base (404)..(404): a, c, t, g, unknown or other
  misc_feature (404)..(404): n is a, c, g, or t
  modified_base (450)..(450): a, c, t, g, unknown or other
  misc_feature (450)..(450): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggacgtccctgatcggttctctgcctccaagtctggcaacacggcctcctgaccgtctctgggcctccgaggctgaggntggagctgattacctactgcacgcgcaatactacacggccccaagngggttgtttcgggcggcgggtacgtaacggtcgaccgtccgtgggtaccacggcccgtaagggcctccggtcccccgttcggtccaccgttcccttccggttcccccgtccccgttcccttaccccg

SEQ ID NO: 118140 - DNA, 606 bp, Homo sapiens
  misc_feature: GYAE6OF02GL9SI.10.27.C05.1.454.CMB.1.raw
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaaacacgcccagacaaagcccccanactcttgatttangaagtcagtaagcggccctcgaggggtttctagtcgcttctctgcctcaagtctggcaacacgccctcctgacaatctcgtggctccaggctgacgacgaggctagaattacttactgcagctcaatatggtagattgggtctcccgttcttttacgtaaagggtttttccgggacggggtacgggtacccgacggggtcttaccgggtaaccccggttacccgtttaaacggtcccgtaaccggtaccccggtaaacgggtcccgttccccgggttaccccccccggttgggttacccccg

SEQ ID NO: 118141 - DNA, 542 bp, Homo sapiens
  misc_feature: GYAE6OF02HFVYK.10.27.C05.1.454.CMB.1.raw
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgcccccacactcttgatttangaagtcagtaagcggccctnaggggtttctagtcgcttctctcgcctcaagtctggcaacacgcctcctgacaatctctgggctcgagctgacgacgagctgaatattactgcagctcatatgtagatggtgaccttctttacgtaaggtttccggacggtacgggtaccgacggtcgtacggaccgttccgtaacgttccaacggacccgaaggtcctaccgcccccgttagtcccg

SEQ ID NO: 118142 - DNA, 576 bp, Homo sapiens
  misc_feature: GYAE6OF02IJ2D1.10.27.C05.1.454.CMB.1.raw
  modified_base (362)..(362): a, c, t, g, unknown or other
  misc_feature (362)..(362): n is a, c, g, or t
tcagcatagtagtgcacgaccggtgctcgatttagacgcgatcgaagggtttggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacacgccagacaaagcccccacactcttgatttatgaagtcagtaagcgcctcgaggggtttctagtcgcttctctgcctcaagtctggacaacncggcctccctgacatctcgtgggctccgaggctgacgacgaggctagaatattactgcacgctacattagtgtagtagttgggtctccttactttacgtaacggttttcgggacgggtacgggtaccgaagggtccttacggtacccgttacccgttaaggtacccgtaaccggtaccccgtaagggtcccgttccggacccccccgttccggg

SEQ ID NO: 118143 - DNA, 580 bp, Homo sapiens
  misc_feature: GYAE6OF02F7Q5S.10.27.C05.1.454.CMB.1.raw
  modified_base (301)..(301): a, c, t, g, unknown or other
  misc_feature (301)..(301): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctctggtatcaacaacgcccagacaacgccccacactcttgatttangaagtcaagtaacgccggcctcgtagggtttctagtcgcttctctcgcctcaagtctgcaacacgcctcctgacatctcgtcggctcgaggctgacgacgaggctagtaattacttacgcgactacgtctactaattagtaggtagtagttcggtcgttaccttacgtttacggttaagggtttccgggacgggtacgggaccgtcggtcctacggtaacccgtaccgtaacgtaccgacggtacccgtaacggtccctcccggtccccgttcgtaccc

SEQ ID NO: 118144 - DNA, 576 bp, Homo sapiens
  misc_feature: GYAE6OF02FS5QM.10.27.C05.1.454.CMB.1.raw
  modified_base (357)..(357): a, c, t, g, unknown or other
  misc_feature (357)..(357): n is a, c, g, or t
  modified_base (402)..(402): a, c, t, g, unknown or other
  misc_feature (402)..(402): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggctattataaccttgtctcctgtatcaacacgcccagacaacgccccacactctgtattatgaagtcagtaagccggccctcgtaggggtttctagtcgccttctctgcctcagtcnggcacgacgcctcctgactatctcgtggctcgaggctgacgacgnggctagaattatacgtgcagtctactaattagtagtagtgtggttcgtcctttcgtttacggttaacggttttccgggacgggtacggtacccgtagggtcgttaccggtacccgttccgtaacggtccaacggaccccgtacgggtccctcccggtacccccgttcggtaccc

SEQ ID NO: 118145 - DNA, 625 bp, Homo sapiens
  misc_feature: GYAE6OF02IA0RF.10.27.C05.1.454.CMB.1.raw
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (446)..(446): a, c, t, g, unknown or other
  misc_feature (446)..(446): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggtggcattactaccttgtctcctgtatcaacaacgccagacaacgccccanactcttgatttangaagtcagtagcggcctgtagggttcacgtcgtcttctctcgtcctccaagtctaggacctaacgccgtccctccgtacgacctaactctacgtcgggtacctccgaaggtctacggacgtacgacggcttaggaattacttacgngtaccgagtctactaagttagttagtagtacgttcgggttcttacccgtttacgtttacggttaacgggttttccgggacggggtacgggaaccgtacgggtcctaccggtacccggttaaccgtaacgtaccgacggtacccgtaacggtcccgtacccggtcccccgtacggtaccc

SEQ ID NO: 118146 - DNA, 601 bp, Homo sapiens
  misc_feature: GYAE6OF02FTLB6.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccaccaggcaaacgcccccaaactccttgttttgaggtcagtagccggcctcaggactccctgatcggttctctcgcctcaagtctggcaacgcggcctcccgtgaccgtctcgtcgggctccgaggctgaggatggaggtcgtgtacttactacgtgcgagcgactattacttcgacggtaccccaaggtgggttcgtttacgggcgggtacgggtaacgttaacgggtcgacccgttccggtcgggtaccacggtccccgaaggtccgtcccgtcccccgttacggtcctaccgttccgttcccgttaccccctacccttccctacccg

SEQ ID NO: 118147 - DNA, 602 bp, Homo sapiens
  misc_feature: GYAE6OF02HDYW2.10.27.C05.1.454.CMB.1.raw
  modified_base (435)..(435): a, c, t, g, unknown or other
  misc_feature (435)..(435): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgccccacactcttgatttatgaagtcagtaacgcggccctcgtaggggtttctagtcgtcttctctcgcctccaagtctggacaacaccggcctccctgacaactctcgtcggcctccgaggtctcgacgacgaggctagaattattacngcagctcattacgtagtagtagtggtcgtcctttcgtttacgttaaggggtttttccgggacgggtacgggtaccgtacgggtcctaccggtacccgttaccgttaacggtccgaaccggtaccccgaacggtcccgtacccggtccccccggttacggttaccccg

SEQ ID NO: 118148 - DNA, 536 bp, Homo sapiens
  misc_feature: GYAE6OF02GJM60.10.27.C05.1.454.CMB.1.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatgttgggcattataaccttgtctcctggtatcaacacgcccagacaagcccccanactcttgatttangaagtcagtaagcgccctnagggtttctagtcgcttctctgcctcaagtctggcaacacggcctcctgacaatctctggctcagctgacgacgagctgaatatactgcagctcatatgtagagtggtgtccttctttcgtaaggttttcgggacggtacgggaccgacggtcgtacgacccggtcctaacgtacacggtacccgaaggtccgtccgtcccccgtcggtacccg

SEQ ID NO: 118149 - DNA, 615 bp, Homo sapiens
  misc_feature: GYAE6OF02INKB0.10.27.C05.1.454.CMB.1.raw
  modified_base (322)..(322): a, c, t, g, unknown or other
  misc_feature (322)..(322): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtatcaacaacgccagacaaacgcccccacactcttgatttatgaagtcagtaagcggccctntagggtttctagtcgcttctctgcctcaagtctggcaaccgacggtcccttaccctgaacctaactccgtacgtcgggcctaccacgggctcggaaccggaacgaggtccgtaggaaacttacgttactagcacgtacctctaattactagttagtacgttgggttacgtcctttacttttacgtaacggggtttttcggacgggtacgggtaccgtacgggtcgtacggtaacccgttaccgtaacgtaccgacgacccgtaacgggcctccgtacccccgtcggttacccg

SEQ ID NO: 118150 - DNA, 596 bp, Homo sapiens
  misc_feature: GYAE6OF02HECZ1.10.27.C05.1.454.CMB.1.raw
  modified_base (386)..(386): a, c, t, g, unknown or other
  misc_feature (386)..(386): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatgttgggcattataaccttgtctcctggtatcaacaacgcccagacaaacgcccccacactcttgatttatgaagtcagtaaagcggccctcgagggtttctagtcgcttctctgcctccaagtctggcaacacggcctcctgacaatctntggctccaggctgacgacgaggctaggaattattactcgcagctacatatgtagatggtacgccttacgttttcgtaagggtttttcgggaccgggtacggggtaaccgacgggtccgttacggaaccccggttacccgttaaacggttacccgtaacgtaccccgtaacgggtaccttcccgggtcccccccgttacgggttacccccg

SEQ ID NO: 118151 - DNA, 720 bp, Homo sapiens
  misc_feature: GYAE6OF02H7X9T.10.27.C05.1.454.CMB.1.raw
tcagcatagtagtgcacgaccggtgctcgatttagacgcgatcgaaggggtttggggggggtctcaggaggcggccctctcgggacgtctccaccatggcctgggctctgctattcctcaccctcctcactcagggcacagggtcctgggcccagtctgccctgactcagcctgcctcgtgtctgggtctcctggacagtccatcaccatctcctgcactcggacccaccagttacatttggtaaataatgaatatgtcctctggtaaccaacagtacccaggacaaacgcccccaaactgactgtaatttatgattgtaccaagttaatccgacccctgtaggggttttctgtaactcgtcttttcgtttcgaccttaccaagtctggaccaaacgaccggtccctcccgtcgaaccctactcctcgtcgggtacctaccagtacgtggacggacggtaggtctagtaactttattaactgacgtacgcgtaccaaactacgtaaccgtaacggccggacgtacgggtacggggtttcggggtttacgggttcgggggacccggggggtaaccctaaacggttaccggtacggtaccccggttaccggttacgggttaccaacccggtacccggtaacggttcccgttaacccgccccccggttaccggttaccccgtacccggttccgttttaccccgttacccccgttaaccccccg

SEQ ID NO: 118152 - DNA, 562 bp, Homo sapiens
  misc_feature: GYAE6OF02GL4BJ.10.27.C05.1.454.CMB.1.raw
  modified_base (402)..(402): a, c, t, g, unknown or other
  misc_feature (402)..(402): n is a, c, g, or t
  modified_base (439)..(439): a, c, t, g, unknown or other
  misc_feature (439)..(439): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttagatttatgaagtcagtaagcgcctgagggtttcagtcgcttctctgcctcaagtctggcaacacgcctccgtgacaatctcgtcggctccgagctgacgacgnggctgaattattctgcagctacatatgtagatcggtnccttcgtttacgtaagggttttcggacgggtacgggacccgtaggtcgttacggtacccgtccgttaacgttccgaacggtccccgtaaagggtccctaccggtaccccccgttcggtacccg

SEQ ID NO: 118153 - DNA, 545 bp, Homo sapiens
  misc_feature: GYAE6OF02GRHJU.10.27.C05.1.454.CMB.1.raw
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(545): a, c, t, g, unknown or other
  misc_feature (538)..(545): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggtgtttctagtcgcttctctgcctccaagtctggcaacacggcctccctgacaatctctgggctccaggctgacgacgaggctgaatattactgcagctcatatgtagatggtgtccttctttcgtaagggttttcggacgggtaacggggaccgagggctcggacccggtctaacggtcgacggcccaacgggtccctcgccccccgttcggtcctaccgttcctccgttccccaccccttccctccctacctactactcgctcgacggtcggcgtcgcgacggccgacgacgtacgngntngnnnnnnnn

SEQ ID NO: 118154 - DNA, 598 bp, Homo sapiens
  misc_feature: GYAE6OF02HT07H.10.27.C05.1.454.CMB.1.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattataaccttgtctcctgtatacaacaacgcccagacaaacgccccanactcttgatttangaagtcagtaagcgccctcgtagggtttctagtcgtcttctctgcctacgaagtctggacaacaccggccctcctgactaactctacgtcggctccgaggctgacgacgaggctagtaatattactgcctagctacataacgttgtagagttggtacgtccttcgtttacgtaaagggttttcgggaccgggtacgggaccgtacgggtacgttaccggacccggttaccgtaaacgtcccgaaccggtacccgaaacgggtcccgtacccggtccccccggttaggttaaccccg

SEQ ID NO: 118155 - DNA, 638 bp, Homo sapiens
  misc_feature: GYAE6OF02GITEG.10.27.C05.1.454.CMB.1.raw
  modified_base (305)..(305): a, c, t, g, unknown or other
  misc_feature (305)..(305): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgcccccacactcttgatttangaagtcagtaagcggccctcgtaggggtttctagtcgtcttctctcgcctccaagtctggacaacgaccggtccctccctcgaactaacttcctcgtcgggcctccgaggtctggaccggacgaggtctgtaattacttactgactagccgactattacttaccgacggacccctaaaggtcggggttggtttcgggacgggtaccggggtaacgttaaacggggtcgtacccggttccggtaggggtacccacgggaaccccgaacgggtcccgtcccggtccccccggttcgggtaccctaccgttacccgttcccgggtttacccccccg

SEQ ID NO: 118156 - DNA, 595 bp, Homo sapiens
  misc_feature: GYAE6OF02GMZPX.10.27.C05.1.454.CMB.1.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
  modified_base (331)..(331): a, c, t, g, unknown or other
  misc_feature (331)..(331): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacngtcgtcaccatctcctgcactggaccagcactgatgtggctattataaccttgtctctgtatcaacacgccagacaaacgccccacactctgatttanagaagtcaagtacgcgtcctgtagggttctagtcncttctctcgtcctacgaagttcgtcggtacaacgtacgccctccctagtaacctaatccgtcgtcgggtccttccgacggtctacggaccgacggtacggctagtaaacttactacgtacgcctagtctactatagtagtagtacgttaggtcgttcttcgtttacggtacgggttttagggacggtacggaccgacggtcgtacgtacccgtaccgtaacgtccgaacgtaccgtaacggtcctcccggtccccgtggtaccc

SEQ ID NO: 118157 - DNA, 595 bp, Homo sapiens
  misc_feature: GYAE6OF02GU10X.10.27.C05.1.454.CMB.1.raw
  modified_base (227)..(227): a, c, t, g, unknown or other
  misc_feature (227)..(227): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccngcactgatgttgggcattataaccttgtctcctggtatcaacaacgcccagacaaacgcccccanactcttgatttangaagtcagtaagccggccctcgtaggggtttctagtcgcttctctgcctcaagttctggcaacgacggtccctcctgaccaatctctgggctcgaggctgacgacgaggctagaattattactgcagctacattatggtagtagttggtcgtccgttacgttttacgtaaagggtttttccgggacgggtacgggacccgtacgggtccgtacggtaccccgttaccgttaacgtccgtaacggccccggtaaaggtcccgtaccggtcccccccgttagggttaccccg

SEQ ID NO: 118158 - DNA, 554 bp, Homo sapiens
  misc_feature: GYAE6OF02F1WIO.10.27.C05.1.454.CMB.1.raw
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgatttatgaagtcagtaagcgccctgtagggtttctagtcgcttctctcgcctccaagtctggcaacacgcctcctgacatctctgggctccgaggctcgacgacgagctagaattatactgcagctnatatgtagngtcggtcgtccttcgtttcgtaagggttttccggacgggtacgggaccctagggtcctacggtaccccgttacgtaacgtccgacgcccgtaagggccctccggtcccccgtggtaccc

SEQ ID NO: 118159 - DNA, 628 bp, Homo sapiens
  misc_feature: GYAE6OF02HH34C.10.27.C05.1.454.CMB.1.raw
  modified_base (474)..(474): a, c, t, g, unknown or other
  misc_feature (474)..(474): n is a, c, g, or t
tcagcatagtagtgcacgaccggtgctcgatttagacgcgatcgaagggtttgggggggggtcacaagaggcagcgctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccacagttacattggtaataatgaatatgtctcctgtaccaacagtacccaggacaaacgcccccaaactgatgatttatgatgtcagtaatccgaccctcgtagggtttctgtactcgtcttcttcgcctacaacgttctggaccaaccgaccggtcccttcccgtagacctaacttccgtcgtcgggtccctccgagggctacggaccggacggacggtactagtaattattacgtgacgagtctanacttagtagtacgtagtggttacgtcctttccgtttacggtacgggttttcgggacgggtacgggaccgtaggtccgttacggtacccgttaccgtaacgttccgaccggacccgtaagggtccctcccggtcccccgttcggtcccttacccg

SEQ ID NO: 118160 - DNA, 608 bp, Homo sapiens
  misc_feature: GYAE6OF02IKZO8.10.27.C05.1.454.CMB.1.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcggtcaccatctcctgcactcggacccagcactgatgttggcattataaccttgtctcctgtatcaacaaccgccagacaacgccccacnctcttgtatttangagtcagtaacgcgtccctgtagggttctagtcgcttctctncctaccaagtctggaccaaccgaccgtcccttccctagaacctaacgttccgtaccgtcgggacctaccgacggtccgtaggaccggtaacggacgggtacctagtaaacttactttacgtcgtaccaggtactactaatagttagtaagtacgttggtcgtacctttacgtttacgtaacgggtttccggacggtacggacgacggtctacggaccgttacctaagtccgacgtcccgaaggtcctcccgtccccgtggtacc

SEQ ID NO: 118161 - DNA, 592 bp, Homo sapiens
  misc_feature: GYAE6OF02II790.10.27.C05.1.454.CMB.1.raw
  modified_base (270)..(270): a, c, t, g, unknown or other
  misc_feature (270)..(270): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (361)..(361): a, c, t, g, unknown or other
  misc_feature (361)..(361): n is a, c, g, or t
  modified_base (423)..(423): a, c, t, g, unknown or other
  misc_feature (423)..(423): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatgttggctattataacttgtctctgtatcaacacnccagacaaacgccccacactcttgtatttananagtacagtaacgcgccctcgtagggtttctagtcgtcttctctgcctcagtctgcacncgcctcctgactactctcgtggtcctcgaggctgaccgacggagtcgtagtaattatttacnggtaccagcctactaattagttgtaagtagttggtaccgttcctttacgttttacgttaacggggttttccgggacgggtacggtaccgtcgggtacgttaccgtaccggttaaccgttaagtccacggacccgtaacggttccctcccggtcccccgtcggttacccc

SEQ ID NO: 118162 - DNA, 574 bp, Homo sapiens
  misc_feature: GYAE6OF02IOA8L.10.27.C05.1.454.CMB.1.raw
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (437)..(437): a, c, t, g, unknown or other
  misc_feature (437)..(437): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgagttggtggctattactaaccttgtctcctggtatcaacaccgccanacaacgccccanctctgtattangaatcagtaagccgcctgtagggttctagtcgtcttctctcgtcctacgagtcgtgacacgacgtcctcctagactatctcgtcggtcagctcggacgcgagtctagaacttattacgtcgactacgtctanattagtgtagagttcggcgtcctttacgtttacggtacggtttcggcgggtacgggactacggtccgtaacggtacccgttacgaacgtccgtacggacccgaggtccctcccggtccccgttggtacctaacccgg

SEQ ID NO: 118163 - DNA, 667 bp, Homo sapiens
  misc_feature: GYAE6OF02IINCX.10.27.C05.1.454.CMB.1.raw
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
  modified_base (462)..(462): a, c, t, g, unknown or other
  misc_feature (462)..(462): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgactgtggcattactaccttgtctcctgtatcaacacgccagacaacgccccanactcttcgatttangaagtcagtacgccggcctcgtagggtttctagtcgtcttctcgtcgcctacagtcgtacggaccaacgaccgtcccttccgtacgtacaacgtttcgtccgtacgggtccctaccgacggtcgtacgaccggacggaggtctagtaacttaatttaccgtnacgtacgtacctactaagttacttagggtacgtagttacgggttccgttacccgtttacgttttaccggttaaacggggtttttccggggaaccggggttacgggacccggtacgggtccggtaccgtacccggtttacccgttaacggtacccgtaccggacccggtaaacgggtcctccccggtcccccggttacgtaccccg

SEQ ID NO: 118164 - DNA, 706 bp, Homo sapiens
  misc_feature: GYAE6OF02IJHFO.10.27.C05.1.454.CMB.1.raw
  modified_base (346)..(346): a, c, t, g, unknown or other
  misc_feature (346)..(346): n is a, c, g, or t
  modified_base (553)..(553): a, c, t, g, unknown or other
  misc_feature (553)..(553): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgccctcgtgtcgtggtctcgtgacagtcgtcacatcctctgcacgtcggacccagcacgtgagttggttgggctaatttaacttaacctttcgtccttccgttaggttactaccaaccaaccgacccaagaaaccaacccgacccccactaccttacttacgttaacttttaanacggtaagtcgtaaggtaacggtcccggtacccttacggttacggggttttactacggtcgttccttacttcgtcgtaccctaccgtaacgttcgtacggacctaaccgtccggtccccttacccgtacgtaacctaacttccgtacgtcgggtccctacccgaggtcgtacgacggaacggtacggtactagtaatttacgttacncgacncgtacnctatacgtagtacgtgtcggttctcctttgtttacgttaacgggtttcgggacgggtacgaccggtaggtccgttaccgtacccgttaccgtaacgtacgtaccgtaccgaccggtccgtcccgtccccggtacgttacccg

SEQ ID NO: 118165 - DNA, 584 bp, Homo sapiens
  misc_feature: GYAE6OF02GU92E.10.27.C05.1.454.CMB.1.raw
  modified_base (390)..(390): a, c, t, g, unknown or other
  misc_feature (390)..(390): n is a, c, g, or t
tcagcatagtagtgcacgaccggtgctcgatttagacgcgatcgaagggtttggtgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtgggcattataaccttgtctcctgtatcaacaacgcccagacaaacgcccccacactcttgatttatgaagtcagtaagcggccctcgtaggggtttctagtcgcttctctgcctccaagtctggcaacgacgcctcctgacatctctggctcnggctgacgacgacggctgaattattactgcagctcatatgtagagttggtacgtccttcgtttaccgtaagggtttttccgggacgggtacgggtaccgtacgggtccgttacgggtaacccggttacccgttaaaggtccgtaaccggtaccccgtaaacggggtcccttccgggacccccccgtttcccggg

SEQ ID NO: 118166 - DNA, 744 bp, Homo sapiens
  misc_feature: GYAE6OF02FKG2D.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctctggtaccagcaccaccaggcaaacgccccaaactccttgttttgagtcagtaacgcggcctcaggacgtccctgtacgtcggttctctcgtcctaccgtaagtccgttcggaccaaaccgaccgggtccccttcccgtacggtaccccgttcttccgttcggggtcccttacccggaacgggtcctagggacggtaacgtcgggacgggtcttaggtaactttaacgtaaccgtgtaccaggtaccgtactaagtttacttcccggaaccgggtccccaaacgggtaggggtttcggttacggggtccgggtacggggtaaccttaaagggtccggtaacccggttcccggtgggttaccgaccgggtacccggtaaacgggtcccttacccgggtccccccccggttaggggttacccctaacccggttttcccgttacccgggtttccccccggtcccccgtttaccccgtaccccttaacccgg

SEQ ID NO: 118167 - DNA, 633 bp, Homo sapiens
  misc_feature: GYAE6OF02HKPJU.10.27.C05.1.454.CMB.1.raw
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttggctattataaccttgtctctgtatacaacaaccgccagaacaaacgccccacactcttgtatttanagaatcagtaacgccgcctgtagggtttctagtcgtcttctctcncctacagtctgacaacgccgcctcctcgacctctcgtcggcctccgaggtctaggaggataggacggtcttagtaactttaacgtactgacagccgactaacttagttacccgaccggtaaccccaaaggtagggtttcggttcgggggaccggtaacgggtaacgttaacgggtcccggtaccggttccgggtacgggtacctaaccggaccccgtaacgggtccctcccgggtaccccccgtcggttaccctacccgtttccgtaccccgttaccccccg

SEQ ID NO: 118168 - DNA, 574 bp, Homo sapiens
  misc_feature: GYAE6OF02HIJS9.10.27.C05.1.454.CMB.1.raw
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (436)..(436): a, c, t, g, unknown or other
  misc_feature (436)..(436): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatgttggcattataaccttgtctcctggtatcaacaacgcccagacaaacgcccccanactcttgatttangaagtcagtaagccggccctcgtaggggtttctagtcgtcttctctgcctccaagtctggcaacaccggccctccctagacctaatcctcgtcgggcctccgaggctgacgacgaggctagaattattacngcagtctctatagtagtagagttggtctccttcgtttacgtaacggttttcgggacggtacgggaccagggtcgtacggtacccgttacgtaacgtccgacgtacccgaacggtcctcccggtcccccgtggtacccg

SEQ ID NO: 118169 - DNA, 555 bp, Homo sapiens
  misc_feature: GYAE6OF02GODCJ.10.27.C05.1.454.CMB.1.raw
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
  modified_base (435)..(435): a, c, t, g, unknown or other
  misc_feature (435)..(435): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtatcaacacgcccagacaacgccccacactcttgatttangaagtcagtaacgcggccctgtagggtttctagtcgcttctctcgcctcaagtctgcaacncgcctcctagacaatctcnggctccgaggctgacgacgagctagatatactgcagctcatatagtagagtggtntccttctttcgtaagggttttccggacgggtacgggaccgacgggtccgtacggtacccgtaccgttaagtaccgaccgtacccgtaacggtccctaccggtcccccgtaggttaccccg

SEQ ID NO: 118170 - DNA, 600 bp, Homo sapiens
  misc_feature: GYAE6OF02H959X.10.27.C05.1.454.CMB.1.raw
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattactaaccttgtctcctggtatcaacaacgcccaagacaaacgcccccaanacctcttgtactttangaatcagtaacgcggccctgtacgggttctagtcgtcttctctcgcctcaagtctggacacacgcctcccngactatctcgnggcctcagcngacgacgagctagaattattacngactagctactatagtagtagtagtcggtctacctttcgtttacgtaacgggttttccgggacgggtacgggtaccgtacgggcgttaccggtaacccggttccgttaaacgtccgaaccgggtaccccgaaacgggtcccgttaccccggtaccccccgttcggttaaccccg

SEQ ID NO: 118171 - DNA, 527 bp, Homo sapiens
  misc_feature: GYAE6OF02GGCZO.10.27.C05.1.454.CMB.1.raw
  modified_base (198)..(198): a, c, t, g, unknown or other
  misc_feature (198)..(198): n is a, c, g, or t
  modified_base (512)..(513): a, c, t, g, unknown or other
  misc_feature (512)..(513): n is a, c, g, or t
  modified_base (515)..(515): a, c, t, g, unknown or other
  misc_feature (515)..(515): n is a, c, g, or t
  modified_base (517)..(521): a, c, t, g, unknown or other
  misc_feature (517)..(521): n is a, c, g, or t
  modified_base (524)..(527): a, c, t, g, unknown or other
  misc_feature (524)..(527): n is a, c, g, or t
tcagcatagtagtgcacgaccggtgctcgatttagacgcgatcgaagggtcctgggccctgtctgccccgactcagcctgcctccgtgtctgggtctcctggacagtcggtcaccatctcctgcactggacccagcactgatgttgggcattataaccttgtctcctggtatcaacaacgcccagacaaagcccccanactcttgatttatgaagtcagtaagcggccctcaggggtttctagtcgcttctctgcctccaagtctggcaacacggcctccctgacaatctctggctccaggctgacgacgaggctgaatattactgcagctcatatgtagatggtgccttctttcaagggtttttcggcgggaggtaccgaggctcgacccgtccgtaagtcgacgacccaaggtcctacgccccccgtcggtcctacgtcttccgttccccgtccctccctcctacctactacgtcgctgcgccgggtctcggcgtaggcgtacgatagcnncngnnnnnaannnn

SEQ ID NO: 118172 - DNA, 566 bp, Homo sapiens
  misc_feature: GYAE6OF02GX2YI.10.27.C05.1.454.CMB.1.raw
  modified_base (432)..(432): a, c, t, g, unknown or other
  misc_feature (432)..(432): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgccccacactcttgatttatgaagtcagtaagccggccctcgtagggtttctagtcgcttctctgcctcagtctggcaacacgcctcctgacaatctctcggctcgaggctgacgacgagctagaatattactgcagctcatatgtagntggtcgtccttcgtttacgtaagggttttcggacgggtacgggtaccgtagggtccgttacggacccgttacccgtaaacgttccgaacggtaccccgtaaggtacccgtccggtaccccccgtcgggtacccc

SEQ ID NO: 118173 - DNA, 498 bp, Homo sapiens
  misc_feature: GYAE6OF02FZNWS.10.27.C05.1.454.CMB.1.raw
  modified_base (460)..(460): a, c, t, g, unknown or other
  misc_feature (460)..(460): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (490)..(498): a, c, t, g, unknown or other
  misc_feature (490)..(498): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatatactgcagctcatatgtagatggtgcctctttcgaaggtttttcgggcggtagggaccagggctagaccgtctaagtcagcccaaggctcgcccctcggtcactctcgttcccgcccttcctctactactatcgctagngcggctcggacaggcgcgagtgactnangnnnnnnnnn

SEQ ID NO: 118174 - DNA, 570 bp, Homo sapiens
  misc_feature: GYAE6OF02I7J48.10.27.C05.1.454.CMB.1.raw
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcgtggacagtcggtcaccatctcctgcactcggacccagcactgatgtggcattataaccttgtctctggtatcaacacgccagacaacgccccacactcttgatttatgaagtcagtaagcgccctgtagggtttctagtctcttctctcgctccagtctggcacaccggccctccctcgaacactctcgtggctccgngcngacgagnggctgaattattacngctagctacgatagtgtaagngttggtntcccgttcttttcgtaacgggttttcgggaccgggacgggaccgtacggcgttccggtaccggtaccgttaacgtaccgaccggtacccgaacgggtcctacccggtcccccgttcggtaaccccg

SEQ ID NO: 118175 - DNA, 640 bp, Homo sapiens
  misc_feature: GYAE6OF02JK1QE.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctctggacagtcggtcaccatctcctgcactcggacccagcactgattggttggctattactaaccttgtctcctgtatcaacacgccagacaacgccccactactcttgatttatgaagtcagtaacgcgtccctgtacgggtttctagtcgtcttctcgtcgtcctacaacgttcgtacgacaaccgccggtcccttaccgtacgaacctaactccgtacgtcggtacctccgaacggtcctacggaccgacggtaggtctaggtaaacttacgttactcgacctagtacgtctaattacgtaggttacgtaagttcgggttaccgtacctttcggtttacgttaacggggttcggacgggtaccgggtacggtacggtcggtacggtacccggttacgttaacgtactacggacccgtacggtccgtcccgtcccccggttagtacccg

SEQ ID NO: 118176 - DNA, 572 bp, Homo sapiens
  misc_feature: GYAE6OF02FGZUB.10.27.C05.1.454.CMB.1.raw
  modified_base (298)..(298): a, c, t, g, unknown or other
  misc_feature (298)..(298): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatgttgggcattataaccttgtctcctggtatcaacaacgcccagacaaagcccccacactcttnatttatgaatcagtaagcggcctcaggggtttcagtcgcttctctgcctccaagtctggcaacacggcctccctgacaatctctgggctcaggctgacgacgagctagaattatactgcagctcgatatgtagagtggtcgtccttcgtttagtaacgggttttccgggacgggtacgggaacccagggtcctcgggaaccccgttcccgttaaaggttccgaaccggtaccccgaaacgggtccctacccggtccccccgttcgggttacccc

SEQ ID NO: 118177 - DNA, 575 bp, Homo sapiens
  misc_feature: GYAE6OF02FT6EQ.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctgtatcaacaacgcccagacaaacgccccacactcttgatttatgaagtcaagtaagcggccctgtaggggtttctagtcgtcttctctcgcctcaagtctggcaacgacgcctccctgacatctcgtggctcaggctgacgacgaggctagaatatactgcagctacattagtgtagtagtggtctccgttcttttacgtaacgggtttttcgggacgggtacgggaccgtagggtccgttacggtacccggttaccgttaacgtaccgtacggacccgtaaacgggccttccggtccccccgttcggtaccccg

SEQ ID NO: 118178 - DNA, 661 bp, Homo sapiens
  misc_feature: GYAE6OF02HOCI6.10.27.C05.1.454.CMB.1.raw
  modified_base (305)..(305): a, c, t, g, unknown or other
  misc_feature (305)..(305): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatggttgggctattataaccttgtctcctggtatcaacacgccagacaaacgccccacactcttgatttangaatcagtaagcgccctgagggtttctagtcgtcttctctcgtcctcaagtctaggacaaccgaccggtcccttaccctagaacctaactccgttaccgtcgggtcctacccgacggtccgtacggacgacggacggcgtagtaacttacttacgtgacgacgtctacgtaattacgttaggtagtagttgggttccgttcctttacgttttaccggttaacggggtttttccgggacggggtacggggaccgtacggggtaccgttaccggtaacccggttaccgttaacggtacccgaaccggtaccccgtaacgggtcccgttaccccggtacccccggttccggtaaccccg

SEQ ID NO: 118179 - DNA, 785 bp, Homo sapiens
  misc_feature: GYAE6OF02GPI2W.10.27.C05.1.454.CMB.1.raw
  modified_base (263)..(263): a, c, t, g, unknown or other
  misc_feature (263)..(263): n is a, c, g, or t
tcagcatagtagtgcacgaccggtgctcgatttagacgcgatcgaagggtttgggggggtcgacgaagaggcagcgctctcgggacgtctccaccatgcctggctctgctgctcctcaccctcctcactcagacacaggtcctgggccctgtctcgccctgactccagcctgcctccgtgtctgggtcctcctggacaggtcggtcaccatcctcctgcactggacccagctactgatggttcgggactatttactaaccttntaccttctggtactacaaactaaccgcccaacgaacaaaccgcccccaactacttacgttcgtaacttttagtacggaacgtactaacggtaaacggtcccggtacccttcggtaacggggttttcttaaccgtccgtacctttcgtccttcggtacccctaccgtaaacggtttctcggggttaaccaaaccccggtaaccggtcccccttacccgttcccggaaaactaacgtttcctaccggttaccgggtccctttacccggaaccgtcgttaacggacccgtaaccggtacgggtacctaaggtaaacgttaactttaacgtcggaccaggttacctacctaattacgtaagttagtagttacgggtccgttaccgtttccttttaaacggttaacggggtttttccgggaaccgggtttagggaacccgtaacggggttccttaccgggaacccgtttaaccgtaacgtaccgaccggaccgtaacggacctccccggtccccgttacgttacccg

SEQ ID NO: 118180 - DNA, 587 bp, Homo sapiens
  misc_feature: GYAE6OF02G1GJX.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatggttgggcattactaaccttgtctcctggtatcaacaacgcccagacaacgcccccacactcttgatttatgaagtcagtaagccggccctcgtaggggtttctagtcgcttctctcgcctcaagtctggcacacgcctccctgacactctcgtgggcctccgaggctcgacgacgaggctagaattacttactgcagtctacattatagtagtacgttggtcgtcctttacgtttacggttaacgggttttccgggacgggtacgggtaccgacggtcgtaccggtacccgtaccgtaacgtccgacggtaccccgtaaggtcccgtcccgtccccccgtggtaccccg

SEQ ID NO: 118181 - DNA, 603 bp, Homo sapiens
  misc_feature: GYAE6OF02JUNPL.10.27.C05.1.454.CMB.1.raw
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (384)..(384): a, c, t, g, unknown or other
  misc_feature (384)..(384): n is a, c, g, or t
tcagcatagtagtgcacgaccggtgctcgatttagacgcgatcgaagggtttgggggggtcgacaagaggcagcgctctcgggacgtctccaccatggcctggctctgctgctcctcaccctcctcactcaggacacagggtcctgggccctgtctgccctgactcagcctgcctccgtgtctggtctctggacagtcgtcaccatctcctgcactcggacccagcactgagtgttggctattataccttgtctcgtgtatacaacacacccagacaacgccccacactctgtatttananacgtcagtacgccggacctcgtacgggtttcaggtctcttcgtctcgtcctacgaagttcgtacggcaacgccgtcctcccgngtacccgtctcgtcggtcctccgacgtcgtagagtagagtacgctgtacttacctagcgtaccacgcgtactattacgtccaacggacccaaggttgggttcgttcgggacggtaccggtacgttacggtccgtacggtccggttcgggaccgtcggtacccgtaaggtcccgtaccggtccccctggtaccctacccgttccgtacccgttacccccg

SEQ ID NO: 118182 - DNA, 690 bp, Homo sapiens
  misc_feature: GYAE6OF02JZ3A6.10.27.C05.1.454.CMB.1.raw
tcagcatagtagtgcacgaccggtgctcgatttagacgcgatcgaagggtttgggggggtcgacgaagaggcagcgctctcgggacgtctccaccatggcctgggctctgctgctcctcaccctcctcactcaggacacagggtcctgggccctgtctgccctgacctcagcctgcctccgtgtctgggtctcctggacagtcagtcaccatctcctacactggaaccagcagtcgtacttttgtgctttaataacttatgtctccgttggtaccacgccaccacccaggaccaaacgacccccaaacttcctttagttttagtacggtcaaggtaacgtccggtccctacgacggtacgtcccgtgtacgttcggttcttcgtcgtccctaccgagtcgtcggacaccgaccggtcccttaccgtcgacccgtctacgtcgggtcctcgagcctaggagatcgtaaggcctaggtacttaacgtctacgccgaggcactactttataccgacggacccctaaggttacggggttcgttccgggaacggaccgggtaccgttaaacgggtcgtacccgttccggtacgggtacggaaccccggtaccgtaaggtccccggtaacccggtccccgttaacgggttccctaaccggttcccgtttcccgtaccccccgtacccgtttacccg

SEQ ID NO: 118183 - DNA, 680 bp, Homo sapiens
  misc_feature: GYAE6OF02HC9MW.10.27.C05.1.454.CMB.1.raw
  modified_base (226)..(226): a, c, t, g, unknown or other
  misc_feature (226)..(226): n is a, c, g, or t
  modified_base (310)..(310): a, c, t, g, unknown or other
  misc_feature (310)..(310): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcggtcaccatctcctgcactggaaccngcagtgtactttgtgcttaataactatgtctcctggtaccagccaccacccgaggacaaacgcccccaaatgaactgtatttangtatgtacagttaactccgacccgttcgtaggggtttctaggacttcgtcttctttgcccttacctaagtcgtaggacctaacgaccggtccctacccgtacgtaccctattccgtccgttcgggaccttccgaaggtaccgttagggaacgggtaccggtagggtctaggttaacttttaacgttaccttggaccgtagtcccgttacaaccgtaagttacccgaaagggtcccggtacgtaacgggttcggggtttacgggtacgggttaccggggaccgggggtaccacggtacgtcggtacccgttacggtacggtaccgacggacccgtagggtcctcccggtacccccggtgttacccgtcccg

SEQ ID NO: 118184 - DNA, 578 bp, Homo sapiens
  misc_feature: GYAE6OF02IJB9F.10.27.C05.1.454.CMB.1.raw
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (419)..(419): a, c, t, g, unknown or other
  misc_feature (419)..(419): n is a, c, g, or t
tcagcatagtagtgcacgaccggtgctcgatttagacgcgatcgaaggggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctctggacagtcgtcaccatctcctgcactggacccagcactgatgtggcattataccttgtctctgtatcaacacgccagacaacnccccanctcttgtatttatgaagtcagtaagccgccctcgtagggtttctagtctcttctctgtcctcagtctgacaacgacgtccctcctagactactctcgtcggtcctccgaggctcgacgacgaggctagaattattacngacagtctacattataggtagtagttggtacgtcctttctttacggttaagggtttcgggacgggtacgggaccgtacgggtccttacggtacccgttaccgtaacgtcccgacggtacccgtaacgggtcctaccccgttcccccggtacggttaccc

SEQ ID NO: 118185 - DNA, 585 bp, Homo sapiens
  misc_feature: GYAE6OF02HKLFL.10.27.C05.1.454.CMB.1.raw
  modified_base (302)..(302): a, c, t, g, unknown or other
  misc_feature (302)..(302): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccactctcctgcactcggacccagcactgatgttgggcattataccttgtctctgtatcaacacgccagacaaacgccccacactcttgtatttanagaagtcaagtaacgccggccctcgtacggggtttctacggtcgtctttctctcgtcctccaagtctacggaccaacgaccgtccctcctgacatcctcgtgggcctcgaggtctcgacgacgaggtctagaattatactgcagtctactatatagtagtagtggtctcccttcgtttacgtacgggtttcggacgggtacggaccgtacggtccgtacggtacccgttaccgtaacgtccgaccgacccgtaacggtccgtcccgtcccccgtaggttaccc

SEQ ID NO: 118186 - DNA, 701 bp, Homo sapiens
  misc_feature: GYAE6OF02JGIN3.10.27.C05.1.454.CMB.1.raw
  modified_base (276)..(276): a, c, t, g, unknown or other
  misc_feature (276)..(276): n is a, c, g, or t
  modified_base (346)..(346): a, c, t, g, unknown or other
  misc_feature (346)..(346): n is a, c, g, or t
tcagcatagtagtgcacgaccggtgctcgatttagacgcgatcgaagggtttggggggggtcacaagaggcagcgctctcgggacgtctccaccataggcctgggctctgctgctcctcaccctcctcactcgagggcacagggtcctgggcccagtctgccctgactcagcctgcctccgtgtctgggtctcctggacagtccatcaccatcctcctgcactggaccccaccagttaccatttggtaataatgaatatgtctcctggtaccaacncgtacccaggcaaacgcccccaaactgatgatttatgatgtcagtaatccgaccctcgtaggggttttcngtactcgttcctttacgtttcgcccttacccgtaagttccgttcggaacctaaaccgaccggtcccccttaccccgttacgaacccctaacttccgttccggtaccgggaccccttaccgaacggtaccgttaggaccgggtaacggacgggtccttagtaacgttttaacgttaccgtcgtacgacgtccctacgactaagtaaccaagccgcgtacggttcgggtttcgggtcgggttccggggaccggggacccgtacgtacggtccggtaacccggttccggttaacggtccaccggacccgtagggtcccgtacccggtcccccggtccggttaccgtaccgttccccgg

SEQ ID NO: 118187 - DNA, 630 bp, Homo sapiens
  misc_feature: GYAE6OF02HWMHP.10.27.C05.1.454.CMB.1.raw
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (339)..(339): a, c, t, g, unknown or other
  misc_feature (339)..(339): n is a, c, g, or t
tcagcatagtagtgcacgaccggtgctcgatttagacgcgatcgaagggtttggggggggtcacaagaggcagtgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgctactcggacccagccacgtgattggttggctattataccttgtctctgtatcaacacgccagacaacgccccanactctagattanagatcagtacgcgcctgtagggttctagtctcttcnctcgcctacgaagtcgtacggactaacgaccgtacccttccgagtaacctaacgttcctcgtacgggtcctaccggtacggcgttcggaacgacggacggtactagtaaacgttattcgtagtacacgtctactagttagtaggtaatacgtggtccgtcttacgtttacggtaacgggtttcgggacggtaccgggactacggtcgtaccggttaaccggtcccttaaagtcctaacccgggtacccgaaacggttccccgtaccggtccccccggtttaggtaaccccg

SEQ ID NO: 118188 - DNA, 544 bp, Homo sapiens
  misc_feature: GYAE6OF02G5ETW.10.27.C05.1.454.CMB.1.raw
  modified_base (418)..(418): a, c, t, g, unknown or other
  misc_feature (418)..(418): n is a, c, g, or t
  modified_base (468)..(468): a, c, t, g, unknown or other
  misc_feature (468)..(468): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagccggccctgagggtttctagtcgcttctctgcctccaagtctggcaacacgcctcctgacaatctctggctccgaggctgacgacgaggctgaattattacngcagctcattatgtagagtggtcgcctttctttcgtaagggttttccggnggtacgggacctaggtctcggtacccgtcctaacgtcgacggtcccgaaggtcccgtcgtccccccgtggtacccg

SEQ ID NO: 118189 - DNA, 645 bp, Homo sapiens
  misc_feature: GYAE6OF02H5FHT.10.27.C05.1.454.CMB.1.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
  modified_base (395)..(395): a, c, t, g, unknown or other
  misc_feature (395)..(395): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctctcactcaggacacagggtcctgggccctgtctgccctgactcagcctgcctccgtgtctgggtctcctggacagtcggtcaccatctcctgcacgtcggaccagcactgattggtggcattatactgtctctgtatcaacacnccagacaacgccccanactcttgtattanagtagtcagtaacgccggccctagtagggtttctagtcgtcttctctcgcctcagtctggacacgaccgcctcctagactaactctcgtcggtcctcgngctggagtagtggacgtctagtacttacgtactcgactacggctcgtaattaccgttcccgaaccggtacccccgtaaaggtaggggtttcggttccgggaccggggtacccggggaacggttaacggggttaccgggttaacccggtcgggttaccggggtccgtaacccgggtacccgtaaccgggcccgttacccgggtacccccccggtttacgggtacccttacccgttcccggtttacccccgg

SEQ ID NO: 118190 - DNA, 570 bp, Homo sapiens
  misc_feature: GYAE6OF02IFAZZ.10.27.C05.1.454.CMB.1.raw
  modified_base (292)..(292): a, c, t, g, unknown or other
  misc_feature (292)..(292): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggctattataaccttgtctcctggtatcaacaacgcccagacaaacgcccccanacctcttgatttatgaagtcagtaacgccggtccctcgtaggggtttctagtcgcttctctgcctcaagtctgcaacaccgcctccctgacaactctcgtggcctccgaggctgacgacgacggctagaattattactgcagctcaatagtagtagtagttggtctccgttctttacggtaagggttttcgggacggtacgggaccgtaggtctaccggaccgttaccgtaacgtccgacgacccgtaacggtcccgtaccgtccccccgtggtaccc

SEQ ID NO: 118191 - DNA, 624 bp, Homo sapiens
  misc_feature: GYAE6OF02I9INV.10.27.C05.1.454.CMB.1.raw
  modified_base (286)..(286): a, c, t, g, unknown or other
  misc_feature (286)..(286): n is a, c, g, or t
  modified_base (436)..(436): a, c, t, g, unknown or other
  misc_feature (436)..(436): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctggtatcaacacgcccagacaaagccccanactcttagatttatgaagtcagtaacgcggccctcgtagggtttctagtcgctttctcttgccctccaagttcgtggacaacaccggctcccgtcgaccgtctcgtcggctccgaggctgaggatggacggctgtacttacgacttgacncggcacagttacttccgaacggccccaaacggtacgggttggtttcgggcgggtaccggggtaacgttaacgggttcggtaaccccggttccggttaacggggtcctaaccgggtccccgaacgggtacccgttccggacccccccgttcgggtaccctaacccgttcccgttcccgttaaccccccg

SEQ ID NO: 118192 - DNA, 714 bp, Homo sapiens
  misc_feature: GYAE6OF02I1A1Z.10.27.C05.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtggacagtcgtcaccatcctcctgcacgtcggacccagccactgattggtggactattactaaccttgtctccgtgtatcaacaccgccanacaacgcccanactctntattanagagtcagtaacgcgcctgtagggttctagtcgtcttctcgtcnccctactagtcgtcgtacaacgcccgtccccttccgtcgtacccgtcctacgtcggtacctcggacggtccgtaggacggtagtacgggacggtcgttacgttaattaacgttaccgtacgtaccgacgccgtacttaagttaccgtacccggtaacccggaccccgtaacgggttaacgggtttcggtttaccgggggaccgggtaccgggttaacggtaaccgggttaccggtacccgttacccggggtgggtaacccggtaccggtaacccccggtaacgggttcccggtacccggttcccccccggttacgggtaccccgtttacccgttccccggtttaccccgtttaaccccccccg

SEQ ID NO: 118193 - DNA, 601 bp, Homo sapiens
  misc_feature: GYAE6OF02ICCO9.10.27.C05.1.454.CMB.1.raw
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (465)..(465): a, c, t, g, unknown or other
  misc_feature (465)..(465): n is a, c, g, or t
tcagcatagtagtgcacgaccggtgctcgatttagacgcgatcgaagggtttggggggggtcgacaagaggcagcgctctcgggacgtctccaccatggcctgggctctgctgctcctcaccctcctcactcaggacacaggtcctgggccctgtctgccctgactcagcctgcctccgtgtctgggtctccgtggacagtcggtcaccatctcctgcacgtggacccagcactgatggttaggctattataaccttgtctcctgtatcaacaacgccagaacaaacgcccccanaccgtcttcgattttancgaatcagtaaagcgccctgagggtttctaggtcgtcttctctgccctacaagtctcggacaacacggtcctccctgacaagtctcgtgggtctaccgcgctagacgtacgacggctagaattattactgccgagcctcattagtagttaagngttaggtacgtcctttacgtttacggtaacgggtttcgggacgggtacgggtaccggtacggtacgtccggtacccgtacgttaacgaccgtacgtacccgaacggttcccgtacccggtcccccggttacggtcc

SEQ ID NO: 118194 - DNA, 558 bp, Homo sapiens
  misc_feature: GYAE6OF02G4C1G.10.27.C05.1.454.CMB.1.raw
  modified_base (419)..(419): a, c, t, g, unknown or other
  misc_feature (419)..(419): n is a, c, g, or t
  modified_base (444)..(444): a, c, t, g, unknown or other
  misc_feature (444)..(444): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctctggtatcaacacgcccagaccaagcccccacactcttgatttatgaagtcagtaagcggaccctgaggggtttctagtcgcttctctgcctccaagtctggcaacaccggcctccctgacaatctctgggctccaggctgacgcgaggctagaatattacngcagctacatatggtagtagtggtnaccgtttctttacgtaagggttttcggacgggtacgggacccgagggtccgtaggtaccccgttccttaacggtcaacgtcccgaaggtccctcgaccccccgttcgggtaccc

SEQ ID NO: 118195 - DNA, 565 bp, Homo sapiens
  misc_feature: GYAE6OF02H93OV.10.27.C05.1.454.CMB.1.raw
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (563)..(564): a, c, t, g, unknown or other
  misc_feature (563)..(564): n is a, c, g, or t
tcagcatagtagtgcacgaccggtgctcgatttagacgcgatcgaagggtcctgggccctgtctgccctgactcatcctgcctccgtgtctgggtctcctggacagtcagtcaccatctcctgcactggaaccagcagtgactttgttgcttataactatgtctcctggtaccagcaccaccaggcaaacgccccaaactccttgttttgaggtcagtaagcgcctcaggatccngatcggttntctgcctcaagtctggcacaccggcctcctcgaccgtctcgtcggctcccgagctggagatggagctagtattacncgtgcgngccgctatacttcgaacggtaccccaaggtgggttcgttcgggccgggtaggacgtaagggtcgtaccggtcgtgggtacgacgtaccgtaacggcgtaccgtccccgtgtcctaccgtcgtaccgtcccgtccctccgtactaccgtactcacgtcgaccggacgggtccggacgtcgggtaccgaagggtccgacgtacgtacgcncgtncgnancgctncncgcgngcacacnnc

SEQ ID NO: 118196 - DNA, 749 bp, Homo sapiens
  misc_feature: GYAE6OF02HHF36.10.27.C05.1.454.CMB.1.raw
  modified_base (269)..(269): a, c, t, g, unknown or other
  misc_feature (269)..(269): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
tcagcatagtagtgcacgaccggtgctcgatttagacgcgatcgaagggtttgggggggtcgacgaagaggcagcgctctcgggacgtctccaccatggcctgggctctgctgctcctcaccctcctcactcaggacacagggtcctgggcctgtctgccctgactcagcctgcctccgtgtctcgggtctccgtaggacaggttccggtcaccattcctcctgacacgtcggacccagccactgattggtggctaattaataaccttntctccttggtactcaacaacgcccaagaactaaacgaccccacacncgttanacgtttatgaactacagtaancggccctagtacggggttctaggtcgtccttcttcncgtcctacgtaacgtntacggactaactacggccctccggtaacacgtaacttcgtcgcgggtacctacgacgtccgttaggaccgaacggtaacggtaccgtagaaactttaacttacgtacggtactaacgacttacctagttaaagtaccggtttaaaggtaggttaccgggtacctttacccggtttaaccgttttacggttaaaccggggttttccgggaaccgggggttaccggtaaccgggtaacggtccgggttaacccggtttaaccccggttaaccggttaaacccgttaacccggaaccggtaaccccggtaaaccggtacccggttaccccggttaccccccgtacccgggttaccccg

SEQ ID NO: 118197 - DNA, 648 bp, Homo sapiens
  misc_feature: GYAE6OF02IZSU3.10.27.C05.1.454.CMB.1.raw
  modified_base (202)..(202): a, c, t, g, unknown or other
  misc_feature (202)..(202): n is a, c, g, or t
  modified_base (356)..(356): a, c, t, g, unknown or other
  misc_feature (356)..(356): n is a, c, g, or t
  modified_base (474)..(474): a, c, t, g, unknown or other
  misc_feature (474)..(474): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacgagggtcctgggccctgtctgccctgactcagcctgcctccgtgtcgtggtcctccgtcggacngtccggtcaccatctcctgcacgtcggacccagcactgagtgtggctattactacttgtctctggtatacaacaccgccagacaacgccccacactcttagtattagtgagtcgaagtacgccgtacctgtagggtttactacgtacgtccttntaccgtctccctacgtacgtcgtacggacgacgaccggtccctaccgagactacttcgtccgacggtcctcggacgctacggacggtacgtacggacgttaataacgttacgtttacncgacctagtacctatacgttaagtacgtaaggtacgtcggtacgttccttacgttttacggtaacgggttcgggaccgggacgtacggtacgttcgtaccgtacccggttaacctaacggtaccgtaccggtacccgtacggtcccgtaccccgtaccccggttcccgtaccgg

SEQ ID NO: 118198 - DNA, 654 bp, Homo sapiens
  misc_feature: GYAE6OF02HI70S.10.27.C05.1.454.CMB.1.raw
  modified_base (497)..(497): a, c, t, g, unknown or other
  misc_feature (497)..(497): n is a, c, g, or t
tcagcatagtagtgcacgaccggtgctcgatttagacgcgatcgaagggtttgggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccagcagtgtactttgttgactttaataactatctctctacggtaccagccaccaccgaggaccaaaccgccccctaaacttcctttagttttacggaggttcaaggtaacgccggcctcgacggtaccgtccctgtacgtcggtttctacgtcgccctaccgagtcctaggacctaaaccgcggtacccttcccgtacgacccgttcgtcggttcgggaccttccgacggtccgtaggacggtacgtggacgtctaggtacttactcgngtcaggcactagttactacgaccggaccctaggtacgggttcgttgggaccgggtaggtacgaaggtccgtaccgtcggtggtacgaccggtacgacggtcctcccgtacccgttcgtcgcccttccgttccggtaccccctaccgttcctaacccg

SEQ ID NO: 118199 - DNA, 906 bp, Homo sapiens
  misc_feature: GYAE6OF02ILFRA.10.27.C05.1.454.CMB.1.raw
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtcgtgggtctcctggacagtcggtcaccatctcctgcactggacccagcactgatgtggcattataacttgtctcctgtatcaanaaccgccaanacaaacgccccacactcttagatttangaagtcagtaacgcgtaccctgtacgggtttactagtccgtctttccgtctacgtaccctaccgtaaacgttcgttacggaccgtaaaccgtaacccgggtaccccgttaccccgttacgggtaaaacccttaaaacccgttccgttttaaccccggttaccggggggtaaccccgtttacccccgggtaaccggggtacccgtttaccggggaaaacccggttaaacccgggaacggggtaaacccgtttaagggtaaaacgtttaaacgttttaaaccggttacggtaaccgtaaaccgggtaccttaaccgttaacgtttaaaccgttacgggtttaaagggttaaacgggttacggggtttaccgggttaccccctttttaaacccgggttttttaacggttaaaaccggggggttttttttcccgggggaccggggggttaaccgggggtaaccccggttaccgggggttacccgttaaccggggtaaccccgtttaacccggggttaaaccgtaacccgggtaaacccgtaacccggttaaaaccgggtcccccggtttaaccccggttacccccccggtaccggtttaacccccgg

SEQ ID NO: 118200 - DNA, 677 bp, Homo sapiens
  misc_feature: GYAE6OF02F6MIP.10.27.C05.1.454.CMB.1.raw
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatgtgggctattactaaccttgtctcctgtatcaacacnccagacaacgccccanactctgtattatagaagcaagtacgcggccctcgtagggtttctaggtctcttcgtctcgccctaccgtaagttccgtacggtaccaaccgtaaccggtcccttacccgtacgaacctaacgtctacgtcgggtcctaccgacggcgtacggacggaccggacgtcgtagtaattacttacgtacgactacgtctacgtaacgttaagtagttaacgtagttcgggtacgttccgttacctttaacggttaaggggttttaccgggacggggtacgggaaccgtacggggtccggttaccggttaacccggttaccgttaacggtacccgtacccggtaacccgggtaaccggtccctcccgggtaccccccgttgggttaacccccg

SEQ ID NO: 118201 - DNA, 653 bp, Homo sapiens
  misc_feature: GYAE6OF02HNGZF.10.27.C05.1.454.CMB.1.raw
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttggctattataaccttgtctctgtatcaacacgccanacaacgccccanactctgtatttatgaagtcagtaacgcggaccctcgtaggggtttactaggtccgtcttctctcgcctaccaagttccgtaggaccaacgaccggtccctacccgtacgaacctaacgttccgtaccgttcgggacctttacccgagggtccctacggaaccggtacggaggtccgttagaaacttaacgtttaccgtcgaccaagtctactacgttagttacgtaagtacgttgggtacgttacccgtttacgtttacggttaacgggttttccgggacgggtacgggtaccgtggtaccgtacggtacccgtaccgtaacggtcacggtacccgaggtcccttacccggcccccgttggtaccc

SEQ ID NO: 118202 - DNA, 647 bp, Homo sapiens
  misc_feature: GYAE6OF02IWOMV.10.27.C05.1.454.CMB.1.raw
  modified_base (299)..(299): a, c, t, g, unknown or other
  misc_feature (299)..(299): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttggcattataaccttgtcctcctgtatcaacaacgcccagacaaacgccccacactcttnatttatgagtcagtaagcggccctgtacgggttctagtcgtcttctctcgtcctcaacgttcgtggactaaccgaccgccctccctacgacctaactcctcgtcgggctccgaggctcgacggacgaggtcgtagtaattacgttacgtctcgacgtacctacaattagttagtagagtttgggttacgttcctttacgtttacgttaacggggttttaccggggacgggtaccgggtaccgtacgggtccttaccgggtaaccccgttaccgtaaacggttccgtaacccggtaccccgtaacggggttaccccgtacccggttacccccccggttggttacccccg

SEQ ID NO: 118203 - DNA, 664 bp, Homo sapiens
  misc_feature: GYAE6OF02I2A3L.10.27.C05.1.454.CMB.1.raw
  modified_base (302)..(302): a, c, t, g, unknown or other
  misc_feature (302)..(302): n is a, c, g, or t
  modified_base (388)..(388): a, c, t, g, unknown or other
  misc_feature (388)..(388): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggcagtcggtcacatctcctgcactggaccagcactgatggtggcattataaccttgctctggtatcaaacaacgcccagaacaaacgcccccacactcttgtatttangaagtcaagtaacggccggacccctgtaggttgtttctagtcgtcttcgctcgcctacaagtctggacaacaccggcctcccgtanactaatcctctgggctccgaggctcgacgacgacggctagaaacttattactcgacgacgtactacgtaacttaacgttaggtaacgtagtttagggtcgttacctttaccgttttaaccgtttaacgggtttttaccgggaccggggtaacggggaaccccgtaaggggttacccgtaaccgggtaaccccggttacccgttaaacggttacccgtaaccgggtaccccggtaaaccgggtacccgttaccccgggtacccccccgttacccggg

SEQ ID NO: 118204 - DNA, 605 bp, Homo sapiens
  misc_feature: GYAE6OF02JEU19.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcacgtgatgttgggctattataacttgtctcctggtatcaacacgccagacaaacgccccacactcttgattagtgaagtcagtaagccggcctcgtaggggtttctagtcgtcttctctgcctccaagtcgtcggcaacgaccgtccctcctagacactcgtcgtacgggtcctaccgaggcctaggacggaccgtaggtcctaggtaaacttatttacgcgtcacgtctactaagtactggtaagtacgttgggtcctccgtttcgtttacgttaagggtttcggacgggtacgggtaccgacgggtctacggtaccggttaccctaacgtccgaacggccgtaacggtcctcccggtaccccgtcggtacccg

SEQ ID NO: 118205 - DNA, 828 bp, Homo sapiens
  misc_feature: GYAE6OF02IS7KE.10.27.C05.1.454.CMB.1.raw
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctccgtgacngtcggtcaccatctcctgcactggacccagcacngatggttgggctagttataaccttgtactcctggtatcaacaacgcccaagacaaacgcccccacactcttgtactttaatacgaagtacaaggtaacgaccggtccccttgtacggggttttctacggtcgtccttcgttcctcgtccctacctaaacgttccgttacgggacctaaaccgtccgggaccccttttaccccgtacggtaaaccctaaactttcccgttaaccgttcgggggtacccttaaccccgggtaacgggtaccggtttaccgggtaaacccgggaaccggggtaaccggggtacccggttaaagttaaacggtttaaaccttttaaaccggtacggtaccgaaccgggttaccttaccgtaaacgttaggttaacgttaacgggtaacgtttcgggtaaccggtttcccttttccgttttaaccgttaaacgggtttttccgggggaccggggtaacggggtttaaccccggagggtacccgtttaccggtaacccggtttaccgttaaaccggtacgtaacccggtcccgtaaaaccgggttccggtacccccgttacccccccggttaggttaccccgg

SEQ ID NO: 118206 - DNA, 629 bp, Homo sapiens
  misc_feature: GYAE6OF02IGJME.10.27.C05.1.454.CMB.1.raw
  modified_base (308)..(308): a, c, t, g, unknown or other
  misc_feature (308)..(308): n is a, c, g, or t
  modified_base (373)..(373): a, c, t, g, unknown or other
  misc_feature (373)..(373): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatggttgggctattactaaccttgtctctggtatcaacacgccagacaacgccccactactcttggtatttanagtaagtcagtaacgccggtcccagttacgggtttacaattcgctttctcgtgtcctacacgtcnggacacgacccgccttaccgctacctatccgtcgtcgggcccttcgacggtcgtacggacgggacggacggtcgttagtaactttattacgagccgagtctacgaatactaacgaccgagacgacgtacttaccgttctacggtttacgtaccgggtagggaaccggtaaccgacggtaccgtccgggtaacccgttccgttaacggttccgaccgtacccggtaacggtccctaccccgggtccccttacccggg

SEQ ID NO: 118207 - DNA, 716 bp, Homo sapiens
  misc_feature: GYAE6OF02GI7IE.10.27.C05.1.454.CMB.1.raw
  modified_base (177)..(177): a, c, t, g, unknown or other
  misc_feature (177)..(177): n is a, c, g, or t
  modified_base (547)..(547): a, c, t, g, unknown or other
  misc_feature (547)..(547): n is a, c, g, or t
  modified_base (554)..(554): a, c, t, g, unknown or other
  misc_feature (554)..(554): n is a, c, g, or t
tcagcatagtagtgcacgaccggtgctcgatttagacgcgatcgaagggtttgggggggccgacgaagaggcagcgctctcggacgtctccaccatggcctggctctgctgctcctcaccctcctcactcaggacacagggtcctggccctgtctgccctgactcagcctgcctcgntcgtggtctcctggcagtcggtcaccatctccgtgcacgtgacccagccactgactgttcgggatattactaaccgttgtaccttccttggtactacaaacctaaccgacccaacggtacaaaccgacccctaccaacctcttacgactttagtacgtaagtacgtaagtaacggaccggacccgttcgtacgggtttacgttacgttaccggtctttccgtacgttccgtcccgtacctaaacggttctaccggactaaccgacgtccctacccctagacctaacgttctcgtacggtccctcgaccggtctacgacggaacgtacggaccgtagtaaacttagtacgtttagaccgaacgtcgttaanacgttanagttacgtaaagtcggttacgtccgttcgttttaactaacgggtttccgtagggtaccgggtaaccgtacgggtactaacccgggttacggtaacccgttaaagttccggtaaacgtcccgtaaacccgggtctcccgggttaccccgtcccggttaacccg

SEQ ID NO: 118208 - DNA, 589 bp, Homo sapiens
  misc_feature: GYAE6OF02IJD0F.10.27.C05.1.454.CMB.1.raw
  modified_base (293)..(293): a, c, t, g, unknown or other
  misc_feature (293)..(293): n is a, c, g, or t
  modified_base (371)..(371): a, c, t, g, unknown or other
  misc_feature (371)..(371): n is a, c, g, or t
  modified_base (447)..(447): a, c, t, g, unknown or other
  misc_feature (447)..(447): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcggtcaccatctcctgcactcggaccagcactgatggttggcattataaccttgtctcctggtatacaactaccgccaagaccaacgcccccanacctcttgtactttatagaatcagtaacgcgtcctgtagggttctagtcgtcttctctcgcctcaagtctggacaacnccggtccctccgtagaactaactcctacgtgggccttaccgaggtctgacgacgacggctagtaagttacttacgngacagtctactagtagtagtagtagtgtcgcctttcgtttaggtacgggtttcgacgggtacggaccgtacgggtcgtccgtaaccggttcctaacgtacgtaccggaccgaacggttccgaccgtcccccgtaggtacccg

SEQ ID NO: 118209 - DNA, 782 bp, Homo sapiens
  misc_feature: GYAE6OF02FXY43.10.27.C05.1.454.CMB.1.raw
  modified_base (225)..(225): a, c, t, g, unknown or other
  misc_feature (225)..(225): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcacatctctgcactcggacccngccacgtgattggttcggactaattactaaccttgtcctccgtaggtactaccaactaaccgcccaagaaccaaaccgcccccacacttcttagtatttacgtagtaagtcgtaagtaacgccggtcccttcggtacgggttttctacgtccgtacctttcgtcgtcgtccctaccgtaacgtccgtcggtaccaaaccgtaccggtcccttacccgtagtaacctaagttcccgttcgtcgggtaccctaccggtaggtcctacggaaccggtacggtacggtacgtaagttaacttacgttaccgtcggaacctacgtaccgtaacctagttaagttaacgggtacgttacggttaccgggttaccgtttacccgttttaaccgttttaaccgggtttaacgggggttttacccgggacccggggttaacgggtacccggtaaccggtccggttaacccggtaacccggttaaccgttaaacggtacccgtaacccggtaccccggtaacgggtaccccgtaccccccgggttccccgttaccgggtaacccccg

SEQ ID NO: 118210 - DNA, 594 bp, Homo sapiens
  misc_feature: GYAE6OF02FJUY6.10.27.C05.1.454.CMB.1.raw
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
  modified_base (465)..(465): a, c, t, g, unknown or other
  misc_feature (465)..(465): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggttggcattataaccttgtctcctggtatcaacacgccagacaaacgccccacactctgatttangaagtcagtaagccggcctcgtagggtttctagtcgtcttctctcgcctcaagtctggcaacncgccctcctgactaatctcgtggcctcgaggtctacggaacgacgaggcctagtaaacttacttacgtgcgagtctacgtaatagtagtaagtatcggtnttccttattttacggtaaaggggttttccggacgggtaacgggaccttacgggtccttaacggacccggttaacctaaggtccaacggaccccggtaacggtcccttacccggacccccgttggtaccc

SEQ ID NO: 118211 - DNA, 569 bp, Homo sapiens
  misc_feature: GYAE6OF02F0JBT.10.27.C05.1.454.CMB.1.raw
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (460)..(460): a, c, t, g, unknown or other
  misc_feature (460)..(460): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcggtcaccatctcctgcactggacccagcactgatggttggctattataccttgtctctgtatcaacacnccanacaacgccccacactcttgtatttangaagtcagtaacgccgcctagtgggtttcagtcctcttctctcncctcagtcnggacaacgccgcctcctagactactctcgtcggctcgacggctggacgacggnggtctanaacgttacttcgnaacngctactattagtgtagagttggtctcctttnttaccggttaaggttccgggacgggtacggaaccgtcggtccgtaccggtacgttaccgtacgtaccgtacgaccggtaccggccttaccccggtcccctacgtacccg

SEQ ID NO: 118212 - DNA, 715 bp, Homo sapiens
  misc_feature: GYAE6OF02GSSJE.10.27.C05.1.454.CMB.1.raw
  modified_base (198)..(198): a, c, t, g, unknown or other
  misc_feature (198)..(198): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctccgtgacngtcgtcaccatctcctgcactggacccagcactgatggttggcattactaaccttgtcctcgtgtactacacaaccgccagaacaaccgccccactacctcttagtatttacgtagtaacgtacaaggtaacgccgtcccgtcgtaggttcgtttacgtacgttccgtctttcctcttcgtccctacgtaacgttcgtacggactaaaccgcccgggtcccttcccgtacgtaaccaacgtttccgtcggtaccgggcctttcccgaacgggtccttacggaaccggtacggttacgcgttaaccggtaaattacgttaaccgttcgaacctggtaccctagtaagttagtggtaaacgtgttcgggtttctaccgtttcgtttaacgggttaacgggttttcgggaccgggtaacggtacccgtagggtaccgttaccggtaaccccgttaccggtttaagacccggttaaccggacccgtaacggtcccggttacccgtaccccccgtttaccgg

SEQ ID NO: 118213 - DNA, 566 bp, Homo sapiens
  misc_feature: GYAE6OF02FJUEJ.10.27.C05.1.454.CMB.1.raw
  modified_base (314)..(314): a, c, t, g, unknown or other
  misc_feature (314)..(314): n is a, c, g, or t
  modified_base (349)..(349): a, c, t, g, unknown or other
  misc_feature (349)..(349): n is a, c, g, or t
  modified_base (384)..(384): a, c, t, g, unknown or other
  misc_feature (384)..(384): n is a, c, g, or t
  modified_base (416)..(416): a, c, t, g, unknown or other
  misc_feature (416)..(416): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaaccagcagtgactttgtgcttataactatgtctctgtaccagcaccaccagacaacgccccaactccttgttttgaggtcagagcgcctnagctcctgatcgttctctcgcctcagtctgcaacncgcctcctgaccgtctcgtggctccgagctgaggntggacggtctagtacttactactgcgagccgntatacttcgacgacccagtacggggttgttacgggcggtacgggacttaacgggcgtacccggtcgtcgggtaccacggtaccccgaacggtcccgtccggacccccgttcggtcctaccgttccgtcccgttacccctccccgttcccg

SEQ ID NO: 118214 - DNA, 654 bp, Homo sapiens
  misc_feature: GYAE6OF02IKMUN.10.27.C05.1.454.CMB.1.raw
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
  modified_base (341)..(341): a, c, t, g, unknown or other
  misc_feature (341)..(341): n is a, c, g, or t
  modified_base (451)..(451): a, c, t, g, unknown or other
  misc_feature (451)..(451): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatcctcctgcactcggacccagcactgatggttggctaattataaccttgtctctgtatcaacaacnccagaacaaacgccccacnctcttgtatttangaatcagtaacgccgcctgtagggttctagtcncttctctcgtcctaccaagtctggtacaacgaccgtcccttaccctagaactacttcgccgtggtccctcgagtctgaacgacgtaggtctacgtaaacttactttacgngtaccgtacgtctaacgtattaacgttggttaagtacggttacgggtcttaaccgttttcgttttaacggtaaccggggttttaccgggaccggggtacggtaacccggtacggtaccggttaaccggtacccgttaacccgttaacgtacccgaaccggaccccgtaacggtcccgtacccgtccccccggttacggtaccc

SEQ ID NO: 118215 - DNA, 686 bp, Homo sapiens
  misc_feature: GYAE6OF02I7WWH.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcagtcacatctctgcacgtggaaccagcagtgtacttttgtcgcttaataactatcgtctcctggtaccagcaccaccaggaccaaacgcccctaaacttcctttgttttcgaggtcaagtaacgccggcctacgacggacgtcctagacttcggttctcgtcgcctcaagtcgtggacaacgccgtcctccctacgaccgttctcggtcggcctaccgacggtcgtaggacggtagtacggacggtcgttacgtaactttaaccgttacgtcggacgtacggccgtagtaacttacgttaccgaacccggtaccccgtaaacggttcgggggtttacggttttacggggaccggggttaccgggtaacgttaaacggggtccgtacccggttaccggtcgggtaccgaaccggtcccgaacgggttcccgtacccggtccccggttcggtacccgtaccgttccgttcccggttacccctaccccg

SEQ ID NO: 118216 - DNA, 915 bp, Homo sapiens
  misc_feature: GYAE6OF02HHPTI.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcgaggacacgagggtcctcgggccctggtctacgccccgtaggacctcgaggccctcggcccgtccggtcggtcgtcggggtcctccgtggactacggtcgggtaccaaccgtagtcctccgtgacaccgtcgggacccaggcctacgtgagttcgggttcggactagttaacgttaaccgttcgtcctccgtaggtaactacaaaccgaccgacccgtaacgaacgaaaccggcccccaactaccgttcttaacggttaacgtttaacgtacggtaacgtcgtaacggttaaccgggccggtcccgttacgggttaaccggggtttacctaagggtccgttaccgttaccgttccgtacggtaccccgttacgtaaacgtttccggtacggtaaccaaacccggttaacccggtccccgtaacccgttacggaaaaccgtaacgtttcccggttacggtcccggggttaccctaccccgggtaacgggtacccgttaccggggaaacccggtaaacggggttccggtaaccgggttaacgtaaaaacgttaccgtttaaaccggttacggtaaccgaaccgtacctaaccgttaagtttaacggtaacgggttacgttaaggttacccgggtacgtttccgtttaaccgggtttaacgttaaccggggttttccgggaacggggtaccggggtaaccgtacgggtacgttaccggtacccgttaccggttaaccggtacgaccggtccggtaaccggtccgtcccgtccccggtagtaccccgg

SEQ ID NO: 118217 - DNA, 619 bp, Homo sapiens
  misc_feature: GYAE6OF02H8V3N.10.27.C05.1.454.CMB.1.raw
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (449)..(449): a, c, t, g, unknown or other
  misc_feature (449)..(449): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctctcactcaggacacagggtcctgggccctgtctgccctgactcagcctgcctccgtgtctggtctctgacagtcgtcaccatctcctgccactggacccagcactgatgttggactagttactaccttgtctcctgtatacaacaacgccagacaacnccccacactnttagtatttangaacgtcaagtacgccgcctgtagggtttcagtctcttctcgtcncctacacgtctcgcactcgtccttccgagacctagtccgtccggcctaccgaccgtcgtggacggacgcggtcctactagttacttacgtcgacacgtctanaactaccgtaaccgaaccggtacgggtaccctacgttccgtacgtagtacgttacgttcggggtaccggacgggtaccgtcggtacgttacccgtaccggttcccttaccggtaccgtaccggacccggtaaaccggtccgtaaccccggttcccccggtaggttccccg

SEQ ID NO: 118218 - DNA, 579 bp, Homo sapiens
  misc_feature: GYAE6OF02GF4DR.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtgggcattataaccttgtctcctggtatcaacaacgcccagacaaagcccccacactcttgatttatgaagtcagtaagcggccctcgaggggtttctagtcgcttctctgcctccaagtctggcaacacggcctccctgacaatctcgtggctccgagctgacgacgaggctagaattattacctgcacgctacattaactggtaagtagtgggttcgtccgttctttaccgttaagggttttccgggaccgggtagggacccgtagggtcttacggtacccgttaccgttaacgtcgtaaccggacccaagggtcctccgggtccccccgtcggtaccccg

SEQ ID NO: 118219 - DNA, 870 bp, Homo sapiens
  misc_feature: GYAE6OF02HPZ9N.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggcctgtctgccctgactcagcctgcctccgtgtctgggtctccgtggacagtccggtcaccatctcctgcacgtcgacccagcactgatggtggctattaactaccttgtccccctcgtgtactacaaccacgcccaagaacaaccgccccaactactcttacgtatttagtaggaacgtctaaggtaacgcccggtcccttaggtacggggtttacctacggttccgtcctttactcgtacgtccctaaccgtaacggttccgtacggaacctaaaccgtacccgggtccccttaccccggtaacgaaccttaaccgttaccgtttccggtaccgggggttacccttacccgggaacgggtaccgttaaccgggaaccgggtaaccgggtacgggtaccgttaacgggttaaacgtttaacgttttaaccggtacgtaaccgtacgttacccttaaccttaagtttaaccggttacgggttaaacggttagggttaccgggtttaccttaaccccgtttttacggtttttaaccgggttaaaccgggggttttttacccggggaccgggggtaacggggttaacccgtacgggggttaacccggttaacccgggtaaaccccggtttaaccggtttaaaccgggacccgtaacccgggtaaccccgtaaaccgggtttcccccgtaaccccggtttaccccccgggtccggttaaccccg

SEQ ID NO: 118220 - DNA, 645 bp, Homo sapiens
  misc_feature: GYAE6OF02JTT17.10.27.C05.1.454.CMB.1.raw
  modified_base (198)..(198): a, c, t, g, unknown or other
  misc_feature (198)..(198): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacngtcggtcaccatctcctgccactggacccagcactgatggtggcattactaccttntctctgtatcaacacnccanaccaacgccccacactcttgacttatgagtcaagtagccgtccctgtacgggtttctacggtctcttactccgtcgtacctaccgtaagtcgtacggtacctaacgacccggtcccttccctacgactacttctcgtcggtcctacgcggtctagaaccggcggtacggtacgtacgtaagttactttacgtacgccgtacgtactaccgtaatttcggaaggttcgaaggttccggtacgttcccgtttaccgttacggttaaaccgggtttcgggaccggtacgggtacctcgggtaaccgttcggtacccggttacgtacgtactaccggacccggtagtcccggtccgttcccccggtacttacccg

SEQ ID NO: 118221 - DNA, 712 bp, Homo sapiens
  misc_feature: GYAE6OF02GLE5C.10.27.C05.1.454.CMB.1.raw
  modified_base (195)..(195): a, c, t, g, unknown or other
  misc_feature (195)..(195): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctctgacngtcgtcaccatctcctgcactcggacccagccacgtgagttggttgggactattactaaccttgtcctccgtggtatacaacaaccgcccagaaccaaccgcccccactactcttgatttanagaatnaagtacgccggccctgagttgttcgtagtccgtcttctccgtcgccctacgtaagttccgtaggacctaaccgccggtccccttccgtacgaacctaacgttccgtacgtcgggtcctacccgaggtccgtacggacgtaacggacggtcttaagtaacgttacttacgtacgacgacgtcctaactagttaacgttacgggtagtacggttcggttccgttacccgttttacgttttaccgggttacggggtttaccggggtaccggggtaccgggtaccggtacgggttacccgttaccggttaacccccgttaacggttaccggtaccgtaacccggtacccggttaaccggtccccggttaccccggtacccccgttaccccggg

SEQ ID NO: 118222 - DNA, 747 bp, Homo sapiens
  misc_feature: GYAE6OF02G5O3B.10.27.C05.1.454.CMB.1.raw
  modified_base (320)..(320): a, c, t, g, unknown or other
  misc_feature (320)..(320): n is a, c, g, or t
tcagcatagtagtgcacgaccggtgctcgatttagacgcgatcgaagggtttgggggggtcacaagaggcagcgctctcgggacgtctccaccatggcctgggctctgctattcctcaccctctcactcagggcacgagggtcctgggcccagtctgccctgactcagcctgcctcgtgtctggtctcctggacagtccatcaccatctctgcactcggaccccactagttacagttggtaactaatagaattactgttcctccgtacggtaccaaacgtacgtacccgagaccaaacgacccccaaatgatgttattanagatgtacagtaacgtccgtaccgtcggttagggtttccagtacgttcgtctttcgttacgccttaccgtaagttcggtacgacctaccggaccgtcccttacccgtactaccgtactttccggtccgtaggtacccctacgtacgtaccgtaggacggaaccgtacgggtacgtacgttaagttttacgttaacggttacgacgtacgtacgttaccgaactaacgtaaccgaacgtccgggaacgttaccgggttaccgggtttacggggttccgggtttaccgggaaccgggggttaaccctacccggttaaccgtaccgggtacccggttaacccggtacggtaccgtacccggtaccggttaaccgtccgggtaccccgtcccggttacccggttaccgtccccgttaccgttaccccccgg

SEQ ID NO: 118223 - DNA, 729 bp, Homo sapiens
  misc_feature: GYAE6OF02HVS0P.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatggtggctattatacttgtctctgtatacaacacgcccagacaacgccccacactcttgtatttatgaagtcagtaacgccggtccctgtagggtttctagtcgtcctttctctcgtccctaccgtaagttcgtacggaccaaaccgtaccggtccccttcccgtacggtaacctaaacgttccttaccggtccgggtcccttacccggaacgggtccttacgggaaccggtaaccgggacgggtaccgttaaggtaaacttaacgttttaccgtacggaccgtaacgtccttacctaagtttacgttaggttaagtacgttcgggttccgttacccgttttcggttttaaccggttaacggggtttttccggggaccggggtacgggtacccggtacgggtccgttaccggtaacccggttaccgttaacggtacccgaaccggtacccggtaaccggtcccgttaccccggtcccccggttaccggttacccg

SEQ ID NO: 118224 - DNA, 593 bp, Homo sapiens
  misc_feature: GYAE6OF02FP60X.10.27.C05.1.454.CMB.1.raw
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (583)..(584): a, c, t, g, unknown or other
  misc_feature (583)..(584): n is a, c, g, or t
  modified_base (589)..(593): a, c, t, g, unknown or other
  misc_feature (589)..(593): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagccggccctcaggggtttctagtcgtcttctctcgcctccaagtctggcaacacggcctccctgacaatctctgggcctccaggctcgacgacggaggctagaattattactgcagtcctcatataggtagagtcgggtctcctttacgtttcgtaagggttttcgggacgggtacgggaccgacggtccgtcggaacccgttaccgttaacgccgtacgacccgtaaacgggtccctacccggcccccgttccggttaccaccgttccttcccgttcccctaccccgtccctccctaaccgtaccttagtcgtcgtcgaggccgggtcgtaggccgacggccgacgtagtgacnacgngnngctgnnnnn

SEQ ID NO: 118225 - DNA, 630 bp, Homo sapiens
  misc_feature: GYAE6OF02IQ6S4.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgccagaacaaacgccccacactcttgatttatgaagtcagtaagcgcctcgtagggttctagcgtctctctgctccaagtctggacaacaccgtcctcctgacaattcctcgtcgggctacccgaggtccttagacgaacggtaggacttagaaacttattaacgtgacagtctacaatactagtaacgagttcggtctaccgttccgttttacaaacggggttttttcggaccggggacggggtaacccgtacgggtacctacgggtaaccccggttaccgttaaaacgttccgaaccggttaaccccgggtaaacggtcccggttcccggtaacccccccggttcgggttaacccc

SEQ ID NO: 118226 - DNA, 648 bp, Homo sapiens
  misc_feature: GYAE6OF02G9F6B.10.27.C05.1.454.CMB.1.raw
  modified_base (216)..(216): a, c, t, g, unknown or other
  misc_feature (216)..(216): n is a, c, g, or t
  modified_base (320)..(320): a, c, t, g, unknown or other
  misc_feature (320)..(320): n is a, c, g, or t
tcagcatagtagtgcacgaccggtgctcgatttagacgcgatcgaaggggtttggggggggtcacaagaggcagcgctcgtcgggacgtctccaccatggcctgggctctgctgctcctcaccctcctcactcaggacacagggtcctgggccctgtctgccctgactcagcctgcctccgtgtctggtctctggacagtcgcacatctccgggtncacgtcggacccagcactgattggttggactattaactaaccttgtctcctggtatacaaacaaccgcccaagaaccaaacgcccccactactcttgtatttangaagtcgagtaaggccgcctgtagggtttctagtctctttctctcgcctccgtaagttctcggaccaacgtcccggtcccttcccgagtaacctaacgttccgtacgtcgggtcctaccgacggtcgtacggacgtacgacggtcgtacgtaattacttactggcaacgtctacgtattacgtgtaagtgttcggtcgttcctttaccgtttacggttaacgggttttacgggaccgggtacgggaccgtaggttccgtaacgtacccggtaactacggtaccgacgtacccggaacggtccctacccggtccccgttccggtacccg

SEQ ID NO: 118227 - DNA, 592 bp, Homo sapiens
  misc_feature: GYAE6OF02IX4SP.10.27.C05.1.454.CMB.1.raw
  modified_base (356)..(356): a, c, t, g, unknown or other
  misc_feature (356)..(356): n is a, c, g, or t
  modified_base (463)..(463): a, c, t, g, unknown or other
  misc_feature (463)..(463): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (510)..(510): a, c, t, g, unknown or other
  misc_feature (510)..(510): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcggtcaccatctcctgcactggacccagcactgattgttgggcattactaaccttgtctcctggtatacaacaaccgcccagaacaaacgccccacactcttgatttatgtaagtcaagtaacgcggaccctcgagggtttctaggtcgtgtttccnctcgcctacctaagtcgtggcaaacgccgccctcccgtagaacctatcctcgtcgggccttaccacggtctaggaccgacgaggctagaatattactgcaagtctanacgtatcgtaagngttgtnccgtttcttacgaagggtttcgacgggnggaccttgggaccttcggacccgttacgtaacgttacgaccggtaccgtaacggtccctacccgtccccggtacgtaccccg

SEQ ID NO: 118228 - DNA, 690 bp, Homo sapiens
  misc_feature: GYAE6OF02JY570.10.27.C05.1.454.CMB.1.raw
  modified_base (220)..(220): a, c, t, g, unknown or other
  misc_feature (220)..(220): n is a, c, g, or t
  modified_base (323)..(323): a, c, t, g, unknown or other
  misc_feature (323)..(323): n is a, c, g, or t
  modified_base (428)..(428): a, c, t, g, unknown or other
  misc_feature (428)..(428): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctctcactcaggacacagggtcctcgggccctgtctgccctgactcagcctgcctccgtgtcgtgggtctccgtggactagtccggtcacctatcctcngcacgtcggacccagcactgtagtggttggactattaactaaccttgtctctggtactacaacaccaccgagaaccaacgccccactacctcttagtatttanagtaagtcaagtaacgcgtccctacggtacggttctaggtcgtacctctctcgctacagtcgtcgacacgccgtcctcctagaacctatctcgtcggcctaccgngtcgcgtaacggagtacgctagtaattacgttacgtcgacgacgtactacgtaacttagttacgtagttacggtcgttaccggttaccctttacggttttaccggtttaaggggtttaccgggtaccggggtaaccgggttaacccggtaacggttaccggtttacgggtaaccccgttaaccggttaaccggttacccgaaccgggtacccggtaacggttccccgaaccccgggttcccccggttacggtttacccccgg

SEQ ID NO: 118229 - DNA, 689 bp, Homo sapiens
  misc_feature: GYAE6OF02FMXZY.10.27.C05.1.454.CMB.1.raw
  modified_base (307)..(307): a, c, t, g, unknown or other
  misc_feature (307)..(307): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatcctcctgcactggaccccagcactgattggttgggctattataaccttgtctcctgtatcaacacgcccagacaacgccccacactcttagatttangaagtcagtaagccgcctcgtagggtttctagtcgtcttctctcgtccctcaagttcctaggaccaaccgaccggtccccttacccgtacgaacctaactccgttccgtacgggtccctaccgtacgggtccttacggaccggtaacgggacggtacgtagtaaactttaacgttaccgtcgtaccacggtacctaccgtaattacgttaggttacggtagtttcgggttaccgttaccctttacgttttacggttaacgggtttttccgggacgggtacgggaccgtacgggtccgtacggtaacccggttaccgttaacgttaccgtaccggtaacccgtaaccgggtcccgtacccggtcccccgttacggttaccccg

SEQ ID NO: 118230 - DNA, 683 bp, Homo sapiens
  misc_feature: GYAE6OF02HRK78.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctctgcactggaccagcactgatgtggctattataaccttgtctcctggtatcaacacgccagaacaaacgccccaacactcttagtactttatacgaagtacgaacgtaacgccggtccctgtacggggtttctaggtctcgttactctcgtcctaccgaacgttctacggacctaacgaccggtacccttcccgtacgtaacctaaacttccttacggtccgggtaccctacccgtacggtccgttacggaaccggaacgggtacggtactagtaaactttacgttaacgtacgacacgtcctactaattagtacgtagtagtggttcgtacctttcgtttacgttaacggggttttaccgggacggggtacgggtaaccgtacgggtccgttaccggtaaccgttaaccgtaacggtccgtaaccggacccgtaaggtcccgtacccggtcccccgttacggttaacccg

SEQ ID NO: 118231 - DNA, 719 bp, Homo sapiens
  misc_feature: GYAE6OF02HKEWA.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtcgtgggtctcctggacagtcggtcaccatctcctgcacgtcggacccagcactgagttggttgggctaattacttaaccttcgttccttccgtggttactaccaaccaacccgtcccaacgaaccgaaaccgcccccaacacccttccttagtatttacgtagtaacgtacgaaggtaacggcccggtcccgttacggtacgggggttttccttaggtccgtctttcgtcgtcgccctactaacggtcgtacggacctaaccgccgcccctcctacgactaactccgtcgtcgggcctcgaggtccgtaggacggacggaggtctaagtaacttattacgcgtaccagtacctactaagttaacgttacggttagtacgtttcggttacggtaccccttttaacggttttcgggttaaaccggggttttcgggaccgggttacgggaccgtacgggtcgtaccggttacccgttaaccggtaacgtccgaccggacccgtaacgggtcccttacccgggtcccccgtacgttacccg

SEQ ID NO: 118232 - DNA, 629 bp, Homo sapiens
  misc_feature: GYAE6OF02JUMKP.10.27.C05.1.454.CMB.1.raw
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (413)..(413): a, c, t, g, unknown or other
  misc_feature (413)..(413): n is a, c, g, or t
  modified_base (446)..(446): a, c, t, g, unknown or other
  misc_feature (446)..(446): n is a, c, g, or t
  modified_base (475)..(475): a, c, t, g, unknown or other
  misc_feature (475)..(475): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacaccagggtcctgggccctgtctgccctgacctcagcctgcctcgtgtctgggtctcctggcagtcggtcacatctcctgccactcggacccagcactgatggtggcattaactaaccttgtctctgtactnaacacgccanacaaacnccccacacctctagtattatagatanaacgtacgacggccctacgtagggttctagtcgtcctctctcgtcctctaacgtctaggccaacacacctccctgtacaatctcgtacgtcttccgacggtcncggaagacgacggtctacgtaactatttaaccngtcaacgtctacgtattatacgtaacgtntccgggttgtaccctttcgtttaaccggttaagggtttaccggtccggggtaacggtacccggtacggtcggttaaccggtaccgttaaccgtacgttaaccgtaccggtacccgtaacccggacgttccccgacccccggtacggttaccccg

SEQ ID NO: 118233 - DNA, 735 bp, Homo sapiens
  misc_feature: GYAE6OF02GA1UE.10.27.C05.1.454.CMB.1.raw
  modified_base (727)..(727): a, c, t, g, unknown or other
  misc_feature (727)..(727): n is a, c, g, or t
  modified_base (730)..(730): a, c, t, g, unknown or other
  misc_feature (730)..(730): n is a, c, g, or t
  modified_base (733)..(734): a, c, t, g, unknown or other
  misc_feature (733)..(734): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatggttgggcattataaccttgtctcctggtatcaacaacgcccaagacaaacgccccacactcttgtatttatgaagttcagttaacggccggcccgtcgtacggggttttctacgttcgtctttctcctcgtcctacctaacgtcgtcggaccaaaccgaccggtccctccctgaacctaacttccgtccgtcggggtccctccgacgggtcgtacggaaccggtacgaggcttacgaaatttacttaacgtgacgtacgtcttactaattagtagtagacgtttcgggtctcccgtttcgtttaacgttaacggggttttccgggacgggtaccggtaaccgaggtccgttacggtacccgtaccgttaacggtccgaaccggtacccgaacgggttccgtacccggtcccccggttccggtccctacccgtttcccgttacccggttcccccgtaccccgtttcccttacccgtaccgtttacttacggtaccgtcgttaccggaccgggtccgggtacggttacgggaccgtaaccgggtcccgtaacgtacggtaaccggtcgtactcgcgcgcgtcgagngcncgnng

SEQ ID NO: 118234 - DNA, 591 bp, Homo sapiens
  misc_feature: GYAE6OF02IJNXK.10.27.C05.1.454.CMB.1.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
  modified_base (346)..(346): a, c, t, g, unknown or other
  misc_feature (346)..(346): n is a, c, g, or t
  modified_base (402)..(402): a, c, t, g, unknown or other
  misc_feature (402)..(402): n is a, c, g, or t
  modified_base (433)..(433): a, c, t, g, unknown or other
  misc_feature (433)..(433): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctggtctctgacngtcgtcaccatctcctgcactcggacccagctactgatgttggctattactaaccttgtctccgtggtactcaacaccgccagaacaaccgccccacactcttagtatttanagtaagtcagtaacgccgtcctcgtagggttctagtcncttctctgcctcagtctgacacgccgtcctccctagactactctcgtcggctccgngcgtagacgacgaggtctagtaattacttcngcacgtctactatagttagtagtacgtggtcttacctttcgtttacgttacgggttttacgggcgggtaggaccgtacgggtacctcggtacccgttaccgtacggttaccgaccggacccgtaccggtcccgtacccgtcccccgttcggtaccccg

SEQ ID NO: 118235 - DNA, 586 bp, Homo sapiens
  misc_feature: GYAE6OF02FU1VT.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacacgcccagacaacgccccacactcttgatttatagaagtcaagtaagccggccctcgagggtttctagtcgtcttctctcgcctctaacgtctaggcaacgaccggtccctccctagaccaacttctacgtcgggcctccgaggtcgtagaacgacgacggcgtagaaacgttattacgtgcacgtctacattactggtagtagtggtcgtccttcgttacgttaacggtttcgggacgggtacggtacgacggtcgtacggtaccgtaccgtaacgtacgaccgtaccgacggtcctccggtccccgtcgtaccc

SEQ ID NO: 118236 - DNA, 723 bp, Homo sapiens
  misc_feature: GYAE6OF02F7Z8C.10.27.C05.1.454.CMB.1.raw
  modified_base (231)..(231): a, c, t, g, unknown or other
  misc_feature (231)..(231): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgccctccgtgtctgggtctcctggacagtcggtcaccatcctcctgcactcggacccngcactgatggttgggactattaacttaaccttgtcctccgtagtactacaaccaaccgcccaacgaaccaaaccgacccccacctacctcttagtatttatagtaacgtacaagtaacgccggtcccgtacggtacgggtttcgtacgtcgtccttctcgtcgtccctaccgtaacgtcgtacgaccaaccgtaccggtccccttcccgtacgaacctaacttccgttcgtccgggtcctacccggtacggtaccgtcggaaccggaacggtacggtaccgtaacgtaacgtttaacgttacgtcgacgacgtcctactaattacgtagtacgtagtcggttcgttccttacgtttaccggttaaggggttttaccggacggggtaccggggtacgtaccggtccggttccggtaacccgttacccgtaacggttaccgacccgtacccggtaaccggtcccgtccccggtaccccgtacccggttaccccg

SEQ ID NO: 118237 - DNA, 632 bp, Homo sapiens
  misc_feature: GYAE6OF02FSPA2.10.27.C05.1.454.CMB.1.raw
  modified_base (199)..(199): a, c, t, g, unknown or other
  misc_feature (199)..(199): n is a, c, g, or t
  modified_base (619)..(619): a, c, t, g, unknown or other
  misc_feature (619)..(619): n is a, c, g, or t
  modified_base (623)..(623): a, c, t, g, unknown or other
  misc_feature (623)..(623): n is a, c, g, or t
  modified_base (626)..(626): a, c, t, g, unknown or other
  misc_feature (626)..(626): n is a, c, g, or t
  modified_base (628)..(629): a, c, t, g, unknown or other
  misc_feature (628)..(629): n is a, c, g, or t
  modified_base (631)..(632): a, c, t, g, unknown or other
  misc_feature (631)..(632): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaaacaacgcccagacaaagcccccanactcttgatttatgaagtcagtaagcggccctcaggggtttcagtcgcttctctgcctccaagtctggcaacacggcctccctgacaatctctgggctccaggctgacgacgaggctgtaatattactgacacgctacgattatagtaagatggtcgccttacctttactaaacgggtttttccgggacgggtacggggaaccctaggggtaccttaggtaacccggttacccgtaaagttccgaacggaccccaaagggtcccttaccggcccccccttaccggggttaccctacccgttaccgttccgtttacccccgaaccccctttaccctaccccgtaaccttaaccgtactacgtccgtaggtacggaccgggtcgttccgggacgtaacgggcgaccgagttaacgcgtacgntcangcnanncnn

SEQ ID NO: 118238 - DNA, 687 bp, Homo sapiens
  misc_feature: GYAE6OF02HE4GA.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctcgtgtcgtggtctctggacagtcggtcaccatctcctgctactcggacccagcactgatggtggcattactacttgtctcctgtatacaacacgccagaccaacgccccaatactcttgtatttatgaagtcagtaacgccgcctacgtagggtttctacgtctccttcgtctcgtacctccgtaacgtcgtcggacctaacggtcccggtccctaccctacgtaacctaacttccgtaccggtcgggtcctacccggtaacgggtccttacggaaccggtaacggtacggtacgtaagtaactttacgttacgtccgacgtacgtcttataacgtattacggttagacgttggttaccgttaccttttacgtttacggttaacgggtttccgggaccgggtagggtacccgtagggtccgttaccggtaacccgtttaaccgtaacgtaccggtaaccggtacccgggtaacggtccccttaccccgggtcccccgtttaaggtccccc

SEQ ID NO: 118239 - DNA, 721 bp, Homo sapiens
  misc_feature: GYAE6OF02I0VLO.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtcgtggtctcctggacaggtcgtcactatctcctagcacgtcggaacccagcacgtgagttggttacggctattaactaaccttcgtactccgtgtatacaacaaccgcccaagaccaaccgaccccaactacctcttagtaatttagaagtaagtacgaaggtacgaccggtcccgtacgttacggggtttactacggttacgtcgtttaccttcgtacgtaccccttactaaacgttctacgggaaccaaaacccgccggtacccctacccggtagaaccgtaacttcgtacgttcggtacctaccgtacggaccgtacggaaccggaacggaggttacctaaagtaaacgttaacgttacgtacgtaccaacgtactaacgtactttaaatcgtaaagtcggttggtaacttccgtttaacgtttaccgttaagggtttacgggaccgggtacggtacgacggtaccgtaccggtaaccgttaaccggtaacgttaccaccggtaccacggttccgcccgtacccgttaccgtacccg

SEQ ID NO: 118240 - DNA, 703 bp, Homo sapiens
  misc_feature: GYAE6OF02FKQBF.10.27.C05.1.454.CMB.1.raw
tcagcatagtagtgcacgaccggtgctcgatttagacgcgatcgaagggtttggggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatgttgggctattataaccttgtctcctggtatcaacaacgcccagacaaacgcccccacactcttgatttatgaagtcaagtaagccgccctcgaggggtttctaggtcgcttctctcgtcctccaagtctggaccaacgaccggtccctccctacggactaaacttccgtacgttcggggcccttccgacgggtcctacgggaccgaacggagggtcctaggtaaattaacgttactcggacctagcctactaacttagtacggttaacggtagttagggttcgtaccttttaccgtttttacggtttaaccggggtttttaccgggggtaccgggggtacggggtacccggtaacggggtcccgttaaccgggtaaccccggttacccgtttaacggtacccggtacggtaccccggtaaacggggtcccgttccccggtaccccccgggttcggttacccccg

SEQ ID NO: 118241 - DNA, 571 bp, Homo sapiens
  misc_feature: GYAE6OF02FGU0V.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatgttgggcattataaccttgtctcctggtatcaacaacgcccagacaaacgccccacactcttgatttatgaagtcagtaagcggccctcgaggggtttctagtcgcttctctcgcctccaagtctaggcaacacggccctccctgacaatctctcgggctcaggctgacgacgaggctgaatatactgcagtctcgacttagagtagagttggtgtccttctttacgtaacgggttttccggacgggtagggaccgacgggtctacggtaacccgttccgttaacggttccgtacggacccgaaacggtcctccggtacccccgtcggttacccg

SEQ ID NO: 118242 - DNA, 314 bp, Homo sapiens
  misc_feature: GYAE6OF02IXPHG.10.27.C05.1.454.CMB.1.raw
  modified_base (299)..(314): a, c, t, g, unknown or other
  misc_feature (299)..(314): n is a, c, g, or t
tcagcatagtagtgcacgaccggtgctcgatttagacgcgatcgaagggtttgggggtgtggtggtctccactcccgccttgacggggctgctatctgccttccaggctgacgacgaggctgaatattactgcagctcatatgtagatggtgccttctttctaaggttttcggcggaggaccaggctcgaccgtctaagtcacgcccaaggctcgccccctggtcactctcgttccccaccctcctacctactactagtcgcgtcgaggccgggtctggaccaaggtccgacgaatgannnnnnnnnnnnnnnn

SEQ ID NO: 118243 - DNA, 652 bp, Homo sapiens
  misc_feature: GYAE6OF02H7BGE.10.27.C05.1.454.CMB.1.raw
  modified_base (218)..(219): a, c, t, g, unknown or other
  misc_feature (218)..(219): n is a, c, g, or t
  modified_base (230)..(230): a, c, t, g, unknown or other
  misc_feature (230)..(230): n is a, c, g, or t
  modified_base (418)..(418): a, c, t, g, unknown or other
  misc_feature (418)..(418): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
  modified_base (520)..(520): a, c, t, g, unknown or other
  misc_feature (520)..(520): n is a, c, g, or t
  modified_base (613)..(613): a, c, t, g, unknown or other
  misc_feature (613)..(613): n is a, c, g, or t
tcagcatagtagtgcacgaccggtgctcgatttagacgcgatcgaaggggtttgggggggggtcacaagaggcagcgctctcgggacgtctccaccatggcctgggctctgctgctcctcaccctcctcactcgaggacactagggtcctgggccctgtcctcgccctgactcacgcctgcctcgtgtcgtggtctccgtgacagtcgcaccatctcnncacgtcgaccngctacgtgtagttggtcggactattactaccttgtcctcgtagtacaacaaccaaccgaccgagaaccaaccgacccctaaactactacgttgtttatttagacgtacgtaactaacggtaccgtccgtacccgtacgggttaacggttactaacgttcttccttcgtaccgtcgtctaccgtagtcncggaccacgtccgtcctacgtacnctactcgtcgcgtccngcgtgagacgacgtgtactagttaattacgtacncgacgtacnctaactactaaccgtaacncgacgctacttacttcgtacgttacggtacgggcggtaacggtaccgaacgtacgttacccggtaccgtacccgttaacgccgggttaaaccncccgggtaccggacccgtccggtacccccgtaccgttcg

SEQ ID NO: 118244 - DNA, 706 bp, Homo sapiens
  misc_feature: GYAE6OF02IIU12.10.27.C05.1.454.CMB.1.raw
  modified_base (311)..(311): a, c, t, g, unknown or other
  misc_feature (311)..(311): n is a, c, g, or t
tcagcatagtagtgcacgaccggtgctcgatttagacgcgatcgaaggggtttggggggggtcacaagaggcagcgctctcgggacgtctccaccatggcctgggctctgctgctcctcaccctcctcactcaggacacagggtcctgggccctgtctcgccctgactcagcctgcctcgtgtcgtgggtctcctggcaggtcgtcaccgatctcctgctacgtcggacccagcacgtgatggttggctagttactaccttgtctcctggtatacaactacgccagacaacgccccacactcttgtattangatgacggtagccgccgtgtacgggttctagtcgtacttctctcgaccctaacgtacgttcgtcggacctaaccgaccggtacccttacccggtacgacctaacgttcccgtacgtccggtacctccgtacgggtcgtacggaaccgaacgggtacggacgttacgtaaagttactttaccgtacgaccgtacgtacctacgttaacgtacgttaggtaaccggtaggtacggtaccgttccctttaccggtttaacggtaccggggttttccgggaaccgggttacgggtaaccgtacgggtccggtaccggttacccggttaccgtaaccggtaccgtacccggaaccggtaccggttcccggtacccggttcccccgttccggttaaccccg

SEQ ID NO: 118245 - DNA, 704 bp, Homo sapiens
  misc_feature: GYAE6OF02GMB8W.10.27.C05.1.454.CMB.1.raw
  modified_base (459)..(459): a, c, t, g, unknown or other
  misc_feature (459)..(459): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacaggtcggtcaccatcctcctgcacgtcggacccagcactgagttggttcgggctattactaaccttgtcctccgttggtactacaaccaaccgcccaagaaccaaaccgcccccaactactccttagtaatttagtagtaagtactaaggtaaccgcccggtcccgtacggtacggggtttcctacgttccggtactttcctacgtcgtcccgttaccaacgtttcgtcggaccctaaccgtacccggccctccccggtanacctaacgttccgtcgttcgggcctccggacggtcctaggaccgaggcgtactagtaattacgttactcgacctgtcctagtacgttagttacgtaagtacggttcggttcccgttccgttttaccgtttacggttaacgggtttcgggacgggtaccgggtaccgagggtctacccgggtacccgttaacgacggttacccgacggtcccgaaccggtcccgtcccggtaccccgtgtaccccg

SEQ ID NO: 118246 - DNA, 591 bp, Homo sapiens
  misc_feature: GYAE6OF02HO01X.10.27.C05.1.454.CMB.1.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctcgtgtctggtctcctggacngtcggtcaccatctcctgcactcggacccagccactgatggtggctattactaaccttgtctcgtgtatacaacaaccgccagacaacgccccanactctgtattangatcagtagccgtcctcgtagggttctagtctcttctctcgcctcgaacgtcgtggaccacaccggtccctccgtacgaactacttcctcgtcgggcctcgcggtctgaccggtagcgacgtagtaacttacttactgccaagtcctactatagtagtagtagtcggtctaccgtttagttacggttaacgggtttcgggaccgggtagggaccgtacggtccggtaccgtaccgtaccgttaagtccgaacgaccgtaccggtcctacccggtcccctcggtaccc

SEQ ID NO: 118247 - DNA, 534 bp, Homo sapiens
  misc_feature: GYAE6OF02GHLDA.10.27.C05.1.454.CMB.1.raw
  modified_base (366)..(366): a, c, t, g, unknown or other
  misc_feature (366)..(366): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgatttatgaagtcagtaagcggccctcgtagggtttctagtcgcttctctgcctcaagtctggcaacncgcctcctgacatctcgtggctccagctgacgacgagctagaatattactgcagctcatatgtagagttggtcgtccttcgtttacgtaagggttttcggacgggtacgggaccgaggtcgtcgtaccgtccgtaagtcacgccgaggcctccgtcccccgtgtaccc

SEQ ID NO: 118248 - DNA, 583 bp, Homo sapiens
  misc_feature: GYAE6OF02FG7YD.10.27.C05.1.454.CMB.1.raw
  modified_base (304)..(304): a, c, t, g, unknown or other
  misc_feature (304)..(304): n is a, c, g, or t
  modified_base (440)..(440): a, c, t, g, unknown or other
  misc_feature (440)..(440): n is a, c, g, or t
  modified_base (464)..(464): a, c, t, g, unknown or other
  misc_feature (464)..(464): n is a, c, g, or t
tcagcatagtagtgcacgaccggtgctcgatttagacgcgatcgaagggtttggggggggtcacaagaggcagcgctctcgggacgtctccaccatggccctgggctctgctgctcctcaccctcctcactcaggacacagggtcctgggccctgtctgccctgactcagcctgcctccgtgtctgggtctcctggacagtcggtcaccatctcctgcactggaccccagcactgatgttgggctattactaacctgtctctggtatcaacacgcccagacaacgccccacactctagtattangaagtcaggtaacgcgtcctcgtagggtttctagtcgcttctctcgcctacgaagtctaggccaacgccggtccctccctgactaactctcgtggcctacgagtcgtgaccgtacggagctagtaattactagtcncgacgtctactaattcgtagtagngttggtcgttccttcgtttacgtagggtttaccggaggtacggtaccgaggtccgtaccggtaccgttaccgttagtaccggacgcccgaaacgtccgtcccggtccccgtggtacccc

SEQ ID NO: 118249 - DNA, 623 bp, Homo sapiens
  misc_feature: GYAE6OF02HE569.10.27.C05.1.454.CMB.1.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (297)..(298): a, c, t, g, unknown or other
  misc_feature (297)..(298): n is a, c, g, or t
  modified_base (323)..(323): a, c, t, g, unknown or other
  misc_feature (323)..(323): n is a, c, g, or t
  modified_base (355)..(355): a, c, t, g, unknown or other
  misc_feature (355)..(355): n is a, c, g, or t
  modified_base (405)..(405): a, c, t, g, unknown or other
  misc_feature (405)..(405): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctcgccctgactcacgcctgccgtccgtcgtcgtgggtctccgtggacaggtcggcaccatctcctgcacgtcggaccagcacngatgtgcattatactntctctgancaacacgccagacaacncccanctctntattannacgtcaagacgcgcctgtacggttntagtcgtcttcgtctcgactacgtaacgtcgnggaacaactaccggtaccctcctagaactaatccgtcgtcggtactaccngggtacctggaacacgggtagacgtataaacttagttacagcaagtccactaaagttatagtttaacgagttaggttcgttaccgttacgtttaccggttaaaggggtttccgggagggaacgggtaccggacggtccttaaccggtacgttaaccgtaaccggttacaccggttaaccccgagggttaccctacccggttaccccgtcggttacccg

SEQ ID NO: 118250 - DNA, 646 bp, Homo sapiens
  misc_feature: GYAE6OF02FUNQO.10.27.C05.1.454.CMB.1.raw
  modified_base (260)..(260): a, c, t, g, unknown or other
  misc_feature (260)..(260): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcggtcaccatctcctgcactcggacccagcactgatgtggcattactactgtctctgtanacaacacgccagaacaaacgccccacactcgttagatttatagtaagtactaaggtaacggccggtcccttacgtagggtttctacgtccgtcttctctcgtcctacctaacgtcgtacggacgaacgacccgtccctccctacgaacctaacgtctccgtcggtctccgaggtccgtaggacgacggacggtctaagtaacttactacgtcgactacactactaagtactaggttacgtagttacggtccttaccgttaccgtttacggttaacgggtttccggggacggtacgggtacccgtacgggtctaaccggtacccgttaacgttaacgtaccgaccggtacccgtaacggtcccgtcccggtccccgttacggtaccc

SEQ ID NO: 118251 - DNA, 619 bp, Homo sapiens
  misc_feature: GYAE6OF02IBYKE.10.27.C05.1.454.CMB.1.raw
  modified_base (209)..(209): a, c, t, g, unknown or other
  misc_feature (209)..(209): n is a, c, g, or t
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
  modified_base (419)..(419): a, c, t, g, unknown or other
  misc_feature (419)..(419): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctcgccctgactcagcctgcctcgtgtctgggtctccgtggacagtcggcaccntctctgcacgtcgccagcacgtgattggtggctagttaacttaccgttntcctcgtagtactaccaacaacgcccaanaacaaccgacccccatacttacttagtatttagagtatcagacgccgcctgtaggttcngtctcttactctcgctacgagtcgtacgacaccgccgtaccctccgtanaactactcgtcgtcggtctaccgngacgtacggaaccgagaaccggtgtagtaacgttacttacgcgtacgacgctaactagttagtacggtagtacggtcgttccgttaccgtttcgtttacgggtacggtttcgggacggtaccgggaacgtcggtaacgtacggtaccgtaccgttaacgccgtaccgacccgtacggtcccgtcccgtccccgtagtccc

SEQ ID NO: 118252 - DNA, 702 bp, Homo sapiens
  misc_feature: GYAE6OF02FQFGY.10.27.C05.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctcgtgtctggtctccgtggacngtcggtcaccntctcctgcactcggacccagcactgatggttggctattactaaccttgtcctcgtgtactacaacaaccgcccaagaaccaaccgcccccactacttcgttatactttagtagaagtacgaagtacggccggtcccttcggtagggtttctagtccgtccttcgtcgtccgtccctaccgtaacggttccgtacggacctaaccgtaccgggtccccttcccgtacgtaaccctaacgttcccgttccggtccgggtacctacccggacggtccgttacggaccggacggacggtaccgtagttaaacgttacttacgtcggtaccacgtcctagtacttaggtagttagtacggttcggtaccttccgtttacgtttaccggttaacggggtttcgggaccgggttacgggaccgacggtccgttaccggtaccgttaccgtacgtaccgaccggtacccggacggtcccgtcccggtacccgtcggtaccc

SEQ ID NO: 118253 - DNA, 606 bp, Homo sapiens
  misc_feature: GYAE6OF02GBAPF.10.27.C05.1.454.CMB.1.raw
  modified_base (308)..(308): a, c, t, g, unknown or other
  misc_feature (308)..(308): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtcgtgggtctcctggacagtcggtcaccatctcctgcactcggacccagcactgatgtgggctattataccttagtctctgtactcaacaccgcccagacaacgcccccacacctcttcgatttangtaagtcagtaacgccggccctacgtagggtttctagtcgtcttctctcgctccgaagtcgtggacaacgaccgccctaccctcgacaactctcgtcggcctccgaggctaggacgaacggagcgtagtaacttattacgntaccgagtcctacagtagtaggtangttcggtacgtcctttacgttacgttagggtttccgggaggtaccgggtacgacggtcgtaccggtacccgttaccgtaacgttcccgacggtaccccggtaggtcctccccggtaccccgtcggttacccc

SEQ ID NO: 118254 - DNA, 721 bp, Homo sapiens
  misc_feature: GYAE6OF02IXOCW.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcgactagatggttgggctattactaaccttgtcctcctggttactacaacaaccgcccagaacaaacgccccacactctgtattatgaatcagtaacggcgtccctggtacgggtttactacgtcgtccttctctacgtcctacctaacggttctacggtaccaaacgcccggtaccccttcccgtacgtaacctaaacttccttcgtcgggtccctccgaacgggtcgtaacggtaccgaaccggacgggacctaggtaaacttaagttaacggttccgactacgtactacgttacgttacgttaggtacgtaacgttggtacccgtttccgtttaccgttttaaccggttaaggggttttccgggaccgggttacggtacccggtacggtacggttaaccggtaccccggttaaccggtttaacggtacccgtaaccggtacccggtaaccggtacccgtcccggttaccccccggttacggttaccccg

SEQ ID NO: 118255 - DNA, 644 bp, Homo sapiens
  misc_feature: GYAE6OF02I340P.10.27.C05.1.454.CMB.1.raw
  modified_base (206)..(206): a, c, t, g, unknown or other
  misc_feature (206)..(206): n is a, c, g, or t
  modified_base (329)..(329): a, c, t, g, unknown or other
  misc_feature (329)..(329): n is a, c, g, or t
  modified_base (628)..(628): a, c, t, g, unknown or other
  misc_feature (628)..(628): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacgagggtccgtgggcctgtctcgccctgactcagtcctcgccgtccgtgtcgtcgggtctccgtggacncgtcgtcacctatcctcctgccacgtcggaccagctacgtgtagtggttcgggctaatttacttaaccttgtctccgtgtactacaacaccgacccagaaccaaccgtaccccactactgttntattagtacgaagtacgagtaacggcgtacccgtaggttacgggttcgtacggtcgtacttcgtctcgtaccgtactagtcgtaggaccaaccgtaccgtcccgtccgtacaactactcgtcgtacggctaccggacgtccgacggaacggtacgacggtacgtagtaacgttaacttacgtcgtacacgtactcgtaatagtagtagtcggtacgttcgttacgtttacgttacggttacggttcggacggtacgacgtcgtcgtcctaccggtatacgtacaccggacgaccgtccncccgtccgtcgtaccg

SEQ ID NO: 118256 - DNA, 553 bp, Homo sapiens
  misc_feature: GYAE6OF02FS3CC.10.27.C05.1.454.CMB.1.raw
  modified_base (255)..(255): a, c, t, g, unknown or other
  misc_feature (255)..(255): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
  modified_base (543)..(543): a, c, t, g, unknown or other
  misc_feature (543)..(543): n is a, c, g, or t
  modified_base (550)..(550): a, c, t, g, unknown or other
  misc_feature (550)..(550): n is a, c, g, or t
tcagcatagtagtgcacgaccggtgctcgatttagacgcgatcgaagggtcctgggccctgtctgccctgactcagccctgcctccgtgtctgggtctcctggacagtcggtcaccatctcctgcactggacccagcactgatgttggcattataaccttgtctcctggtatcaacaacgcccagacaaacgcccccacactcttgatttatgaagtcagtaagccggccctcgaggggtttcagtcgcttctcngcctcaagtctggacaacacggcctcctgaacatctctcgggctccgaggctgaccgacgaggctagtaaattattactgacagctacatactaggtagagtcggtctcttcgtttacgtaaggttttcgggacggacgggaccaggtctacggacccgtacgtaagtcacgaccgagcgtccgcccctcggtctacgtcttcgtccctaccctccgtacctaactactgtcgtctacgcggccggtcgtacggacgaccgcgaccgagtgactnanncgtacgctancgatcgnacg

SEQ ID NO: 118257 - DNA, 875 bp, Homo sapiens
  misc_feature: GYAE6OF02JEU0A.10.27.C05.1.454.CMB.1.raw
  modified_base (202)..(202): a, c, t, g, unknown or other
  misc_feature (202)..(202): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgccctccgtgtcgtgggtcctccgtggacncggtcggtcacctatcctcctgccactccgggaccccagtccacgtgtacgttggtttcgggactaactttaacttaacctttgttccctccgttagggttacttaccaaaccaacccggaccccctaagaaaccgaaacccgcccccctaactaccttcctttaggtacttttagttacggaaacgttacgaaggtaacggtacccggtaccccgttacggttaaccggggtttccttaggttccgtccgtttctccgttcggtaccctaccgtaacgggtcgttacggtacctaaaccggcccggtaccccttacccgaccggtaaccctacgttccgtccggtacgggtcccttaccggtacggtcgttagggaaccggtacccggtaaggtccgtttaacggttagttttaaacttacgttacggtaccgtacggttaccctacgttaacgttaactaaacccgtaaccgtacgtaaccggacgttacgttaccctttaggttaacggtttaccgggttaccggggtaccgggtaaccggggtaacccgtaagggtacccgttaacccgggtaccccgtttaaccgggttaaccggtttacccggaaccgggttaccccgtaacccggggtccggttacccccccggtcccccgggttttaaccccggg

SEQ ID NO: 118258 - DNA, 704 bp, Homo sapiens
  misc_feature: GYAE6OF02IGBNJ.10.27.C05.1.454.CMB.1.raw
  modified_base (308)..(308): a, c, t, g, unknown or other
  misc_feature (308)..(308): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacaggtcctgggccctgtctgccctgactcagcctgcctccgtgtctgggtctccgtggacagtcggtcaccatcctcctgcacgtggacccagcactgatgttggctattataacttcgtctccgtgtatcaacaccgccaagacaacgccccactacttcttatatttanagagtacagtaacgccgcctcggtagggtttctaggtcgtacttcgtactcgacctacacgttctacggacctaaccgaccggtcccttccctagtaacctaacttccgttacgtcgggtaccctccgaacggtccgaggtaccggaacggtacggtacgtaagtaaactttaacgtttacgacgtaccgtatacctagttaacgttacgtacggttaaggacggtttcgggttaccgttccttttacggtttacggtttacggggttttaccgggaccgggttacgggaccgttacgggtaccttaacccggttacccggttaacgttaaccggtccgacccggtaacccggtaccggttacccgtcccggttaccccccgttaggttaccccgg

SEQ ID NO: 118259 - DNA, 691 bp, Homo sapiens
  misc_feature: GYAE6OF02IVC0B.10.27.C05.1.454.CMB.1.raw
  modified_base (332)..(332): a, c, t, g, unknown or other
  misc_feature (332)..(332): n is a, c, g, or t
tcagcatagtagtgcacgaccggtgctcgatttagacgcgatcgaagggtttgggggggggtcacaagaggcagcgctcgtcgggacgtctccaccatggcctgggctctgctgctcctcaccctctcactcaggacacgagggtcctgggcctgtctgccctgactcagcctcgcctcgtgtcgtggtctccgtggacagtcggtccacctatcctctgacacgtcggacccagcactgtattgggtcggactagttaactaaccttcgtctcgtaggtactacaacaacgccgaacgaaccaaccgccccaactactcttagttatttanagaacgtataacgtacgccgtccgtggtacgggttctacgtcgtcttctctgtcctctaagtcgtcgaccaacgccgtcctaccgtacgactaacgttccgtcggtcggtcccgtaccgtacggtccgtacggtaaccgggacgtacgggtactaaacgtaatttaacgtaccgtagaccgtacgttactaactaagttagttaacgtagtacgtcggttacctcccgttttaacgtttaacggttacggggtttaccgggaacggggacgtacgggtacggtcggttaaccgtaacccggtaacgttaacgtaccggaactaccggaaccggtcccgtcccgtacccgtcggtaaccc

SEQ ID NO: 118260 - DNA, 860 bp, Homo sapiens
  misc_feature: GYAE6OF02IMM7C.10.27.C05.1.454.CMB.1.raw
  modified_base (141)..(141): a, c, t, g, unknown or other
  misc_feature (141)..(141): n is a, c, g, or t
tcagcatagtagtgcacgaccggtgctcgatttagacgcgatcgaagggtttggggggggtccacaagaggcagcgctcgtcgggacgtctccaccatggcctgggctctgctgctcctcaccctcctcactcaggacacngggtcctgggccctgtctgccctgactcacgcctgtcctccgtgtacgttgggtcctaccgtggacaggtccggtacacccacttcctccttcgaccaccgttcggaccccagactaacgtggtacgttggttggggaccttaatttaacttaacctttcgtacttccgttaggttaacttaccaaaaccgtaaccgccccgtaagaaaccaaaacccgccccccaactaccttctttagttaactttaatacggtaacttacgaacggttaaccgtccgggtacccttggttaacggggttttactaggttccgtaccgttttacctccgttacgtaccccgttaccgtaaggttcgttaccgggaacctaaccggtaccgggttcccctacccgtacggtaaacctacgttccgtacggttcggtacccgtaccgtaaccggtacgttacgggaaccggtaaccgggtacgggtacgtaacgttaaacgtttaaacgttaaccgtgtaccgacggtacctataacgtttaaccgttaggtacgtaacgttcggttccgttacccttttcgggttttaaccgttaacggggttttacccgggagggtaccgggaccgttacgggtcgtacccggtaaccggttaaccgtaacggtacccgtaacccgggtaccgtaaccggtccccggtacccggttccccccgtacggttaaccccg

SEQ ID NO: 118261 - DNA, 834 bp, Homo sapiens
  misc_feature: GYAE6OF02JW9SI.10.27.C05.1.454.CMB.1.raw
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagctgcctcgtgtctgggtctcnggacngtcgtcaccatctctgcacgtcggacccagctacgtgattcggtggactattaactaaccgttcgttaccgtccgtggtactacgaacctaaccgaccccgtaggaaacctaaaccgacccccctaaccgtaccttaccgtttagttaacgttttaacgtacgtaacgttacgaacgggtaacggcccggttaacccctacgggttacggggttttaccgttacgttaccggttcctttcccgtttcgtccgtacccgttacccgtaacgttaccgttaccgggaccaaaccggtacccggtacccgttacccgtacggtaaccttaacgttccgtcggttaccgggaccctaccgtacggtccgtaacggacccggtacggtacgcggttaaggtaaccgttacgtttaccgggtaccgtaccgtaacgttccgttaacttaaggttacgggttacggttacggtaacgggtttcggttccgttaacccggtttacgtttacccggtttaacggggtttcgggtaaccggggaccggtacggtaccggtcggtttaccggtaccggtttaaccgtacgtacggaacccgggttcctaccggtaccccggtacccgttccccggttacggttaccccgg

SEQ ID NO: 118262 - DNA, 792 bp, Homo sapiens
  misc_feature: GYAE6OF02JDFUW.10.27.C05.1.454.CMB.1.raw
  modified_base (347)..(347): a, c, t, g, unknown or other
  misc_feature (347)..(347): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgacctcagcctgccctccgtgtcgtgggtctccgtggacacggtccggtacacccagttccttcctgcctacgtacggaccccagcacgtgtagtggttggactaattacttaaccttgtcctccgtggtactaccaacaaccgcccaagtaacaaaccgccccactactaccttagtaatttangtaagtcgtaagtaacgccggtaccctacgggtagggtttctacgtcgtcctttactcgtccgtcctaccgtacgttcgtcggaaccaaccgtacggccccttaccgtacgaaccttaccttaccgtcgttcgggtacccgttaccgaacgggttacgtaccggtaaaccgggtaccgggttaacgggtcctttaaacgggtaaacctttaacgtttaccgtaacgtaccgtaccggtacttaccgtaacgttaaggtacggtttaacgtaaagttccgggttaccgttaccgtttttaccgtttaaccgggttttaacggggttttcccggggaaccggggtacgggtaccggtacgggtcgtaccggttaccggtaaccgttacgtaccgtacggacccgtaccggttacccggtcccggtacccccggttagttacccccgg

SEQ ID NO: 118263 - DNA, 294 bp, Homo sapiens
  misc_feature: GYAE6OF02J160F.10.27.C05.1.454.CMB.1.raw
  modified_base (252)..(252): a, c, t, g, unknown or other
  misc_feature (252)..(252): n is a, c, g, or t
  modified_base (284)..(294): a, c, t, g, unknown or other
  misc_feature (284)..(294): n is a, c, g, or t
tcagcatagtagtgcacgaccggtgctcgatttagacgcgatcgaagggtttggggggtgtggtggtctccactcccgccttgacggggctgctatctgccttccaggctgacgacgaggctgaatattactgcagctcatatgtagatggtgcctctttcaaggttttcggcggaggccaggctgaccgtctaagtcagcccaaggctgccccctggtcactctcgttccccaccctcctccactaccgtntcgctgaggcggactggacaagggcgcatagnnnnnnnnnnn

SEQ ID NO: 118264 - DNA, 631 bp, Homo sapiens
  misc_feature: GYAE6OF02GLY31.10.27.C05.1.454.CMB.1.raw
  modified_base (466)..(466): a, c, t, g, unknown or other
  misc_feature (466)..(466): n is a, c, g, or t
tcagcatagtagtgcacgaccggtgctcgatttagacgcgatcgaagggtttggggggggtcacaagaggcagcgctctcgggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtcgcttaataactatgtctccgtaggtaccagccacccaccaggaccaaacgcccccaattcctttgtttgacgtcagtacgccggtccctgaggtctcctgacgttcggttctctcgccctacgaagttcgtggaccaaacgccggtcccttacccgtgtacccgtctcggtcggcctccgaggcgtacggaggtagtggacggtctagtacttactacgtcgacncgcgtactattacgtccaccgtaccctaggtgggttcgttacgggcgggtacggtaacgttacggcgtaccgtcggtcggccgaccgtaccgacggtcccgtccgtccccggttcgtcccgtaccgttccgttacccgttccccacccgttcccgaccttaaccg

SEQ ID NO: 118265 - DNA, 746 bp, Homo sapiens
  misc_feature: GYAE6OF02HJ7CZ.10.27.C05.1.454.CMB.1.raw
  modified_base (712)..(712): a, c, t, g, unknown or other
  misc_feature (712)..(712): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctctcactcaggacacgagggtcctgggccctgtctcgccctgactcacgcctcgcctccgtgtcgtggtcctcgtaggacagtcggcacactcctctcgcacgtcggaccagcagtgagttgtaggctattaactacttgtctcgtagtacactaaccacgaccaagaaccgaaccgaccccactacgttcttagttaatttagagtacgtacaacggtaacgcccgtaccttgggttaccggtttactacgtcgttcttactttcgacgtccctacgtaacgtcgtacgaccgtaacgaccgtcccttacgtacaacttacgttccacggtccgtcctacggtacgcgtaacggaccggtacgacgtaccgtaatacttacgttacgcgtacacttctacgtattagtacggtattacggtgggtttcccttacccgtttacggttttaaacgggttttccgggttaacggggacccggggtaacgtaccggggttaacggtacccggttaaccggggttacccggttaaccggtttaacccggaaccggtaccccggggttaaacccgacccgggggtttaacccccnccccgggttaccccggttttcccgtaacccccgg

SEQ ID NO: 118266 - DNA, 715 bp, Homo sapiens
  misc_feature: GYAE6OF02I5WGL.10.27.C05.1.454.CMB.1.raw
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacgagggtcctgggcccttgtctcgccctagactcagcctgcctcgtgtcgtggtctccgtggacagtcgtcaccntctcctgccacgtcggaccancactgattggttggacctagttacttaacttgtcctaccgtacggtactacgaaaccgtaccgacccgaagaacccaaaccgcccccaataaccttcgttagtactttagacgtaagtacgaacgtaacggccggtcccttacggttcgggtttacctacggtctccgtttactcttcgtacctcgtaagtcgtacggtactaaccgtccggtccctccgaacacttaacgtcgttacggacggtctacccggaggtctaacggacgtacggacgtcgtaagtaaactactttccggatacgcgtaccagttacgttaattacggttaacgtgtcggttccgttacgtttacggttttaacggtaccgggggtttcgaaccgggtaggttacccggaggttccgttaccggtaaccgttaccgtaaacgttccgaaacccgtaccgttacggtcccgttacccgtcccggtccgttaacccg

SEQ ID NO: 118267 - DNA, 748 bp, Homo sapiens
  misc_feature: GYAE6OF02JUF8A.10.27.C05.1.454.CMB.1.raw
  modified_base (201)..(201): a, c, t, g, unknown or other
  misc_feature (201)..(201): n is a, c, g, or t
  modified_base (574)..(574): a, c, t, g, unknown or other
  misc_feature (574)..(574): n is a, c, g, or t
tcagcatagtagtgcacgaccggtgctcgatttagacgcgatcgaaggggtttggggggggtcacaagaggcagcgctctcgggacgtctccaccatggcctgggctctgctgctcctcaccctctcactcacggacacagggtcctgggccctgtctcgccctgactcagcctgccctcgtgtcgtggtctccgtggacngtcggtcacagtctcctgcctacgtcggaaccctagcctactgacgttggtggactaagttaacgttaaccgttgtaccgtccgttaggtataccgaaacgtaccgaccgaacgaaccgaaaccgtcccccaactacgtaccgttaagttaactttaacgtacggtaaacgtacgtaaacggtaaacggtcccggtaacccgttacgggtacggggttttaccgtacggttccgttccgtttcctaaccgtcgtaaccctaccgtaacggttccgtacgggaccaaaccgtcccgtaccctccgtacgaactacgtcgtccggcggtacctccgaggtctacgacggtacgtgtacgtaatacgttacgtacncgacctagtcctactaagttacgtacttacggtacgttcggttacttccgtttaacgttacggtacggttacgggcgtacgtaccgtacggtaccgttaccggtaacgttaccgtacggttaccgaaccggttaccgtaaccggtcccgtaccgtacccccgttacgtaccccg

SEQ ID NO: 118268 - DNA, 669 bp, Homo sapiens
  misc_feature: GYAE6OF02HOZXG.10.27.C05.1.454.CMB.1.raw
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (653)..(653): a, c, t, g, unknown or other
  misc_feature (653)..(653): n is a, c, g, or t
  modified_base (657)..(657): a, c, t, g, unknown or other
  misc_feature (657)..(657): n is a, c, g, or t
  modified_base (660)..(660): a, c, t, g, unknown or other
  misc_feature (660)..(660): n is a, c, g, or t
  modified_base (663)..(669): a, c, t, g, unknown or other
  misc_feature (663)..(669): n is a, c, g, or t
tcagcatagtagtgcacgaccggtgctcgatttagacgcgatcgaagggtcctgggccctgtctgccctgactcagcctgcctccgtgtcgtgggtctccgtggacaggtcggtcaccactctcctgcactggacccagcactgatgttggcattataaccttgtctcctggtatcaacaacgccagacaaancccccanactctnatttangaagtcaagtaagcgcctgtaggggtttctagtccgcttctcttgcctaccagtctggactaacgaccgccctccgtacgaacaacgtcgtacgtcgggaccttccgacggtctacgaacggaaccgacgggtactaggtaaactaagttttacacggacgacgtacccttacgaattaacgtaggttaagaacggtttcggtcgtaccctttcgtttttaacgacggggtttttacgggaccggggttaacggaaccggacggtacgtaccggtaccgtaccgttaacgtaccgacgtacccgaaaggtcccgtacccggtccccgttcgggtaaccctaccgttacgttcccgttacccccgtacccttccctaccgtaaccttaaccgtcttcgccttggacgtcgggctacgacggtacggccgtactaaggtacgntcgnagngcnnnnnnn

SEQ ID NO: 118269 - DNA, 711 bp, Homo sapiens
  misc_feature: GYAE6OF02GISH0.10.27.C05.1.454.CMB.1.raw
  modified_base (493)..(493): a, c, t, g, unknown or other
  misc_feature (493)..(493): n is a, c, g, or t
  modified_base (533)..(533): a, c, t, g, unknown or other
  misc_feature (533)..(533): n is a, c, g, or t
tcagcatagtagtgcacgaccggtgctcgatttagacgcgatcgaaggggtttggggggggtcacaagaggcagcgctctcgggacgtctccaccatggcctgggctctgctgctcctcaccctcctcactcagggcacagggtcctgggcccagtctgccctgactcacgcctccctccgcgtccgggtctcctggacagtcagtcaccatctcctgcactcggaaccagcagtcgtacttttgtgtacttaataacttatcgttcctccgttacggtaaccagtaccaaccctaacccgaaggtaccaaaaccgacccccctttttttaaaacgcccttttaggtttttacgacggtacctaaggtaacgtcccgggtacccctagtaacgggtacgttccctaggtacgttccggttctcgtacgccctacaaggtctacggacaacgaccggtcctccgtagcctcgtcgcggcctacgagctagacgngtggacgtctagtacttactcgtcgacacgcgacattacncgaacgaccctaaggtggtttacgtcgggacgggtacggtaactaacgggtacgcccgttagtagggtacccgaacggtcccgtaaacggtccccgttaccggtaccccccggttaggttaacccgttcccgttcccggttaccccgtttcccccggtccccttacccctaaccccgg

SEQ ID NO: 118270 - DNA, 758 bp, Homo sapiens
  misc_feature: GYAE6OF02HQ5KH.10.27.C05.1.454.CMB.1.raw
  modified_base (333)..(333): a, c, t, g, unknown or other
  misc_feature (333)..(333): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacgagggtccgtcgggccctgtctcgccctgactcagcctcgccgtcgtgtcgtcgggtcctaccgtcggacagtccggtcaccattctctgcacgtcggaccagcactgagttggtggctaatttactaaccttgtctctaggtatacaaaccaccgccaagaaccaaccgccccaactactcgttataacttanagtacgtacaacggtacggccgacccttaggtacgggtttactacgtccggtctttcctcgtccgtccctaaccgtagttccgtacggaaccaacggtacccgtacccttcccgagtaacctaactttccgtacggtccgggtacctacccgggagtaccgtacggaccgaacggtcggtaacgtaaggtaaactttacgtttacgacgtacgtctaccctaagtaacttagttagtaaggtcgttcgggtacgtttaccccttttaacgttttaacgggttaaacgggtttccggggaacgggtaccggggtacccgtaaccgggtcgttacccgggaaacccgttaacccgttaacggtacccggtaaccggaacccggtaacggttccccggttaccccggtcccccggttaggttaccccg

SEQ ID NO: 118271 - DNA, 577 bp, Homo sapiens
  misc_feature: GYAE6OF02GYG7A.10.27.C05.1.454.CMB.1.raw
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccccagcactgatggttgggctattataaccttgtctcctggtatcaacaacgccccagacaaacgcccccacactcttgtatttatgaagtctagtaacgccggccctcaggttctttctagtccgtcttctctcgcccttccaacgtcgtcggaccaaccgccggccctaccctgactaatcctcgtgggcctcgagctgaccgacgaggctagaatattacngcngtctacattatggtagtagttggtcctccttcttacgtacgggttttcggcgggtacggtaccgaggtcctacgtacccggttactacggtcgaccgacccgaacggtcctcccgtccccgttcgg

SEQ ID NO: 118272 - DNA, 699 bp, Homo sapiens
  misc_feature: GYAE6OF02GI98G.10.27.C05.1.454.CMB.1.raw
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
tcagcatagtagtgcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgactcgtgtctgggtctccgtggacagtcgatcactatctccngcacgtgcaccagcagtgactagtaggtntacttaataactatgttcctccgtacggtaaccaaccaaaccgacccgacggacccgaccgaccccacgactacatcttatttcgtgatcgtacgtagtcgtacgtccggttccgtttgggtactttaccgtaacgttcgtacctttccgtactccgtccctacgtaacgtccgtccgtaaccgaacctccggttcccttcccggtctaaccctaccgttcccggtcccgggtccgtacccgacgtacgtacgggaccgggacgtaccgtacttactttaagttaccttacgtacgtacgccgttaacgtactaacgttaacccaacccgggtccggtaacgggtacccttccgttcgttacgtaacgttacgtcggttaaccgggcgggtacgtccggtcgtaccgtaccggtacccgtactaccggtaccaccggtacccgtacggtccccgg

SEQ ID NO: 118273 - DNA, 693 bp, Homo sapiens
  misc_feature: GYAE6OF02JX506.10.27.C05.1.454.CMB.1.raw
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (401)..(401): a, c, t, g, unknown or other
  misc_feature (401)..(401): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacaggtccgtcgggccctgtctcgccctgacctcagcctgccctccgtgtctcgggtctccgtggacacggtcggtacaccatctcctgcncgtcggacccagcacgtntattggtggctattaactaccttgtcctcgtgtactacaacaaccgaccacaaccaaccgaccccacctaccttactagtatttatagtacgtacgaacgtaacggccgtaccgtacggttcgggtttacgtacgtccgttcttacttccgtccnccgttaaccgtacgttcgtacgaccaacgcccgtacccctccgtacgacctacttccgtaggtcccggtactaccgacggtacgtacgaccggtacggaacgtcgtaagtacttacgttaccgtgtactactaccgtactagttagtacgtagtacggtacgttcgttacgtttacgtttacggttaacgggtttcgacgggttaccggaccgtcggtacccgttaccgtaccgttaaccgtacgtacggacccgtccgaccggtaccgtccccgtcccgttaccgtacccg

SEQ ID NO: 118274 - DNA, 704 bp, Homo sapiens
  misc_feature: GYAE6OF02IA102.10.27.C05.1.454.CMB.1.raw
  modified_base (141)..(141): a, c, t, g, unknown or other
  misc_feature (141)..(141): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (603)..(603): a, c, t, g, unknown or other
  misc_feature (603)..(603): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacgngggtcctgggccctgtctgccctgactcagcctcgcctcgtgtcgtggtctcgtgacagtcgtcaccntctccngcacgtcgaccagcactgatggtgctattacttacttcgtctcgtagtactacaacaccgccaagaccaaccgcccccatacttcttagttacttagagtaagtcgtaaggtaacggccggtaccctaggttaacgggttctacggtcttcttccgtcgtcgtcctacgtacgtcgtacggaccaccgaccgtccctaccgtagtacctaacgttccgtcggtaccggtccctaccgggtaggtccgtaacggtacccggaggtacggtacgttaaagtaacgttacgtttcgcgtacgtcgtactgttaacttaggttagacgttcgttcggtccttttaccgtttagttacggttaacgggtttccggggaacgggttacccgggngttaccgggtccttaaccgggtacccgttaaccgtaacgttcccgtaaccggtacccggtaccgtccccggtttacccccgtcccggtaccgtttccccgg

SEQ ID NO: 118275 - DNA, 679 bp, Homo sapiens
  misc_feature: GYAE6OF02HO3M4.10.27.C05.1.454.CMB.1.raw
  modified_base (137)..(137): a, c, t, g, unknown or other
  misc_feature (137)..(137): n is a, c, g, or t
  modified_base (167)..(167): a, c, t, g, unknown or other
  misc_feature (167)..(167): n is a, c, g, or t
  modified_base (180)..(180): a, c, t, g, unknown or other
  misc_feature (180)..(180): n is a, c, g, or t
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
  modified_base (536)..(536): a, c, t, g, unknown or other
  misc_feature (536)..(536): n is a, c, g, or t
  modified_base (668)..(668): a, c, t, g, unknown or other
  misc_feature (668)..(668): n is a, c, g, or t
tcagcatagtagtgcacgaccggtgctcgatttagacgcgatcgaagggtttgggggggtcacaagaggcagcgctctcgggacgtctccacatggcctgggctctgctgctcctcaccctcctcactcaggacacngggtcctagggccctgtctcgccctgactnagctgcctccgtntctgggtctccgtggacagtcggtcactancctcctncactggacccagctactgatggtggctaagttactacttgctctgtatcaacacgccagacctaagccccanctctntacttatgaatcagtacgccgcctagtacgggttcagttcgcttccgtntacgccctactaagtcctagacctaaccgtacgtcccgtaccttcgaacgtacttccgtgtaccgggctaccggtcgtacgttacggaaccgacggacgtacgtacggaaatttaaccgtttacgcgtacgtaacgtccgttactaacggtacctttaggtaccgtagtttccgggtaacttccccggttttnttttaaaccgggtaacgggttttacccggaccgggggtttaacggacccggtagggtaacccttcggtacccgtaaccggttacgtaaccggtacccgaccggtaaacccggccttcccggtaacccccggnggtttaacccc

SEQ ID NO: 118276 - DNA, 825 bp, Homo sapiens
  misc_feature: GYAE6OF02GOZOM.10.27.C05.1.454.CMB.1.raw
  modified_base (762)..(762): a, c, t, g, unknown or other
  misc_feature (762)..(762): n is a, c, g, or t
  modified_base (773)..(773): a, c, t, g, unknown or other
  misc_feature (773)..(773): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctggccctgtctgccctgacctcagcctgcctccgtgtctgggtctcctggacagtcggtcaccatctcctcgcactgggacccagccacgtgattcgggttgggactaacgttacttaaaccgtttgtaccttcccgtagggtaactccaaaccgtaaaccgaccccgagaaacccaaaccggaccccccaactacccgttcctttaggttaaacttttaacgttacggtaaaggtacctaagggttaaccggtaccgggtacccccgtttaccggttaacgggggttttacccgtttaacggttcgttacccgttttccgttaacccgttcggtacccccgtttacccgtaaaaacggtttcccggttacgggaacccgttaaaccggaaccccgggggttacccctacccccggttacggaaccctaaccgtttccgtaccgttacgggggaccctttacccggaacggtaccgttaacggaaccggtaaacgggaggtacccggtagttaaaccgttagttaaccgtcgtaactcgggtacctacgtaacgttatacgtagtacgtgggtactccgttcttacgtagggttttaccggcgggaggtacgaggtcncgggttaaccnccgttaacggtacctaccggacctaccggtccgtccgtaccccgtggtaccc

SEQ ID NO: 118277 - DNA, 941 bp, Homo sapiens
  misc_feature: GYAE6OF02GRU10.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctctcactcaggacacagggtcctgggccctgtctgccctgactcacgcctgcctcgtgtcgtgggtcctctggacagtcggtcaccgtatcctccgtgctacgtggacccctagcctactcgattggttcgggactagttactaaccttgtcctcgtggtactaccaactaacgccctagaacctaaacgcccccactaccgttcgttgtaactttacgtaggtaacgtacgaaggttaacggccgtacccgttacggtacggggtttactaacgggttcgtccgtttcgtaccgttcgtacccgttaccggtaacggttcccggttacgggaaccctaaaccggtacccggttacccccgttacccgttacggtaaccgtttaaaccgttccgttttacccggtcccggggtaaccgtaccccgggtaacggttacccggttacgggaaaacccgggtaaccggttaacgggtaccgtaaacgggttaatttaaacccgtttaccggtacggtaccgtaccgttacccgttaaccgttaaacgtttaacggttaaccggttaaacgggtccgtttaccggggttaacgtttccccccggtttttaacggtttttaacccggggtttaaaaccgggggttttcccggggtaacccggggttaaaccgggggtaccccttaacgggggtaccctttaaccggggtttaaccccggttaacccggtaacgggttttaaccccgaacgggtttaaaccccccgttaacggggtccccctttaaccccggggttacccccccgttttcgggttaaacccccgg

SEQ ID NO: 118278 - DNA, 665 bp, Homo sapiens
  misc_feature: GYAE6OF02F12KJ.10.27.C05.1.454.CMB.1.raw
  modified_base (236)..(236): a, c, t, g, unknown or other
  misc_feature (236)..(236): n is a, c, g, or t
  modified_base (394)..(394): a, c, t, g, unknown or other
  misc_feature (394)..(394): n is a, c, g, or t
  modified_base (506)..(506): a, c, t, g, unknown or other
  misc_feature (506)..(506): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctcgccctgactcagcctgcctccgtgtcgtgggtctcctggacagtcggtccacctactctcctgcctacgtcggacccngcactgtacgtggttcggactattacttacttgtctcgtgtatacaaccgaacctcccacgaaaccaaccgaccccactactctttacgtaagtttactagtacgtactaggtaacggccggtacctcgggttacgggttactcgtacgtctttctcncgtccttaccgtagtcgcgtacaaccgcccggtcccttccgacgactacgtactcgtcggtccgcgtcggtcgtacgacggacgtacggacttatacttacgtcgtacgtcncgtactactaagttcgtagtacgtcgttaggtccttacgtttcggttacggtttacggttacgggacggtacgtacggtacgttcgaccgttaccgttaacggtacgttaaccgaccggttaccgtaccgtccggtaccccgtacgttcccgttaaccg

SEQ ID NO: 118279 - DNA, 719 bp, Homo sapiens
  misc_feature: GYAE6OF02GMBER.10.27.C05.1.454.CMB.1.raw
  modified_base (318)..(318): a, c, t, g, unknown or other
  misc_feature (318)..(318): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacaggtcctgggccctgtctgccctgactcagcctgcctccgtgtctgggtctcctggacagtcggtcaccatctcctgcactcggacccagcactgatggttgggctattaactaaccttgtcctccgtagtactacaaacaacgcccagaacaaaccgccccactactctgtaatttangaagtcaagtaacgccggtaccctcgtacgggttcgtacgttacgtcttacctctcgtcctacctaacgtcgtacggtaccaaccgaacccggtaccctccccgtacgaaccaacttacctccgttacgggcccgtacccgacgggtcccgttacggaaccggaacggaaccggtacgtacgtaaacggttaaactttaaccgagtaccgaataccgttactaacgttataacggttaggtaacgttacgggtcgttacccgttttacgttttaaaccggttacgggttttacccggggacgggtacgggtaccggtacggtcggtaaccgtacccgggttaacgtacgttaccgtaacgacccgtaaaggtccccgtacccggcccccgttcgtaccccg

SEQ ID NO: 118280 - DNA, 770 bp, Homo sapiens
  misc_feature: GYAE6OF02H7PEI.10.27.C05.1.454.CMB.1.raw
  modified_base (257)..(257): a, c, t, g, unknown or other
  misc_feature (257)..(257): n is a, c, g, or t
  modified_base (555)..(555): a, c, t, g, unknown or other
  misc_feature (555)..(555): n is a, c, g, or t
  modified_base (597)..(597): a, c, t, g, unknown or other
  misc_feature (597)..(597): n is a, c, g, or t
tcagcatagtagtgcacgaccggtgctcgatttagacgcgatcgaagggtttggggggggtcacgaagaggcagcgctcgtcgggacgtctccaccatggcctgggctctgctgctcctccaccctcctcactcgaggacacgacgggtcctcgggccctgtcctcgccctagacctcgacgcctcgccctccggtgtcgtcggtctccgtaggactaggtccggacacctcgtcctccgtagctaacgtccggacncgtaccacgtgtattcgggtcggactttaacttaccgttaaccgttcgtcgttacccgtaggttactaccgaaaccgaacccgtacccgaaacgaacccgtaaaccgcccccgtaacctaccgttacgttacggttaacttttagaacggttacgtacgtaacgttaaccggccgtaccgtcggttacgggttctaccgtcgttactccgttactccgtacctacgtacgtcgtacgactaccgtaaccgtccctaccgtacggtaaactccgttcgtcgcggtcgacccgtgtaccncgggtaaccgacggttaccgagtacgtaacgttacgttaacncgtaacccgtgtacctaactgtttaaacgtgtaaacggttcgacgggtttctaccgtttcgttaggttaccggttacgggtaccggaaccgtacggttccgaaggttacccgtccgtaccgttaagcccgtaacggaccgtcccggccgttacccgtacccggtgttaacccg

SEQ ID NO: 118281 - DNA, 845 bp, Homo sapiens
  misc_feature: GYAE6OF02HTB8M.10.27.C05.1.454.CMB.1.raw
tcagcatagtagtgcacgaccggtgctcgatttagacgcgatcgaagggtttgggggggggtcacaagaggcagcgctctcgggacgtctccaccatcggcctgggctctgctgctcctcaccctcctcactcaggacacagggtcctgggcccagtcctgccctgacgtcacgccctccctccggtcgtccgggtctcctggacagtcacgtccactactctcctgctacgtacgaaccagcaggtacgtactttggtactacttaactaacttatgttacctccgtacggtaccgacgaccacccaacccgacggaaccaaacccgtacccctaaacgtttccttttaggtttttacggacggttctaacggtacggtaccggcccctacggacggtaccgttcctaggtacgtttccgggttactccgtacggtcccttaccgtaacgttcgacgggtacctaaacccgtacccggtcccttacccggtaccgttacccgtaccgttcggtaccgggtacccgttaccggaacggtccggttacgggacgggtaaggttacgggtacggtcgttaacgttaaccgttaaccttcggtaccggtaccgttaccgggacttaaacgttacgttaaccgttaaccggaccccgggttaaccttaaccggggttacggggtttacgggttccggggtaacgggtaaccggggtaacgggttcggttaaacccgtcccgggttacggtcggtacgtaccgggacccgtaccggtcccggtaccccgtccccggttaccgtaccttaccgttcccgttccccgtaacccttccccctagttaccccgg

SEQ ID NO: 118282 - DNA, 1063 bp, Homo sapiens
  misc_feature: GYAE6OF02FK5RL.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtcgtgggtcctccgtggacagtcggtcacctatcctcctgctacgtcggaccccagccacgtagtacgttgggtttcgggactaagtttaacttaacccgtttcgttcccgttaccgttagggtttaactaacccgtaaaaccgaaccccggacccccgtaaacggaaaacccgaaaaaccccccggacccccccctaaaacctaacccgttttaccgttttaacggttaaacgttttttaagttaaacgggtaaaacggtttaaaaccggttaaacgggtcccccggggttacccccggtttacggggttttaaaccgggggttttttacccctttacggggttacccggtttacccgttttccgtttaccggttacccggtacccccgtttaaccgttaacccgtttaccggtttaaccgggtaaccccgtaaaccccggtaccccggggttaccccccctttccccggttaaccggtaaacccttaaaccgttttaccccggttacccggggttaccggggttaccccttaccccgggtaaccggggttaccccgtacgggtaaacccggaacccggggttacgggtaccgttaaaccggttaaacgttttaaaccgtttaaccgtaccggtacgtaacccggtaccgtaccgtttaagtttacggttaaagttaccgggttaagggttcccggtttaccgtttacccgtttttacgggttttaaccggttaccgggggttttacccgggacggggttaaccgggttaccgggtacggtaccgttaacccggtaaccccttaaggttaacccgttacccggaaccgtacccgggtaccggtcccgtaccccggtccccgtttcggtaccctacccccgg

SEQ ID NO: 118283 - DNA, 764 bp, Homo sapiens
  misc_feature: GYAE6OF02JVBLV.10.27.C05.1.454.CMB.1.raw
  modified_base (593)..(593): a, c, t, g, unknown or other
  misc_feature (593)..(593): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctcgccctgactcagcctgccctcgtgtccgtgggtcctccgtggactcggtcggtcacctatcctcctgcctacgtcggacccagacactgtatggtggactattactaccgttgtcctcgtaggtactacgaacctaccgacccaacgtaaccgaaacccgcccccaacttaccgttcgttagttacgtttacgaacggtaacgtacgtaacggtaccggtcccggtacccttagggttacggtttcgtaccggttccgttaccttccgttaccgttaccggtacccgttaaccgttaacgggttccgtaaccgggtaaccaaccggtaccccgtacccgttacccgtagaacccgttaactcccggtttaccggccgttaccgttccgacggtcgtacggaacggtacgcgtacgtagtaacttctacgcgtacncgtacctagtatacgttcgtaaacggtcgttcggttaccttccgtttacgttacggttaacgggttccggggaacggtaccggtcgttacggccgtttacggtaccgtaccggttaacgtaccggaccttccgggtaacctcccggtcccgttacccggtaccttacccgg

SEQ ID NO: 118284 - DNA, 567 bp, Homo sapiens
  misc_feature: GYAE6OF02HKXLZ.10.27.C05.1.454.CMB.1.raw
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggcctgtctgccctgactcagcctgcctcgtgtctggtctccgtgacagtcggtcaccatctcctgcacgtcggacccagcacgtgagtgttggctattactaccttgtctcgtgtatcaacacgccagacaacgcccanactctgtattangatcagtacgcgcctagagggtttcagtcgtcttctctcgcctctaagtcctggacctaaccgcggtccctcccgtagacctacttcgtacgtcggtctccgacgtcgtacgacgtaacgngtcgtagtaagttacttcngtcagtccatagtntagtagtacgtgtcgtcctttcgttacgtaacggtttcgacgggtacggacgtcggtcgtccgtaccgtcgtaccgtcgacgtacccgtagtcctacccgtcccgttgtacccg

SEQ ID NO: 118285 - DNA, 614 bp, Homo sapiens
  misc_feature: GYAE6OF02I1U2L.10.27.C05.1.454.CMB.1.raw
  modified_base (225)..(225): a, c, t, g, unknown or other
  misc_feature (225)..(225): n is a, c, g, or t
  modified_base (309)..(309): a, c, t, g, unknown or other
  misc_feature (309)..(309): n is a, c, g, or t
  modified_base (377)..(377): a, c, t, g, unknown or other
  misc_feature (377)..(377): n is a, c, g, or t
  modified_base (448)..(448): a, c, t, g, unknown or other
  misc_feature (448)..(448): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctcgcctcgtgtctggtctctggacagtcgtcacatctctgctatcgaccagcntgatggtggactattactacttgctccgtgtactccaacaccgaccaacgacaaaccgcccctaactacttccgttgtatttanagaacgtacaggacgtccgccctcggtagggttctacgtcgtcttctcgtcgacctacgacgtcgtanaccaacgtccgtacctccgtacactaacctcgtaccggtcggaccgtccgacggtcgtacgaacgacgggngtactagtaattacgttacgtacgccgatacctacgtatagttacggataggtctcgtcgtttcgttaacggttaggttacgggtcggtccggagtacgcgttaccgtacgttcgaacggttaccacggtaccgtacgtcccggtcccgttcccggtacctacccg

SEQ ID NO: 118286 - DNA, 712 bp, Homo sapiens
  misc_feature: GYAE6OF02G0C98.10.27.C05.1.454.CMB.1.raw
  modified_base (197)..(197): a, c, t, g, unknown or other
  misc_feature (197)..(197): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctctggacngtcgtcacatctctgcactcggacccagcactgattggttggctaattactaaccttgtcctcgtgtatacaacaccgaccaagaccaacgccccactactcttagtattatagtaagtacagtacgcgtcccgtacgtagggtttctacggtcgtcttcctcgtcgtacctccgtaagttcgtacggacctaacgacccgtcccttaccctcgtaacctaacgttcctcggtccgggtccctaccggtacggtaccggtacggaaccggaacggtacggtacgtagttaaacttaacttaccgtacgtaccgtacgtacctacgtacttaagttagttacgtacgttaggttccgttaccgtttacgtttacggttaacgggtttccgggtaaccggggtaccgggtaccgtacgggtccggttaaccggttaacccggttaaccgtaccggttaccgacccggtacccggtaaaccggtcccgttaccccggttccccgttaccggttacccg

SEQ ID NO: 118287 - DNA, 788 bp, Homo sapiens
  misc_feature: GYAE6OF02JUKMC.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcacctcaggacacgacgggtcctgggccctgtctcgtccctgactcacgcctgccctccggtgtccgtgggtcctccgtggactagttcggtacacctatcctacctgactacgtacggtaaaccagtcgtacgttagtcttttgttgacctttaagtaactactcgtaccttccgtacgtaccacgccacccacgacgaccaaccgacccctaacttccgttgtttgacgtacgacgtacgcgcctgacgtcgtcctgtagttccgtctacgtctacctactagtctacggactacgacccgtcccgtaacccgtcctaccggtcgttccggtcggtaccgtccgtacgggtccgtagggaacggtacgtacgggacgtaccgtagttaacccttacggtaccgtacggtccgtaccggtaccgttaaccgttaacgtaacggttacccggtaaaccgggacccgttaagggttaccgggtttcgggtaccgggtaccggggttaacccgggtacttaaccgggtaccgttaccccgggtaccggtaccggtaccgggtaacccgtaacccgggtaaccgtccccggtaacccggttccccgttacggtcccgtaaccccgttcccggtttccccgggttacccccttacccgttcccccg

SEQ ID NO: 118288 - DNA, 584 bp, Homo sapiens
  misc_feature: GYAE6OF02F4PPS.10.27.C05.1.454.CMB.1.raw
  modified_base (287)..(287): a, c, t, g, unknown or other
  misc_feature (287)..(287): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgctcctggtatcaacacgcccagacaacgccccanactcttgatttatgaagtcagtaagccggcctcgaggggtttctagtccgctttcgtcgtcgtccctaccgaagttctacggtaccaaccgaccggtccctcccgtacgacaactctcgtcgggcctccgagctgaccgacgacgctagaacttattacngcgngtctacgattagtgtagacgttggctcccttagtttacgtaacgggttttcggacgggtacggaccgtaggtcctaccgtacccggtcttaacggtccacggcccgaacggtcctccggtaccccgtgtaccc

SEQ ID NO: 118289 - DNA, 713 bp, Homo sapiens
  misc_feature: GYAE6OF02HR6RX.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacgagggtcctgggccctgtctcgccctgactcacgtcctgccctccgtgtcgtggtcctcctggactagtccggtcaccatcctctgccacgtcggaccagctacgtgacgtggttggactattaactacttcgtctccgtagtactaccaacaccgaccaacgaacaaccgaccccactacttacttagttacgtttacgtaggtaactacgtaacggtaacgtcccggtaccgttacgggttacgggtttactacgttccgtacgttcctcgtacgtccctacgtacgtcgtacgtaccaacgtaccgtcccgttaccgtagtaactaacgtccgtacgtacgggtccttaaccgcggtacgtacggtacgaaacggtacggtacgtaaagtaacgttaactacggtacgtacgagtcctagtaagttacgtacgtaagtacgttcggtcttaccgtttacggtttaaacggtacggggttacggagggtaccgaggttaccggacgtaccggtacccgttacgtaccgtacgtacccgtaccgacggttcccgccgtaccccgtagtacccg

SEQ ID NO: 118290 - DNA, 671 bp, Homo sapiens
  misc_feature: GYAE6OF02HGUXV.10.27.C05.1.454.CMB.1.raw
  modified_base (306)..(306): a, c, t, g, unknown or other
  misc_feature (306)..(306): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggactattaataaccttgtctcctggtatcaacaccgccagacaaacgcccccactactcttgatttatagaacgtcaagtacgccgtccctcgtaggggttctacggtcgtcttctcgtcgtcctccaagtctcggacctaacgtaccggcctcccgtnaacaactcgtacgtcggtccgtaccgacggcctacggacgtacggacggtctacgtaatacttacgtgacacgtctactagtacgtgtacgtagtcggtcgtctttcgtagtacgggttttcgggccggtacggtacgcgtcgtaccgtaccgttaccgacggttaccacgtaccgacggtcctccggtaccccgttggtcctaccgttccgttccgttcccgtaccgtccctaccgtaccgttaacgtccgtacgttaccggtagtaccgggtaccggccggttacgaccgggtaccggtacggttaccgttacgaacgtccgtatcgttcagtttacgcgtaccgtagtactcggaataccgg

SEQ ID NO: 118291 - DNA, 605 bp, Homo sapiens
  misc_feature: GYAE6OF02GG40W.10.27.C05.1.454.CMB.1.raw
  modified_base (283)..(283): a, c, t, g, unknown or other
  misc_feature (283)..(283): n is a, c, g, or t
  modified_base (425)..(425): a, c, t, g, unknown or other
  misc_feature (425)..(425): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatcctcctgcactcggacccagcatgatgtggctattactacttgctctgtatcaacacgccagacaacgcccanactctgtacttatagaagtcaagtacgccgccctgtacgggtttctagtcgtcttactcgtcgcctacgtaagttcgtacggactaaaccgaccggtccctaccccgtagaaccttacttacgtcgtcggtccaccgtcggngtacgaacgacggtacggtactaggtaaattacttacgtcgcaagtcttacgaattcgtaagtagtacgttggttacctctttacgttacgttaacgggtttcggacgggtacggtacgtggtactacggtaccgtaacgttagcctaacgccgtaaggcctccgtacccgtcgttaccg

SEQ ID NO: 118292 - DNA, 701 bp, Homo sapiens
  misc_feature: GYAE6OF02G5W4G.10.27.C05.1.454.CMB.1.raw
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtcgtgggtctccgtggacagtcgtacaccatcctcngctacgtcgaccngcactgacgtggtcggatattactacttntcctctgtanacaccacgccagacaaccgccccacgtactcgtntattanaggtaactcgtaaggtaacgtcccggtccttacgtacgggttatacgttccgtcttctcgtcctacctccgtaacgtcggtcgaacccacgtacccgtcccttaccgtacgtactaaccgtcgttccggtaccggtccgtaccggtacggtcggtaccgaaccggaccggtaccggtaccgtacggttaaacgttaacgttccgttacgtacgtacgtacttaccgtacgttacgttacgttagtacgttcggtacgttccgtttaccggtttacggttacgggttacgggtacgtaccgggggggggtactaccgggtacggtaccgtaccggtacgtaccgtacggaccgtaccggaccgtacccgtcccggtacccgtccgttaccccg

SEQ ID NO: 118293 - DNA, 727 bp, Homo sapiens
  misc_feature: GYAE6OF02HPT2P.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacgacgggtccgtcgggccctgtctcgccctgactcagcctgcctccgtgtcgtgggtcctcgtggacacggtcgtcaccacgttcctccgtgaccacgtccgggaccccaggctacgtgacgttgggttacggctaacgttaacttaccgttcgtcctttccggtacggttaactaccgaaaccgaaccgacccgaagaaccaaacccgacccccactaaccttcgttagttaattacgtagtaacgtacgtaaggtacggccggtcccgtaggttacgggttctacgtccgttcgttcctctcgtcctactaacgtcgtcgaaccaccgccgtacctaccgacgactacttccgtcggtcggtccgacggacggtcgtaacggacggacggtggtaacttagtaaacgttacgttcgacgataccgtacttacgtaagttacgtggttaagtcggttacggttcttacccgttttaggttaaccggttacggggttacgggcgggtacggtaccgtaccggtacgtaccggtaccgtacgtaacgtcccgacggtacccgccggtcctcccgggtacccctcggtacc

SEQ ID NO: 118294 - DNA, 705 bp, Homo sapiens
  misc_feature: GYAE6OF02JOR2V.10.27.C05.1.454.CMB.1.raw
  modified_base (249)..(249): a, c, t, g, unknown or other
  misc_feature (249)..(249): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (541)..(541): a, c, t, g, unknown or other
  misc_feature (541)..(541): n is a, c, g, or t
tcagcatagtagtgcacgaccggtgctcgatttagacgcgatcgaagggtttggggggggttcgacgaagaggcagcgctctcgggacgtctccaccatgcctgggctctgctgctcctcaccctcctcactcacggacacacgggtcctgggccctgtcctcgccctagactctacgcctcgcctccgtgtccgtgggtctacctggactagtcggtcacactctcctgcaccgtcgacccagcactntagtcggttcgggctacttaataccttcgtctccgtgttactaccaactaaccgaccaagaacaaccgaccccaaccactctatacgtttatagactacagacgtacgccctatggttctttacngtccggtnttactccttcggacccttacgtaacgtcgttcggacctaaaccgtcccgtcccgtaccttacacgtaacgtcccttggtaccgggcccttacgtacgtgaccgggtaacaccgggaacggtacctaaggtaactttaccggttaactcgggtaccgtanccgtttacaagtttacgacggttagtacggttcgggtaccttacgtttacgtttaccgttaaggggttccgggtacggggtaccggacggtaaggtcccgttacgtaccggtaaccttacgtacccgaccttaaccggcgtacccggtccctccccgggttacg

SEQ ID NO: 118295 - DNA, 649 bp, Homo sapiens
  misc_feature: GYAE6OF02H5IR3.10.27.C05.1.454.CMB.1.raw
  modified_base (172)..(172): a, c, t, g, unknown or other
  misc_feature (172)..(172): n is a, c, g, or t
  modified_base (244)..(244): a, c, t, g, unknown or other
  misc_feature (244)..(244): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtccgtcgggccctggtctcgccctgactcncgcctcgccctccgtgtcgtgggtcctccgtggacaggtccggtccaccatcctcctgccacgtcggacccngccactgagttggtggactattacttacttgtcctcgtgtactacaacacgaccagacaaccnccctanacttntatattanagtatacagtacgccgtccgtaggtagttctgtctcttctctcgtcctacgtacgtcgtcgaccaccggtcctccctcctacgtaactcgtcctcggtccggtcctccggacgtcgtacgacggaacggtcgtagtagtaagttacgtacgtacgacgtacgtactaacgtacgttaggtagtacgtcggttacggtcctttaccgttacgtttacggtaacgggtttacgggacgggtacggtacggtaccggtcgtaccggtaccgtaccgttaacgtccgaccgccggtacgtcccgtacccgttccccgtagtaccccg

SEQ ID NO: 118296 - DNA, 692 bp, Homo sapiens
  misc_feature: GYAE6OF02JEWIN.10.27.C05.1.454.CMB.1.raw
  modified_base (141)..(141): a, c, t, g, unknown or other
  misc_feature (141)..(141): n is a, c, g, or t
  modified_base (537)..(537): a, c, t, g, unknown or other
  misc_feature (537)..(537): n is a, c, g, or t
  modified_base (573)..(573): a, c, t, g, unknown or other
  misc_feature (573)..(573): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcgaggacacgngggtcctcggccctgtctcgccctgctcgcgcctcgccgtccgtgtcgtcggtcctccgtacggactcggtccggtccacctctccgtccgcgacctacgtaccggacccacgtccaacgtggtacgttggttggaccttaagtttaccttaaccttcggttccttccgtggttaactaccaaaccgacccgacccgaacgaaacccgaacccgcccccctaacctaacgttccgttaagtatttaacgtacgaacgtaccgtaacggtaacggcccgttacccggtcgggttaaccggtttacgtcgtcgtccttccgtctcgtcctaccgtagtcgtacgaacacgaccgtcccgtcacgtactaactccgacgtcgtctcgacgtcgtacggngacgtcggactagtaatacgttacacgcgatccgtntaacgtgtatacggtcgtacgtcgttactcgttacggtaggtccgaggtcgacggtcgtccgttacgccggtaacttcgacgacgtacccgtagcccgttacccggcgttaccgtcccg

SEQ ID NO: 118297 - DNA, 770 bp, Homo sapiens
  misc_feature: GYAE6OF02GFQQ1.10.27.C05.1.454.CMB.1.raw
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
tcagcatagtagtgcacgaccggtgctcgatttagacgcgatcgaagggtttggggggggtcacaagaggcagcgctctcggggacgtctccaccatggcctgggctctgctgctcctcaccctcctcactcagggcacagggtcctgggccctagtctgccctgactcagcctgcctcgtgtctggtctctggacagtcgatcaccntcctcctncactggaaccagctagtgacgttggtgttaanactatgtctctgtaccaacaaccaccagacaacgacccccaactcatcgttattttacgattgtacaagtaactccggtccctaggtacggggtttactaacgttccgtcctttacgtcgttcggtcctaccgtaaggttcctacggtactaaaccgcccggttcccttaccccgtacgaacccttctttaccgttcggtccggtaccgttaccgtacgggtcgtaacgggtacgggtaaccggacgggttacgttacgtaccgttttattaccggtcgtacgtagtacccttactaacgttaaaccgtaacctaaaccggtacgtaccgtaacgtaccctttaacgtttcgttaacgggtttacgggttaccgggaacccgggtaaccggggaacccttaacggggtaccgtttaacccggttaacccggttaccgggttaacccggtcccgtaacccgggttacccggaaccccgggttcccccgtaccccggtttcccccggtacccgtttacccccgg

SEQ ID NO: 118298 - DNA, 675 bp, Homo sapiens
  misc_feature: GYAE6OF02JJDK5.10.27.C05.1.454.CMB.1.raw
  modified_base (204)..(204): a, c, t, g, unknown or other
  misc_feature (204)..(204): n is a, c, g, or t
  modified_base (317)..(317): a, c, t, g, unknown or other
  misc_feature (317)..(317): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctactcactcaggacacagggtcctgggccctgtctgccctgactcagcctgcctccgtgtctggtctctggacagtcgcacntctcctgcacgtcggacccagcactgattggtcggacctattactaaccgttcgtcctccgtggtactacaacgaccgccaacgaaccaacgccccactacctctgtattagnaagtcaagtacgccgcctacgtacgggtttactagtacgtcttactcgtcgtcctacctaagttcgaggccaacgaccgtccctccgtacgtactaactcctcggtacggtcctaccgacggtccgtacgaccggtaacggacggtacgtacgtaaacgttacgttaccgtacgacgtacgtctacgtagtagttacgtacgtaggtcgttcgttacctttacgttaccggttaaacggggtttccgggtacgggtaccgggtacccgtagggtcccgtaccggtaacccgttacgtaaccgtaccgaccggtacccgaccgggtcccgtaccccggttaccccgttacggtaccccg

SEQ ID NO: 118299 - DNA, 738 bp, Homo sapiens
  misc_feature: GYAE6OF02FGVJN.10.27.C05.1.454.CMB.1.raw
  modified_base (532)..(532): a, c, t, g, unknown or other
  misc_feature (532)..(532): n is a, c, g, or t
  modified_base (593)..(593): a, c, t, g, unknown or other
  misc_feature (593)..(593): n is a, c, g, or t
  modified_base (626)..(626): a, c, t, g, unknown or other
  misc_feature (626)..(626): n is a, c, g, or t
  modified_base (721)..(721): a, c, t, g, unknown or other
  misc_feature (721)..(721): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcgactcgacggacacgtagggtcctgggccctgtcctagcccctgacctcgacgtccctagtccccgtacgttcggtccgtcgggtacctccggtacggactaggtccgtcccacctacgttcctaccgtcgacctacgtaccggacccgataccgtacgtcgtacgttggtaccggtattaacgttacgttaacccgttgtacccggttccgtaggttaacacccgtaaaccgacccggacctaagaaacccggtacccccgcccctaaggttaacctttccgtagttaacttttcgaacgaacgttacgtacggtaccgccgtaccgtacggttcggttactcggtctcgtctacgtccgtacctcgtaacgcggtaacgaccaacgtccgttccctaccgtanaacgttcacccggtttaggtcggcccttaccggagtacgtacgggaccgtacggtcaagtntaaacgttcgtcggcacgtacgtctacgtacgngttacgagtctcggtacctccttggttatcgggtcgtaaccggtacccgtgtaacgtaccgggcttaacggtacacgacgtacccgtagttcccncggttacccgtagtccc

SEQ ID NO: 118300 - DNA, 734 bp, Homo sapiens
  misc_feature: GYAE6OF02GHIXN.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtcgtgggtctccgtggacagtcggtcaccatctcctgcacgtcggacccagccactgagttggtgggctaattactaaccttcggttacctcgttacggtataccaaaccgtaaccgaccccgtaacgaaaccgaaaccggaccccccaacctaccttacgtttagttaactttaagtacggtaaacgtacgtaaggtaaccggccggtacccgtcggttaacggggttttacgttacggtccggttacctttccgttaccgttcggtaccccttaaccgtaacggttccgtacgggaaccctaaccggtacccggtccctacccgttacgaacctaacttccgtaccggtccgggtacctccggacgtacggtcggaaccggacggaggacttataagttacttacgcgactgacctatattcgtagtagtcgttggtaccgttccttacgttaccgggtaaggtttccgggacgggtacggtacgtacggtcgtacggtaccgtaacgtacgtcgacccggtacggaccgtcacccggtcccgtcgtacc

SEQ ID NO: 118301 - DNA, 678 bp, Homo sapiens
  misc_feature: GYAE6OF02IAL69.10.27.C05.1.454.CMB.1.raw
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
  modified_base (446)..(446): a, c, t, g, unknown or other
  misc_feature (446)..(446): n is a, c, g, or t
tcagcatagtagtgcacgaccggtgctcgatttagacgcgatcgaagggtttgggggggggtcacaagaggcagcgcctctcgggacgtctccacatgcctgggctctgctgctcctccaccctcctcactcaggacactacgggtcctcgggccctggtctcgccctgacctcacgcctcgcctccggtgtcgtggtcctccgtggacagtcggtcacctatcctcctgcaccgtcggacccagctactgattcggtggctagttaactaccttcgtctacgtagatacaaccaacgcccanaaccgtaaaccgcccctatacgttcttagtaatttagagtaagtctaagtaaccgtcgacctaggtttacgggttntaccggttcgtctttacctacgtaccgtcctaacgtagtcggtagacctaccgaccgcccttaccgngtaacctagttccgtacggaccgtccgtaccgtcggtccgtacggtaaccgacggaacggttgtaaccggtaattacgtttaccagggtacctacgtccttaataattacgtaggtacggtaagttcggtcgtttaccttacgtttacgtacgggtttacggacgggtacgacgtccggactaccgtacgtacgactccgtacacggtcccgtaccgtcccgtccgactccg

SEQ ID NO: 118302 - DNA, 748 bp, Homo sapiens
  misc_feature: GYAE6OF02GGLB0.10.27.C05.1.454.CMB.1.raw
tcagcatagtagtgcacgaccggtgctcgatttagacgcgatcgaagggtttgggggggggtcacaagaggcagcgctttcgggacgtctccaccatggcctgggctctgctgctcctcaccctcctcactcaggacagacgggtcctgggccctgtctcgccctcgtactcgacgtccctggtccctccgttggtccgttgggtcctccgtaggactaggtaccggtacaaccgtacttcgttaccgtgccgaacgtccggaccctagccgtacgtggtacgttggtcggactaacgttacgtacgttcgtccgtcgtacggtactacgaaccgaaccgaccaacgaacctaaccggcccctaacgttacctacgtagttacttagtaacggtaacgtacgacgtaacggtccgtacgtcggtggttaccacgttcgtcttccgtacgtcgtacctacgtacgtacgtacggactaccggcgtcctacgtactaacgtacgtcgtacggtcgtacctacgtacggtctacggtacgacggtcgtacgtaagtacgttacgtacgtcgtacgtacgtcgtacgtaacgttacgtacggtagtcgtacgttacgttaccgtttacgttaacggttcgggttacgggacgggttaccgtccggtaacgtccggttaaacggtccgttaacctcggtccgtacggtaacccggcggttaccgcccggttacccggttacgacccgttcccg

SEQ ID NO: 118303 - DNA, 687 bp, Homo sapiens
  misc_feature: GYAE6OF02H0XTG.10.27.C05.1.454.CMB.1.raw
  modified_base (234)..(234): a, c, t, g, unknown or other
  misc_feature (234)..(234): n is a, c, g, or t
  modified_base (336)..(336): a, c, t, g, unknown or other
  misc_feature (336)..(336): n is a, c, g, or t
  modified_base (370)..(370): a, c, t, g, unknown or other
  misc_feature (370)..(370): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcgaggacacgtacgggtccgtcgggccctgtctcgcccctgacctcagccctcgcctcggttcgtcgtcgggtctccgtaggactcggtcgtcaccatcctcngcacgtccggaccagacacgtgagtggttggactaattactacttcgtctcgtagtactacaacgaccgccaagaaccaccgtacccatctagtattattanacgtagtacaagtccgcgtccgtggttaggttcncggttacgtctcgtcgtacgcctacgtaagtcgaacggtccaccgtacgccctaccgtacgaactacgtccgttcgggacgtcccgtacgacggtacgtacgggaacgacgggtactaggtaaacttaaagttcctttacggacgtcggtaagtactaacgtaacgttaaggttaccgagttacggtccggttacctttacgttcgtttacggttaaccgggtcgggacgggaccgtacggaccgtccgtaagtcccggtaagttaccgaccggaccgtaccggtaccgtcccgtacccgtcccgtggttaaccccg

SEQ ID NO: 118304 - DNA, 898 bp, Homo sapiens
  misc_feature: GYAE6OF02IZEW0.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgcctcctcaccctcctcactcaggacacagggtcctcgggccctgtctcgccctgactcacgcctgtccctccgtgtcgttcgggtcctccgtggactaggtccggtaccaccattcctcctcgccacgtcggaccctaggcctacgtacgtagttcgggtacgggtacttaactttaaccgtttaacccgtttcgtaccgttaccgttacgggttaactaacccgaaaacccgtaaaccccgcccccgtaaaacggaaaaccctaaaccccggtacccccctaaaccgttaacccttacgttttacggtttaacttttacgtaaacggtaaccgtttaacgtaaccggtaaccgggtccggtacccccgtttagggtttaaccggggttttactacggttccgtacctttaccgttccgtccgtacccttaccgtaacggtttaccgtacggtaaccaaacccgggtacccgtaccccttacccgttaccggaacccttaacttccgttccggtacggtccctaccggacgtcgacggtaaccgacggtacgtacgtactaacttacgtacgtcggtactacgtcctagtacttcgtaacgttacgtacgggttacgttacgttaccgttttaccgttacggtttaacggggtttcccggacggggtacccgtaccggtacgggttaccgtccccggtttaaacggtaacccgttaccggtaacgtacccggtacccgggttaccgtaccccgggtaccccgttaccccggttccggtaaccccgg

SEQ ID NO: 118305 - DNA, 715 bp, Homo sapiens
  misc_feature: GYAE6OF02JYSH6.10.27.C05.1.454.CMB.1.raw
  modified_base (121)..(121): a, c, t, g, unknown or other
  misc_feature (121)..(121): n is a, c, g, or t
  modified_base (128)..(128): a, c, t, g, unknown or other
  misc_feature (128)..(128): n is a, c, g, or t
  modified_base (140)..(140): a, c, t, g, unknown or other
  misc_feature (140)..(140): n is a, c, g, or t
  modified_base (184)..(184): a, c, t, g, unknown or other
  misc_feature (184)..(184): n is a, c, g, or t
  modified_base (216)..(216): a, c, t, g, unknown or other
  misc_feature (216)..(216): n is a, c, g, or t
  modified_base (676)..(676): a, c, t, g, unknown or other
  misc_feature (676)..(676): n is a, c, g, or t
tcagcatagtagtgcacgaccggtgctcgatttagacgcgatcgaagggtttggggggggtcacaagaggcagcgctctcgggacgtctccaccagtggccgtgggctctgctgctcctcncctctcnctcaggacacgnggtccgtgggccctgtctgccctgcctcagccgtgccctcggtntcgtaggtcctcgtggactagccggtacaccntcctcgtagcacgtcggaccagccagtcgtagttcgtgggccttaagttacgtacttcgtccttcgttaggtagtaccgtaaaccgaccggtacccaacggaaaccctaccggtaccccaaccttacctggttactaactttagacggtaacggccgttaaggtccggaccgtaccgttcggttaacggtcgtacggttatcccttgaccttcgtacctacggtacgtacggacctaacggaacgtcccgccttccgtaaggtaaccaccgttccgtaggtcgtccggtacgtgtccgacggttaacggaccgtagtccgaaacgtactttacgggaactccgggtactaaacgtccgtaacgttaaacgtggttaaccgtaagtccgttaacgtccgtttacctacgttacgggttaacggtccggtagggacgttaaccgtgtccggtacttcgtaanaaccgtcgacgttcggacttcccggccttcggtcgtccg

SEQ ID NO: 118306 - DNA, 653 bp, Homo sapiens
  misc_feature: GYAE6OF02H43DG.10.27.C05.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
  modified_base (289)..(289): a, c, t, g, unknown or other
  misc_feature (289)..(289): n is a, c, g, or t
  modified_base (548)..(548): a, c, t, g, unknown or other
  misc_feature (548)..(548): n is a, c, g, or t
  modified_base (582)..(582): a, c, t, g, unknown or other
  misc_feature (582)..(582): n is a, c, g, or t
  modified_base (606)..(606): a, c, t, g, unknown or other
  misc_feature (606)..(606): n is a, c, g, or t
  modified_base (641)..(643): a, c, t, g, unknown or other
  misc_feature (641)..(643): n is a, c, g, or t
  modified_base (646)..(651): a, c, t, g, unknown or other
  misc_feature (646)..(651): n is a, c, g, or t
  modified_base (653)..(653): a, c, t, g, unknown or other
  misc_feature (653)..(653): n is a, c, g, or t
tcagcatagtagtgcacgaccggtgctcgatttagacgcgatcgaagggtcctgggccctgtctgccctgactcagcctgcctccgtgtctggggtctcctggacagtcggtcaccatctcctgccactggacccagcactgatggttgggcattataaccttgtctcctgtatcaacacgcccagaaccaaagcccccanactcttgatttatgaagtcagtacgcgccctgaggggtttcagtcnctttctctgcctaccagttctggccaaacgcggtccctcctnacctaatctcgtcgggacctcgagggtctacggacggacgacgggcttagaattaattcgtgacctgaccttacaattactggtaacaggttttcggactccgttttacgtttacggtttaagggttttcccgggggacggtaacggggtaaccctaggggtcgtaacggtacccctttacgttaacgcccgtaacggacccgtaggcccttacccggtccccgtcggttacctttcccgtccgttcccgttttccccnccccgttccctaccttaacctacgttacttacgngtaaccggggtcgtacccggggtntaccggggtcggtaaccgcgaccgtaacgtgatannngcnnnnnntn

SEQ ID NO: 118307 - DNA, 250 bp, Homo sapiens
  misc_feature: GYAE6OF01C3BMX.36.47.E03.1.454.CMB.1.raw
  modified_base (247)..(250): a, c, t, g, unknown or other
  misc_feature (247)..(250): n is a, c, g, or t
tcagtacgctgtctcacgaccggtgctcgatttagactcgcgcacagagagaaggggactactctaattggttcggcccctggggccagggaaccctggtcaccgtctcctcagcctccaccaagggcccatcggtcttcccctggcaccctcctccaagagcacctctgggggcacagcggccctgggctgcctggtcaaggactacttccagacaggtactgagcgggctggcaaggcgcatagnnnn

SEQ ID NO: 118308 - DNA, 252 bp, Homo sapiens
  misc_feature: GYAE6OF01C8VFO.36.47.E03.1.454.CMB.1.raw
  modified_base (248)..(252): a, c, t, g, unknown or other
  misc_feature (248)..(252): n is a, c, g, or t
tcagtacgctgtctcacgaccggtgctcgatttagactcgcgcacagagagaaggggactactctaattggttcggcccctggggccagggaaccctggtcaccgtctcctcagcctccaccaagggcccatcggtcttcccctggcaccctcctccaagagcacctctgggggcacagcggccctgggctgcctggtcaaggactacttccagacagcgtactgagcgggctggcaaggcgcatagnnnnn

SEQ ID NO: 118309 - DNA, 261 bp, Homo sapiens
  misc_feature: GYAE6OF01D6GHB.36.47.E03.1.454.CMB.1.raw
  modified_base (248)..(261): a, c, t, g, unknown or other
  misc_feature (248)..(261): n is a, c, g, or t
tcagtacgctgtctcacgaccggtgctcgatttagactcgcgcacagagagaaggggactactctaattggttcggcccctggggccagggaaccctggtcaccgtctcctcagcctccaccaaggcccatcggtcttccccctggcaccctcctccaagagcacctctgggggcacagcggccctgggctgcctggtcaaggactacttccagacagcgtactgagcgggctggcaaggcgcatagnnnnnnnnnnnnnn

SEQ ID NO: 118310 - DNA, 250 bp, Homo sapiens
  misc_feature: GYAE6OF01C9M14.36.47.E03.1.454.CMB.1.raw
  modified_base (248)..(250): a, c, t, g, unknown or other
  misc_feature (248)..(250): n is a, c, g, or t
tcagtacgctgtctcacgaccggtgctcgatttagactcgcgcacagagagaaggggactactctaattggttcggcccctggggccagggaaccctggtcaccgtctcctcagcctccaccaagggcccatcggtcttcccctggcaccctcctccaagagcacctctgggggcacagcggccctgggctgcctggtcaaggactacttccagacagcgtactgagcgggctggcaaggcgcatagnnn

SEQ ID NO: 118311 - DNA, 252 bp, Homo sapiens
  misc_feature: GYAE6OF01DCJ95.36.47.E03.1.454.CMB.1.raw
  modified_base (247)..(252): a, c, t, g, unknown or other
  misc_feature (247)..(252): n is a, c, g, or t
tcagtacgctgtctcacgaccggtgctcgatttagactcgcgcacagagagaaggggactactctaattggttcggcccctgggccagggaaccctggtcaccgtctcctcagcctccaccaagggcccatcggtcttcccctggcaccctcctccaagagcacctctgggggcacagcggccctgggctgcctggtcaaggactacttccagacagcgtactgagcgggctggcaaggcgcatagnnnnnn

SEQ ID NO: 118312 - DNA, 258 bp, Homo sapiens
  misc_feature: GYAE6OF01A4TPV.36.47.E03.1.454.CMB.1.raw
  modified_base (248)..(258): a, c, t, g, unknown or other
  misc_feature (248)..(258): n is a, c, g, or t
tcagtacgctgtctcacgaccggtgctcgatttagactcgcgcacagagagaaggggactactctaattggttcggcccctggggccagggaaccctggtcaccgtctcctcagcctccaccaagggcccatcggtcttcccctggcaccctcctccaagagcacctctgggggcacagcggccctgggctgcctggtcaaggactacttccagacagcgtactgagcgggctggcaaggcgcatagnnnnnnnnnnn

SEQ ID NO: 118313 - DNA, 253 bp, Homo sapiens
  misc_feature: GYAE6OF01DU0AH.36.47.E03.1.454.CMB.1.raw
  modified_base (249)..(253): a, c, t, g, unknown or other
  misc_feature (249)..(253): n is a, c, g, or t
tcagtacgctgtctcacgaccggtgctcgatttagactcgcgcacagagagaaggggactactctaattggttcggcccctggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnnn

SEQ ID NO: 118314 - DNA, 257 bp, Homo sapiens
  misc_feature: GYAE6OF01C7N05.36.47.E03.1.454.CMB.1.raw
  modified_base (249)..(257): a, c, t, g, unknown or other
  misc_feature (249)..(257): n is a, c, g, or t
tcagtacgctgtctcacgaccggtgctcgatttagactcgcgcacagagagaaggggactactctaattggttcggcccctggggccagggaaccctggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnnnnnnn

SEQ ID NO: 118315 - DNA, 263 bp, Homo sapiens
  misc_feature: GYAE6OF02GCWZF.36.47.E03.1.454.CMB.1.raw
  modified_base (250)..(263): a, c, t, g, unknown or other
  misc_feature (250)..(263): n is a, c, g, or t
tcagtacgctgtctcacgaccggtgctcgatttagactcgcgcacagagaggaaggggactactctaattggttcggcccctggggccagggaaccctggtcaccgtctcctcagcctccaccaagggcccatcggtcttccccgtggcaccctcctccaagagcacctctgggggcacagcggccctgggctgcctggtcaaggactacttccagacagcgtactgagcgggctggcaaggcgcatagnnnnnnnnnnnnnn

SEQ ID NO: 118316 - DNA, 251 bp, Homo sapiens
  misc_feature: GYAE6OF02HYWSL.36.47.E03.1.454.CMB.1.raw
  modified_base (247)..(251): a, c, t, g, unknown or other
  misc_feature (247)..(251): n is a, c, g, or t
tcagtacgctgtctcacgaccggtgctcgatttagactcgcgcacagagagaaggggactactctaattggttcggccctggggccagggaaccctggtcaccgtctcctcagcctccaccaagggcccatcggtcttcccctggcaccctcctccaagagcacctctgggggcacagcggccctgggctgcctggtcaaggactacttccagacagcgtactgagcgggctggcaaggcgcatagnnnnn

SEQ ID NO: 118317 - DNA, 269 bp, Homo sapiens
  misc_feature: GYAE6OF02HG7AZ.36.47.E03.1.454.CMB.1.raw
  modified_base (252)..(269): a, c, t, g, unknown or other
  misc_feature (252)..(269): n is a, c, g, or t
tcagtacgctgtctcacgaccggtgctcgatttagactcgcgcacgagagagaaggggactactctaattggttcggcccctggggccagggaaccctggtcaccgtctcctcagcctccaccaagggcccatcggtcttcccctggtcaccctcctccaagagtcacctctgggggcacagcggccctgggctgcctggtcaaggactacttccagacaggcgtactgagcgggctggcaaggcgcatagnnnnnnnnnnnnnnnnnn

SEQ ID NO: 118318 - DNA, 153 bp, Homo sapiens
  misc_feature: GYAE6OF01CF4PD.29.60.F05.1.454.CMB.1.raw
  modified_base (152)..(153): a, c, t, g, unknown or other
  misc_feature (152)..(153): n is a, c, g, or t
tcagatagagtactcacgaccggtgctcgatttagtacgtcatcagggaaagggaccaaggtggaagtcaaaggaactgtggctgcaccatctgtcttcatcttcccgccatctgatatgtatactctgagcgggctggcaaggcgcatagnn

SEQ ID NO: 118319 - DNA, 407 bp, Homo sapiens
  misc_feature: GYAE6OF01CAMJ0.29.60.F05.1.454.CMB.1.raw
  modified_base (402)..(407): a, c, t, g, unknown or other
  misc_feature (402)..(407): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgatcgtagcactctgagcgggctggcaaggcgcatagnnnnnn

SEQ ID NO: 118320 - DNA, 159 bp, Homo sapiens
  misc_feature: GYAE6OF01C593Q.29.60.F05.1.454.CMB.1.raw
  modified_base (152)..(159): a, c, t, g, unknown or other
  misc_feature (152)..(159): n is a, c, g, or t
tcagatagagtactcacgaccggtgctcgatttagtacgtcatcagggaaagggaccaaggtggaagtcaaaggaactgtggctgcaccatctgtcttcatcttcccgccatctgatatgtatactctgagcgggctggcaaggcgcatagnnnnnnnn

SEQ ID NO: 118321 - DNA, 161 bp, Homo sapiens
  misc_feature: GYAE6OF01DV1NY.29.60.F05.1.454.CMB.1.raw
  modified_base (153)..(161): a, c, t, g, unknown or other
  misc_feature (153)..(161): n is a, c, g, or t
tcagatagagtactcacgaccggtgctcgatttagtacgtcatcagggaaagggaccgaaggtggaagtcaaaggaactgtggctgcaccatctgtcttcatcttcccgccatctgatctctcgactctgagcgggctggcaaggcgcatagnnnnnnnnn

SEQ ID NO: 118322 - DNA, 154 bp, Homo sapiens
  misc_feature: GYAE6OF01D8GG2.29.60.F05.1.454.CMB.1.raw
  modified_base (152)..(154): a, c, t, g, unknown or other
  misc_feature (152)..(154): n is a, c, g, or t
tcagatagagtactcacgaccggtgctcgatttagtacgtcatcagggaaagggaccaaggtggaagtcaaaggaactgtggctgcaccatctgtcttcatcttcccgccatctgatctctcgactctgagcgggctggcaaggcgcatagnnn

SEQ ID NO: 118323 - DNA, 404 bp, Homo sapiens
  misc_feature: GYAE6OF01D1K1J.29.60.F05.1.454.CMB.1.raw
  modified_base (400)..(404): a, c, t, g, unknown or other
  misc_feature (400)..(404): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcaccatctgtcttcatcttccgcatctgatcgtagcactctgagcgggctggcaaggcgcatagnnnnn

SEQ ID NO: 118324 - DNA, 154 bp, Homo sapiens
  misc_feature: GYAE6OF01D3V22.29.60.F05.1.454.CMB.1.raw
  modified_base (152)..(154): a, c, t, g, unknown or other
  misc_feature (152)..(154): n is a, c, g, or t
tcagatagagtactcacgaccggtgctcgatttagtacgtcatcagggaaagggaccaaggtggaagtcaaaggaactgtggctgcaccatctgtcttcatcttcccgccatctgatatgtatactctgagcgggctggcaaggcgcatagnnn

SEQ ID NO: 118325 - DNA, 154 bp, Homo sapiens; identical to SEQ ID NO: 118324
  misc_feature: GYAE6OF01A8FN7.29.60.F05.1.454.CMB.1.raw
  modified_base (152)..(154): a, c, t, g, unknown or other
  misc_feature (152)..(154): n is a, c, g, or t

SEQ ID NO: 118326 - DNA, 152 bp, Homo sapiens
  misc_feature: GYAE6OF01CX0YB.29.60.F05.1.454.CMB.1.raw
  modified_base (152)..(152): a, c, t, g, unknown or other
  misc_feature (152)..(152): n is a, c, g, or t
tcagatagagtactcacgaccggtgctcgatttagtacgtcatcagggaaagggaccaaggtggaagtcaaaggaactgtggctgcaccatctgtcttcatcttcccgccatctgatctctcgactctgagcgggctggcaaggcgcatagn

SEQ ID NO: 118327 - DNA, 409 bp, Homo sapiens
  misc_feature: GYAE6OF01CURXI.29.60.F05.1.454.CMB.1.raw
  modified_base (398)..(409): a, c, t, g, unknown or other
  misc_feature (398)..(409): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtctcatcttccgcatctgatcgtagcactctgagcggctggcaaggcgcatagnnnnnnnnnnnn

SEQ ID NO: 118328 - DNA, 407 bp, Homo sapiens
  misc_feature: GYAE6OF01AXLHE.29.60.F05.1.454.CMB.1.raw
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (399)..(407): a, c, t, g, unknown or other
  misc_feature (399)..(407): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagtttcatctccgacgttcggccaagggaccaaggtggaaatcaaacgactgtggctgcacatctgtcttcatctcccgcatctgatcgtagcactctgagcggntggcaagggcnatagnnnnnnnnn

SEQ ID NO: 118329 - DNA, 412 bp, Homo sapiens
  misc_feature: GYAE6OF01D9ML2.29.60.F05.1.454.CMB.1.raw
  modified_base (405)..(412): a, c, t, g, unknown or other
  misc_feature (405)..(412): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaaacgaactgtggctgcaccatctgtcttcatcttcccgccatctgatcgtagcactctgagcgggctggcaagggcgcatagnnnnnnnn

SEQ ID NO: 118330 - DNA, 152 bp, Homo sapiens
  misc_feature: GYAE6OF01DVCW4.29.60.F05.1.454.CMB.1.raw
  modified_base (152)..(152): a, c, t, g, unknown or other
  misc_feature (152)..(152): n is a, c, g, or t
tcagatagagtactcacgaccggtgctcgatttagtacgtcatcagggaaagggaccaaggtggaagtcaaaggaactgtggctgcaccatctgtcttcatcttcccgccatctgatatgtatactctgagcgggctggcaaggcgcatagn

SEQ ID NO: 118331 - DNA, 428 bp, Homo sapiens
  misc_feature: GYAE6OF01D4RYN.29.60.F05.1.454.CMB.1.raw
  modified_base (335)..(335): a, c, t, g, unknown or other
  misc_feature (335)..(335): n is a, c, g, or t
  modified_base (404)..(428): a, c, t, g, unknown or other
  misc_feature (404)..(428): n is a, c, g, or t
tcagatagagtactcacgaccggtgctcgatttagtacgtcatcagggaaagggccgaccctcgtcttggtagggccagtcagagtgttagcagcaactacttagcctggtaccagcagacacctggccaggctcccaggctcctcatccatggtgctatccaccagggcctaactggcatcccagacaggttcagtggcaggtggggtcgtggggacaggacttcgagttctcaccatcagcagactggagcctgaagattttgctagtgtattactgtcagcagtacggtagtcatctcgacgttcggcagggccaggtgaatcaaagactgnggctgcacatctgtcttcatctcccgcatctgatcgtagcactctgagcgggctggcaaggcgcatagnnnnnnnnnnnnnnnnnnnnnnnnn

SEQ ID NO: 118332 - DNA, 409 bp, Homo sapiens
  misc_feature: GYAE6OF01CWBGW.29.60.F05.1.454.CMB.1.raw
  modified_base (401)..(409): a, c, t, g, unknown or other
  misc_feature (401)..(409): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatctatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcattcttcccgcatctgatcgtagcactctgagcggctggacaggcgcatagnnnnnnnnn

SEQ ID NO: 118333 - DNA, 409 bp, Homo sapiens
  misc_feature: GYAE6OF01EE4VO.29.60.F05.1.454.CMB.1.raw
  modified_base (377)..(377): a, c, t, g, unknown or other
  misc_feature (377)..(377): n is a, c, g, or t
  modified_base (396)..(396): a, c, t, g, unknown or other
  misc_feature (396)..(396): n is a, c, g, or t
  modified_base (402)..(409): a, c, t, g, unknown or other
  misc_feature (402)..(409): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctgaagattttgcagtgtattactgtcagcagtacggtagttcatctccgacgttcggccaagggaccaaggtgaaatcaaaacgactgtggctgcacatctgtcttcatcctcccgcatctgatcgtagccactntgacgcgggctggcaggcncatagnnnnnnnn

SEQ ID NO: 118334 - DNA, 419 bp, Homo sapiens
  misc_feature: GYAE6OF01B31RG.29.60.F05.1.454.CMB.1.raw
  modified_base (410)..(419): a, c, t, g, unknown or other
  misc_feature (410)..(419): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctgaagtattttgctagtgtattactgtcagcaggtacggtagttcatctccgacgttcggaccaagggaccaaggtggaaatacaaacgaactgtggctgcaccatctgtcttcatcctccgcatctgatcgagcactctggagcgggctggacgaaggcgacatagnnnnnnnnnn

SEQ ID NO: 118335 - DNA, 405 bp, Homo sapiens
  misc_feature: GYAE6OF01D4S22.29.60.F05.1.454.CMB.1.raw
  modified_base (399)..(405): a, c, t, g, unknown or other
  misc_feature (399)..(405): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtctcatcttccgcatctgatcgtagcactctgagcgggctggcaaggcgcatagnnnnnnn

SEQ ID NO: 118336 - DNA, 408 bp, Homo sapiens
  misc_feature: GYAE6OF01BICI4.29.60.F05.1.454.CMB.1.raw
  modified_base (402)..(408): a, c, t, g, unknown or other
  misc_feature (402)..(408): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcatcatctgtcttcatcttcccgcatctgatcgtagcactctgagcgggctggcaaggcgcatagnnnnnnn

SEQ ID NO: 118337 - DNA, 457 bp, Homo sapiens
  misc_feature: GYAE6OF01ADK0N.29.60.F05.1.454.CMB.1.raw
  modified_base (445)..(457): a, c, t, g, unknown or other
  misc_feature (445)..(457): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcactcccaccgagggccacgtggcactcccagactaggttcaggtggcaggtgggtcgtgggacagtacttcattctcaccatcagcagacgtggacgtccgtagaagtattttgctagtgtattactgtcagctagtacggtagttcatcctccgtacggttcggaccgaagggaccaagggtagaaatacaaacgaactggtggctgcacatctgtctcactccttcccgctatctagtactcgtagctactcgtggaggcgggtctggacgaacgggccgacgagtagnnnnnnnnnnnnn

SEQ ID NO: 118338 - DNA, 174 bp, Homo sapiens
  misc_feature: GYAE6OF01C2D83.29.60.F05.1.454.CMB.1.raw
  modified_base (150)..(150): a, c, t, g, unknown or other
  misc_feature (150)..(150): n is a, c, g, or t
  modified_base (155)..(174): a, c, t, g, unknown or other
  misc_feature (155)..(174): n is a, c, g, or t
tcagatagagtactcacgaccggtgctcgatttagtacgtcatcagggaaagggaccgaaggtggaagtcaaaggaactggtggctgcaccatctgtcttcactcttcccgcatctgatctctcgactctgagcgggctggacaaggcgnatagnnnnnnnnnnnnnnnnnnnn

SEQ ID NO: 118339 - DNA, 451 bp, Homo sapiens
  misc_feature: GYAE6OF01B61W0.29.60.F05.1.454.CMB.1.raw
  modified_base (416)..(416): a, c, t, g, unknown or other
  misc_feature (416)..(416): n is a, c, g, or t
  modified_base (419)..(420): a, c, t, g, unknown or other
  misc_feature (419)..(420): n is a, c, g, or t
  modified_base (422)..(451): a, c, t, g, unknown or other
  misc_feature (422)..(451): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgctatccaccagggcctactggcatcccagacagggttcagtggcaggtgggtctggggacagacttcgattctcaccgatcagcagactggagcctgaagattttgcagtgtattactgtcagcagtacggtatcatctccgacgttcggcctaagggaccaaggtggaaatcaaaacgactgtggctgacacatctagtcttcattctcccgcctatctgactcgtagctactctgacgcgggctaggacaaggctcatagntannannnnnnnnnnnnnnnnnnnnnnnnnnnnnn

SEQ ID NO: 118340 - DNA, 186 bp, Homo sapiens
  misc_feature: GYAE6OF01ESSH1.29.60.F05.1.454.CMB.1.raw
  modified_base (158)..(186): a, c, t, g, unknown or other
  misc_feature (158)..(186): n is a, c, g, or t
tcagatagagtactcacgaccggtgctcgatttagtacgtcatcagggaaaggggaccaaggtgggaagtcaaagggaactgtggctgcaccgaatctgtcttcatcttcccgccatctgatactgtatactctgagcgggctggcaaggcgcatagnnnnnnnnnnnnnnnnnnnnnnnnnnnnn

SEQ ID NO: 118341 - DNA, 500 bp, Homo sapiens
  misc_feature: GYAE6OF01A6ST4.29.60.F05.1.454.CMB.1.raw
  modified_base (463)..(464): a, c, t, g, unknown or other
  misc_feature (463)..(464): n is a, c, g, or t
  modified_base (466)..(466): a, c, t, g, unknown or other
  misc_feature (466)..(466): n is a, c, g, or t
  modified_base (469)..(473): a, c, t, g, unknown or other
  misc_feature (469)..(473): n is a, c, g, or t
  modified_base (475)..(479): a, c, t, g, unknown or other
  misc_feature (475)..(479): n is a, c, g, or t
  modified_base (481)..(481): a, c, t, g, unknown or other
  misc_feature (481)..(481): n is a, c, g, or t
  modified_base (483)..(493): a, c, t, g, unknown or other
  misc_feature (483)..(493): n is a, c, g, or t
  modified_base (495)..(500): a, c, t, g, unknown or other
  misc_feature (495)..(500): n is a, c, g, or t
tcagatagagtactcacgaccggtgctcgatttagtacgtcatcaggggaaagggccaccctctcttgtagggccaagtcagagtgttagcagcaactacttagcctggtaccagcagacacctggccaggctcccaggctcctcatccatggtgcatccacagggccactggcatcccagacaggttcagtggcagtgggtctgggacagacttcattctcaccatcagcaggactggacgcctgaagtacttttggacgtaggtgttaattacgtggtacagtctaaggtacggtagttcatcctaccgtacgttccggaccgaagggaccaagggtagaaatacaaacgtaactgtggactagacacctatctcgtcttcactccgtcccgctatctacgtacgtcgtacgcctacgtcgtaggacggtcgggtctagggacaagggtcgacgagtacgnngntgnnnnntnnnnngngnnnnnnnnnnncnnnnnn

SEQ ID NO: 118342 - DNA, 154 bp, Homo sapiens; identical to SEQ ID NO: 118324
  misc_feature: GYAE6OF01AO5SH.29.60.F05.1.454.CMB.1.raw
  modified_base (152)..(154): a, c, t, g, unknown or other
  misc_feature (152)..(154): n is a, c, g, or t

SEQ ID NO: 118343 - DNA, 415 bp, Homo sapiens
  misc_feature: GYAE6OF01E4VB4.29.60.F05.1.454.CMB.1.raw
  modified_base (405)..(415): a, c, t, g, unknown or other
  misc_feature (405)..(415): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcaccatctgtcttcatcttcccgcatctgatcgtagcactctgagcgggctggcaaggcgcatagnnnnnnnnnnn

SEQ ID NO: 118344 - DNA, 153 bp, Homo sapiens; identical to SEQ ID NO: 118318
  misc_feature: GYAE6OF01DBQKQ.29.60.F05.1.454.CMB.1.raw
  modified_base (152)..(153): a, c, t, g, unknown or other
  misc_feature (152)..(153): n is a, c, g, or t

SEQ ID NO: 118345 - DNA, 404 bp, Homo sapiens
  misc_feature: GYAE6OF01D8FIN.29.60.F05.1.454.CMB.1.raw
  modified_base (327)..(327): a, c, t, g, unknown or other
  misc_feature (327)..(327): n is a, c, g, or t
  modified_base (396)..(404): a, c, t, g, unknown or other
  misc_feature (396)..(404): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagtcatctccgacgttcggccaaggaccaaggtgaaatcaaacgactgngctgcacatctgtcttcatcctcccgctactctgatcgtagcatctgagcggctggacaaggcacatgnnnnnnnnn

SEQ ID NO: 118346 - DNA, 415 bp, Homo sapiens
  misc_feature: GYAE6OF01C4MWY.29.60.F05.1.454.CMB.1.raw
  modified_base (398)..(398): a, c, t, g, unknown or other
  misc_feature (398)..(398): n is a, c, g, or t
  modified_base (404)..(415): a, c, t, g, unknown or other
  misc_feature (404)..(415): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaaacgaactgtaggctgcacatctgtcttcatccttccgccatctgatcgtagcactctgagcggctggcaagggcncatagnnnnnnnnnnnn

SEQ ID NO: 118347 - DNA, 405 bp, Homo sapiens
  misc_feature: GYAE6OF01DZG2G.29.60.F05.1.454.CMB.1.raw
  modified_base (239)..(239): a, c, t, g, unknown or other
  misc_feature (239)..(239): n is a, c, g, or t
  modified_base (389)..(389): a, c, t, g, unknown or other
  misc_feature (389)..(389): n is a, c, g, or t
  modified_base (395)..(405): a, c, t, g, unknown or other
  misc_feature (395)..(405): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacgtagtcatctcgacgttcggccaagggaccaaggtgaaatcaaacgactgtggctgcacatctgtcttcatctccgctatctgatcgtagcactctgagcgggctggcaaggcncatagnnnnnnnnnnn

SEQ ID NO: 118348 - DNA, 406 bp, Homo sapiens
  misc_feature: GYAE6OF01CSF0H.29.60.F05.1.454.CMB.1.raw
  modified_base (400)..(406): a, c, t, g, unknown or other
  misc_feature (400)..(406): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcaccatctgtctcatcttcccgcatctgatcgtagcactctgagcgggctggcaaggcgcatagnnnnnnn

SEQ ID NO: 118349 - DNA, 420 bp, Homo sapiens
  misc_feature: GYAE6OF01DK8ZS.29.60.F05.1.454.CMB.1.raw
  modified_base (239)..(239): a, c, t, g, unknown or other
  misc_feature (239)..(239): n is a, c, g, or t
  modified_base (406)..(420): a, c, t, g, unknown or other
  misc_feature (406)..(420): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggcctaagggaccaaggtgaaatcaaacgaactgtggctgacacatctgtcttcatctcccgcatctgatcgtagcactctgagtcgggctggacaacggcgcgagtagnnnnnnnnnnnnnnn

SEQ ID NO: 118350 - DNA, 408 bp, Homo sapiens
  misc_feature: GYAE6OF01BX6IB.29.60.F05.1.454.CMB.1.raw
  modified_base (401)..(408): a, c, t, g, unknown or other
  misc_feature (401)..(408): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagtcatctccgacgttcggccaagggaccaaggtggaaatcaaacgaactgtgctgcacatctgtcttcatcttcccgctatctgatcgtagctactctgagcgggctggacaggcgcatagnnnnnnnn

SEQ ID NO: 118351 - DNA, 439 bp, Homo sapiens
  misc_feature: GYAE6OF01DAPE6.29.60.F05.1.454.CMB.1.raw
  modified_base (426)..(439): a, c, t, g, unknown or other
  misc_feature (426)..(439): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggctgggacagacttcattctcaccatcagcagactggagcctgaagtattttgctagttgttattactgtcagcagttacggtagttcatctccgcgttcggaccaagggaccaaggtgaaatcaaaacgactgtggctgccactatctgtcttcactccttcccgcctatcctgacttcgtagccacgttcgtggacggcgggcgtgggaccaagggcctcatgnnnnnnnnnnnnnn

SEQ ID NO: 118352 - DNA, 405 bp, Homo sapiens
  misc_feature: GYAE6OF01BWC8B.29.60.F05.1.454.CMB.1.raw
  modified_base (328)..(328): a, c, t, g, unknown or other
  misc_feature (328)..(328): n is a, c, g, or t
  modified_base (396)..(405): a, c, t, g, unknown or other
  misc_feature (396)..(405): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagtcatctcgacgttcgccaagggaccaaggtggaaatcaaacgaactgnggctgcacatctgtctcatcttcccgcatctgatcgtagcactctgagcggctggcaaggcgcatagnnnnnnnnnn

SEQ ID NO: 118353 - DNA, 418 bp, Homo sapiens
  misc_feature: GYAE6OF01DYT6T.29.60.F05.1.454.CMB.1.raw
  modified_base (404)..(418): a, c, t, g, unknown or other
  misc_feature (404)..(418): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaaatcaaaacgaactgtggctgcacatctgtcttcatcttcccgcatctgatcgtagcactctgagcgggctggcaagggcgcatagnnnnnnnnnnnnnnn

SEQ ID NO: 118354 - DNA, 407 bp, Homo sapiens
  misc_feature: GYAE6OF01EWS0K.29.60.F05.1.454.CMB.1.raw
  modified_base (402)..(407): a, c, t, g, unknown or other
  misc_feature (402)..(407): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgtttcggccaagggaccaaggtggaaatcaaacgaactgtggctgcacatctgtcttcatctcccgcatctgatcgtagcactctgagcgggctggcaagggcgcatagnnnnnn

SEQ ID NO: 118355 - DNA, 406 bp, Homo sapiens
  misc_feature: GYAE6OF01BKCGF.29.60.F05.1.454.CMB.1.raw
  modified_base (385)..(385): a, c, t, g, unknown or other
  misc_feature (385)..(385): n is a, c, g, or t
  modified_base (394)..(394): a, c, t, g, unknown or other
  misc_feature (394)..(394): n is a, c, g, or t
  modified_base (400)..(406): a, c, t, g, unknown or other
  misc_feature (400)..(406): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgcatctgatcgtagcactctgagcgggntggcaggcncatagnnnnnnn

SEQ ID NO: 118356 - DNA, 408 bp, Homo sapiens
  misc_feature: GYAE6OF01E1VAD.29.60.F05.1.454.CMB.1.raw
  modified_base (394)..(394): a, c, t, g, unknown or other
  misc_feature (394)..(394): n is a, c, g, or t
  modified_base (399)..(408): a, c, t, g, unknown or other
  misc_feature (399)..(408): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgagttcggccaagggaccaaggtggaaatcaaaacgactgtggctgcaccatctgtcttcatcttcccgcatctgatcgagcactctgagcggctggacaaggcanatagnnnnnnnnnn

SEQ ID NO: 118357 - DNA, 418 bp, Homo sapiens
  misc_feature: GYAE6OF01BGAOI.29.60.F05.1.454.CMB.1.raw
  modified_base (407)..(418): a, c, t, g, unknown or other
  misc_feature (407)..(418): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggttcctcatccatggtgcatccaccagggccactggcatcccagacaggttcagtggcagtgggtctggggacagacttcattctcaccatcagcagactggagcctgaagattttgcagtgtattactgtcagcagtacggtatcatctccgacgttcggccaagggaccaaggtgaaatcaaacgactgtggctgacaccatctgtcttcatccttcccgcctatcctgactcgtagccactctgagcgggctggacaaggcgcatagnnnnnnnnnnnn

SEQ ID NO: 118358 - DNA, 412 bp, Homo sapiens
  misc_feature: GYAE6OF01A0SNU.29.60.F05.1.454.CMB.1.raw
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (405)..(412): a, c, t, g, unknown or other
  misc_feature (405)..(412): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagtttcatctccgacgtttcggccaagggaccaaggtggaaatcaaacgaactgtgctgcaccatctgtcttnatcttcccgccatctgatcgtancactctgngcgggctggcaagggcgcatagnnnnnnnn

SEQ ID NO: 118359 - DNA, 152 bp, Homo sapiens; identical to SEQ ID NO: 118330
  misc_feature: GYAE6OF01BR9YH.29.60.F05.1.454.CMB.1.raw
  modified_base (152)..(152): a, c, t, g, unknown or other
  misc_feature (152)..(152): n is a, c, g, or t

SEQ ID NO: 118360 - DNA, 155 bp, Homo sapiens
  misc_feature: GYAE6OF01CNS36.29.60.F05.1.454.CMB.1.raw
  modified_base (152)..(155): a, c, t, g, unknown or other
  misc_feature (152)..(155): n is a, c, g, or t
tcagatagagtactcacgaccggtgctcgatttagtacgtcatcagggaaagggaccaaggtggaagtcaaaggaactgtggctgcaccatctgtcttcatcttcccgccatctgatatgtatactctgagcgggctggcaaggcgcatagnnnn

SEQ ID NO: 118361 - DNA, 617 bp, Homo sapiens
  misc_feature: GYAE6OF01ET8MI.29.60.F05.1.454.CMB.1.raw
  modified_base (589)..(589): a, c, t, g, unknown or other
  misc_feature (589)..(589): n is a, c, g, or t
  modified_base (591)..(617): a, c, t, g, unknown or other
  misc_feature (591)..(617): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtcgtcggtaggacgacgttccttacttactttcctaccaacctactacgacgacgacgtacggtaggaccgtccgtaaggaagttttagtttcgacgttaggttatttaactttacgttgtacgacgacgtaacgggttaacggttacgttactacgttcccggtaccggttaccgggtacccggaaccgggtaaaccgggaaccggtaagggtaaagtaaacgtaaaccgaaaacgtaacgtggtacgcgtacgacctaactctcgtacgtttacctacttaccttcccgtaccccgacttacttcgtagttacgttccggtaccaccttcgttagtagggaccgggtcccggttagccggaaacgggacgggccctaagtaaggtgngnnnnnnnnnnnnnnnnnnnnnnnnnnn

SEQ ID NO: 118362 - DNA, 153 bp, Homo sapiens
  misc_feature: GYAE6OF01CWVFL.29.60.F05.1.454.CMB.1.raw
  modified_base (152)..(153): a, c, t, g, unknown or other
  misc_feature (152)..(153): n is a, c, g, or t
tcagatagagtactcacgaccggtgctcgatttagtacgtcatcagggaaagggaccaaggtggaagtcaaaggaactgtggctgcaccatctgtcttcatcttcccgccatctgatctctcgactctgagcgggctggcaaggcgcatagnn

SEQ ID NO: 118363 - DNA, 428 bp, Homo sapiens
  misc_feature: GYAE6OF01CEJW9.29.60.F05.1.454.CMB.1.raw
  modified_base (239)..(239): a, c, t, g, unknown or other
  misc_feature (239)..(239): n is a, c, g, or t
  modified_base (412)..(414): a, c, t, g, unknown or other
  misc_feature (412)..(414): n is a, c, g, or t
  modified_base (416)..(428): a, c, t, g, unknown or other
  misc_feature (416)..(428): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtgaaatcaaacgaactgtggctgcacatctgtcttcatcctcccgctatctgtactcgtacgctactctggacgcgggctgggcgacgggcgacagtagnnngnnnnnnnnnnnnn

SEQ ID NO: 118364 - DNA, 426 bp, Homo sapiens
  misc_feature: GYAE6OF01C1RML.29.60.F05.1.454.CMB.1.raw
  modified_base (240)..(240): a, c, t, g, unknown or other
  misc_feature (240)..(240): n is a, c, g, or t
  modified_base (330)..(330): a, c, t, g, unknown or other
  misc_feature (330)..(330): n is a, c, g, or t
  modified_base (411)..(426): a, c, t, g, unknown or other
  misc_feature (411)..(426): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacncctgaagtatttgcagtgtattactgtcagcagtacggtagttcatctccgacgttcgcgaaggaccaaggtagaatacgaaacgactgngctgacacatctgtctcatctccgctatctgtatcgtagctactcgtgacggcgggtctggacgaacggcgtacaagtagnnnnnnnnnnnnnnnn

SEQ ID NO: 118365 - DNA, 407 bp, Homo sapiens
  misc_feature: GYAE6OF01BA618.29.60.F05.1.454.CMB.1.raw
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (401)..(407): a, c, t, g, unknown or other
  misc_feature (401)..(407): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgcagtgtattactgtcagcagtacggtagttcatctccgacgttcggcaagggaccaaggtggaaatcaaacgactgtgctgcacatctgtcttcacttcctcccgcatctgatcgtancactcgtgagcggtcnggcagggcnatagnnnnnnn

SEQ ID NO: 118366 - DNA, 503 bp, Homo sapiens
  misc_feature: GYAE6OF01D04VN.29.60.F05.1.454.CMB.1.raw
  modified_base (401)..(401): a, c, t, g, unknown or other
  misc_feature (401)..(401): n is a, c, g, or t
  modified_base (416)..(416): a, c, t, g, unknown or other
  misc_feature (416)..(416): n is a, c, g, or t
  modified_base (481)..(503): a, c, t, g, unknown or other
  misc_feature (481)..(503): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcaggtgcaggtgggtctgggacagacttcattctcaccatcagcagactggactcctagaacgttagttttgctagttgttattacctgtcaagctaaggttacgggttattcacgttcttcccggacgtttccggaccgtaaagggacctaagggtggaaaactacgaaacgacgtggtacggtcctgaccgacctagttctcgttccgttanactttccctacccgntacgttcagtaactcgtacgctacttcagggaggccggagtcggaacacggggtcacgtatgcannnnnnnnnnnnnnnnnnnnnnn

SEQ ID NO: 118367 - DNA, 409 bp, Homo sapiens
  misc_feature: GYAE6OF01B7FHI.29.60.F05.1.454.CMB.1.raw
  modified_base (239)..(239): a, c, t, g, unknown or other
  misc_feature (239)..(239): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (392)..(392): a, c, t, g, unknown or other
  misc_feature (392)..(392): n is a, c, g, or t
  modified_base (398)..(409): a, c, t, g, unknown or other
  misc_feature (398)..(409): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtggaaatcaaaacgaactgtggctgcacatngtcttcatctcccncatctgntcgtnacnctctgagcggctggcaggcncatagnnnnnnnnnnnn

SEQ ID NO: 118368 - DNA, 468 bp, Homo sapiens
  misc_feature: GYAE6OF01ABSNG.29.60.F05.1.454.CMB.1.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (350)..(350): a, c, t, g, unknown or other
  misc_feature (350)..(350): n is a, c, g, or t
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (444)..(444): a, c, t, g, unknown or other
  misc_feature (444)..(444): n is a, c, g, or t
  modified_base (465)..(465): a, c, t, g, unknown or other
  misc_feature (465)..(465): n is a, c, g, or t
tcagatagagtactcacgaccggtgctcgatttagtacgtcatcagggaagggccaccctctcttgtaggccagtcagagtgttagcagcaactacttagcctggtaccagcagacacctggccaggctccaggctcctcatccatggtgcatccaccagggcccactggcatcccagacaggttcaggtggcagtggtctgggacagacttcattcncaccatcagcagactggancctgaagattttgctagtgtattactgtcagcagtacggtattcatctccgacgttcggaccaagggaccaagggtggaaatcgaaacgactgtgactgcaccatctgtcttnatcctccgcatctgatcgtagcactcngagcgggctgggactagggcncatagangtcngntagcagtcgctagcagcgagcgttgacgttagnatcggattcagcagctgctgntcg

SEQ ID NO: 118369 - DNA, 421 bp, Homo sapiens
  misc_feature: GYAE6OF01AZAVM.29.60.F05.1.454.CMB.1.raw
  modified_base (341)..(341): a, c, t, g, unknown or other
  misc_feature (341)..(341): n is a, c, g, or t
  modified_base (372)..(372): a, c, t, g, unknown or other
  misc_feature (372)..(372): n is a, c, g, or t
  modified_base (409)..(421): a, c, t, g, unknown or other
  misc_feature (409)..(421): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacactttttggccaggggaccaagctggagatcaaacgaactcgtggctncaccatctgtcttcatcttcccgccatctgntcgtagcactctgagcgggctggcaaggcgcatacgnnnnnnnnnnnnn

SEQ ID NO: 118370 - DNA, 407 bp, Homo sapiens
  misc_feature: GYAE6OF01C8D79.29.60.F05.1.454.CMB.1.raw
  modified_base (332)..(332): a, c, t, g, unknown or other
  misc_feature (332)..(332): n is a, c, g, or t
  modified_base (360)..(361): a, c, t, g, unknown or other
  misc_feature (360)..(361): n is a, c, g, or t
  modified_base (381)..(381): a, c, t, g, unknown or other
  misc_feature (381)..(381): n is a, c, g, or t
  modified_base (398)..(407): a, c, t, g, unknown or other
  misc_feature (398)..(407): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagctgagattttgcagtgtattactgtcagcagtacggtagttcatctccgacgttcggccaagggaccaaggtggaaatcaaacgaactgtgcngcacatctgtctcatcttcccgcatctnntcgtagcactctgagcgggntggcaaggcgcagtagnnnnnnnnnn

SEQ ID NO: 118371 - DNA, 153 bp, Homo sapiens
  misc_feature: GYAE6OF01CN2KT.29.60.F05.1.454.CMB.1.raw
  modified_base (150)..(153): a, c, t, g, unknown or other
  misc_feature (150)..(153): n is a, c, g, or t
tcagatagagtactcacgaccggtgctcgatttagtacgtcatcagggaaagggaccaaggtggaagtcaaaggaactgtggctgcaccatctgtcttcatctcccgcatctgatatgtatactctgagcgggctggcaaggcgcatagnnnn

SEQ ID NO: 118372 - DNA, 474 bp, Homo sapiens
  misc_feature: GYAE6OF01BIAVG.29.60.F05.1.454.CMB.1.raw
  modified_base (428)..(428): a, c, t, g, unknown or other
  misc_feature (428)..(428): n is a, c, g, or t
  modified_base (454)..(474): a, c, t, g, unknown or other
  misc_feature (454)..(474): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctagaagtattttgactagtagtaattactgtcagacaggtacggtagtcatcctccggtacgttcggaccaagggaccaaggtaggaaactacgaaaacgaactggtaggctacgacaccatctcgtacttcacttccctcccgaccagtcctgtaacgtcgtacgctactcgtaggacgccgggngtacggacgaacggtcggacatacgnnnnnnnnnnnnnnnnnnnnn

SEQ ID NO: 118373 - DNA, 416 bp, Homo sapiens
  misc_feature: GYAE6OF01EX64T.29.60.F05.1.454.CMB.1.raw
  modified_base (398)..(398): a, c, t, g, unknown or other
  misc_feature (398)..(398): n is a, c, g, or t
  modified_base (403)..(416): a, c, t, g, unknown or other
  misc_feature (403)..(416): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggggacagacttcattctcaccatcagcagactggagcctgaagattttgcagtgtattactgtcagcagtcggtagttcatctccgagttcggccaagggcaaggtggaaatcaaacgaactgtggctgcaccatctgtcttcattcctcccgccatctgtatcgtagcactctgagcgggctggtcaaggcgnatagnnnnnnnnnnnnnn

SEQ ID NO: 118374 - DNA, 435 bp, Homo sapiens
  misc_feature: GYAE6OF01EJ9EB.29.60.F05.1.454.CMB.1.raw
  modified_base (271)..(271): a, c, t, g, unknown or other
  misc_feature (271)..(271): n is a, c, g, or t
  modified_base (419)..(435): a, c, t, g, unknown or other
  misc_feature (419)..(435): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactggagcctgaagtacttttgcagttgtattactgtnagcagtacggtagttcatctccgacgtttcggccaagggaccaaggtggaaatcaaacgaactgtggctgcacatctgtcttcatccttcccgcctatctgactcgtagctaactcgtgagcggtcgtggacaacgggcacgagtagnnnnnnnnnnnnnnnnn

SEQ ID NO: 118375 - DNA, 536 bp, Homo sapiens
  misc_feature: GYAE6OF01BGEJ6.29.60.F05.1.454.CMB.1.raw
  modified_base (365)..(365): a, c, t, g, unknown or other
  misc_feature (365)..(365): n is a, c, g, or t
  modified_base (500)..(500): a, c, t, g, unknown or other
  misc_feature (500)..(500): n is a, c, g, or t
  modified_base (502)..(506): a, c, t, g, unknown or other
  misc_feature (502)..(506): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (518)..(521): a, c, t, g, unknown or other
  misc_feature (518)..(521): n is a, c, g, or t
  modified_base (523)..(528): a, c, t, g, unknown or other
  misc_feature (523)..(528): n is a, c, g, or t
  modified_base (530)..(536): a, c, t, g, unknown or other
  misc_feature (530)..(536): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacgcctagaagtattttgcagtgttattacgtgtcagctagtacggtagttcatctccgacggttccggaccgaagggaccaagggtaggaaactacgaaaacgaacgtcggtaggctcgcaaccgtntcttcggttctttcacttccgttaccccgtccacttcctaggtaacgtttccggtaacgtcctaccttcgtagggacggcccggggtacgttcgggaaccgaacgggtccgtaacgtacgtaacggtcagtctancnnnnngcgcgncncncnnnngnnnnnncnnnnnnn

SEQ ID NO: 118376 - DNA, 411 bp, Homo sapiens
  misc_feature: GYAE6OF01CB3Z1.29.60.F05.1.454.CMB.1.raw
  modified_base (364)..(364): a, c, t, g, unknown or other
  misc_feature (364)..(364): n is a, c, g, or t
  modified_base (400)..(400): a, c, t, g, unknown or other
  misc_feature (400)..(400): n is a, c, g, or t
  modified_base (405)..(411): a, c, t, g, unknown or other
  misc_feature (405)..(411): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcacatctgtctcatcctcccgctatctgntcgtagcctactcgtgacgtcgggctggcagggcanatagnnnnnnn

SEQ ID NO: 118377 - DNA, 473 bp, Homo sapiens
  misc_feature: GYAE6OF01EAQEN.29.60.F05.1.454.CMB.1.raw
  modified_base (456)..(458): a, c, t, g, unknown or other
  misc_feature (456)..(458): n is a, c, g, or t
  modified_base (460)..(473): a, c, t, g, unknown or other
  misc_feature (460)..(473): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacgcctagaagtattttgactaatttattactgtacagctagtaataataactggacccttccgtactacgttttcggaccgacggggaccaagcgtaggagtatacgaaacgaacgtgtggctgcactatctgtcttctacttccttcccgcctactctagtacgttccgtacgctacttcgtggacggcgggtcgtggacgaacggcgactagtagnnngnnnnnnnnnnnnnn

SEQ ID NO: 118378 - DNA, 675 bp, Homo sapiens
  misc_feature: GYAE6OF01EJX4J.29.60.F05.1.454.CMB.1.raw
  modified_base (630)..(630): a, c, t, g, unknown or other
  misc_feature (630)..(630): n is a, c, g, or t
  modified_base (636)..(636): a, c, t, g, unknown or other
  misc_feature (636)..(636): n is a, c, g, or t
  modified_base (643)..(643): a, c, t, g, unknown or other
  misc_feature (643)..(643): n is a, c, g, or t
  modified_base (649)..(649): a, c, t, g, unknown or other
  misc_feature (649)..(649): n is a, c, g, or t
  modified_base (653)..(653): a, c, t, g, unknown or other
  misc_feature (653)..(653): n is a, c, g, or t
  modified_base (655)..(657): a, c, t, g, unknown or other
  misc_feature (655)..(657): n is a, c, g, or t
  modified_base (660)..(661): a, c, t, g, unknown or other
  misc_feature (660)..(661): n is a, c, g, or t
  modified_base (663)..(663): a, c, t, g, unknown or other
  misc_feature (663)..(663): n is a, c, g, or t
  modified_base (665)..(666): a, c, t, g, unknown or other
  misc_feature (665)..(666): n is a, c, g, or t
  modified_base (669)..(674): a, c, t, g, unknown or other
  misc_feature (669)..(674): n is a, c, g, or t
tcagatagagtactcacgaccggtgctcgatttagtacgtcatcagggaaagggccaccctctcttgtagggccagtcagagtgttagcagcaactacttagcctggtaccagcagaccacctggccaggctcccaggctcctcatctatgatgcatccacgaacggccactgatactcccagccgaggttcagtggcaggtcgggtcgtgggactagacgttccacttcctacacctatcacgcacgcctgacgtacgtcgtagtaaacgttattttacggacttaaacttttaacttaaccgttgtaccgtaagtaccgttaagttaaactttaaacgttaaaccggttcgggtaccccgttacccggtttaacccgttaccggtttttaccggggaccccgggtaaacgggggtaaaccctaacggttcgtacgggaaacgtaaccgtaaaccgaaaaaccggtacggttaggtcgggtctacggaccctaaccgtacttaccgttcgttaccttcctaaccgttccccgtacccgtacctacgttacgtacgtacggtccgtaactccgttacgtcggttacggaccgggtcgggtaccgtacggacgtacggcgtagacgtagcngtgacnctgtgcncgacgngcgngnnngcnngncnngtnnnnnnc

SEQ ID NO: 118379 - DNA, 422 bp, Homo sapiens
  misc_feature: GYAE6OF01BN7BG.29.60.F05.1.454.CMB.1.raw
  modified_base (215)..(215): a, c, t, g, unknown or other
  misc_feature (215)..(215): n is a, c, g, or t
  modified_base (240)..(240): a, c, t, g, unknown or other
  misc_feature (240)..(240): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
  modified_base (404)..(422): a, c, t, g, unknown or other
  misc_feature (404)..(422): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgacatccaccagggccactggcatcccagacaggttcagtggcagtggtctgggacagacttnattctcaccatcagcagtactggancctgaagattttgcagtgtattactgtcagcagtacgtagttcattctcgtacgttcggaccaagggaccaaggtggaaatcgaaacgaactgtggctgcaccatctgtcttcatcttcccgcatctgatcgtagccatcngagcggntggcaggcgacatagnnnnnnnnnnnnnnnnnnn

SEQ ID NO: 118380 - DNA, 634 bp, Homo sapiens
  misc_feature: GYAE6OF01CBLIW.29.60.F05.1.454.CMB.1.raw
  modified_base (152)..(152): a, c, t, g, unknown or other
  misc_feature (152)..(152): n is a, c, g, or t
  modified_base (227)..(227): a, c, t, g, unknown or other
  misc_feature (227)..(227): n is a, c, g, or t
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
  modified_base (607)..(608): a, c, t, g, unknown or other
  misc_feature (607)..(608): n is a, c, g, or t
  modified_base (610)..(610): a, c, t, g, unknown or other
  misc_feature (610)..(610): n is a, c, g, or t
  modified_base (612)..(615): a, c, t, g, unknown or other
  misc_feature (612)..(615): n is a, c, g, or t
  modified_base (617)..(618): a, c, t, g, unknown or other
  misc_feature (617)..(618): n is a, c, g, or t
  modified_base (620)..(623): a, c, t, g, unknown or other
  misc_feature (620)..(623): n is a, c, g, or t
  modified_base (625)..(628): a, c, t, g, unknown or other
  misc_feature (625)..(628): n is a, c, g, or t
  modified_base (630)..(634): a, c, t, g, unknown or other
  misc_feature (630)..(634): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctccaggctcctcatccatggtncactccaccgagggccactggcactcccagacaggttcaggtggcaggtgggtcgtgggacagtacttcattccncacatcagaccagacgtggacgacctaggaagttagttttggactaggttgttaacttacgtgacacgtacgtaggttacggttagtcgtacttccgtaccgtaccggttaccggaaccgtaaagggtaaccgtaaagggttaacgaaacgttaacgaaaaccggtaacgtcgggttacggaccgttaccggacctaacgtaacgtttccttacggtttacctttaactaaccgtttcccgttaccccggaactttacgttcgtacgttaacgttaccggtacgtaccgtaacgtcgtaacgggccgggtaccgggtaccgttagggaccgtaaacgggcccgtacgtaacgtacggcgcganagngacgacgcgtacanngncnnnngnngnnnnannnnannnnn

SEQ ID NO: 118381 - DNA, 450 bp, Homo sapiens
  misc_feature: GYAE6OF01EH1C0.29.60.F05.1.454.CMB.1.raw
  modified_base (371)..(371): a, c, t, g, unknown or other
  misc_feature (371)..(371): n is a, c, g, or t
  modified_base (434)..(450): a, c, t, g, unknown or other
  misc_feature (434)..(450): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagttgtattactgtcagcagtacggtagttcattcctccggacggttcggaccaagggaccaagggtagaaactacaaaacggaactggtggctgacacatctgtcttcactcctccnccattctgactcgtagcctacttcgtggacggcgggtcctgggaccgaagggccgacagtcgnnnnnnnnnnnnnnnnn

SEQ ID NO: 118382 - DNA, 572 bp, Homo sapiens
  misc_feature: GYAE6OF01BBPIH.29.60.F05.1.454.CMB.1.raw
  modified_base (233)..(233): a, c, t, g, unknown or other
  misc_feature (233)..(233): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (544)..(572): a, c, t, g, unknown or other
  misc_feature (544)..(572): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccgacgggccactggccactccccagacgtaggttcaggtggcgaggtgggtcgtggggacagtcttcattcncaccatcagcgagacgtggacgtcctaggaagtattttgctaggttgtaactttactgtacagtcgtaggttacggttagtttacacgttccgtacccgtacggttccgggaccgtaacgggaaccgtaaggtacggaaactacgaaaaccggtaacgtcggtcggacttacggaccaccctaagtcttcggttaccttacctacgtttccccgttcccgtaccctattccgtacgttacgtacgtaccgtcctaccgttcggtacgcgggccggtacgtacgggacgacgggctacgagtagnancagcnnnnnnnnnnnnnnnnnnnnnnnnnnnnn

SEQ ID NO: 118383 - DNA, 459 bp, Homo sapiens
  misc_feature: GYAE6OF01COMUC.29.60.F05.1.454.CMB.1.raw
  modified_base (240)..(240): a, c, t, g, unknown or other
  misc_feature (240)..(240): n is a, c, g, or t
  modified_base (404)..(404): a, c, t, g, unknown or other
  misc_feature (404)..(404): n is a, c, g, or t
  modified_base (424)..(424): a, c, t, g, unknown or other
  misc_feature (424)..(424): n is a, c, g, or t
  modified_base (446)..(459): a, c, t, g, unknown or other
  misc_feature (446)..(459): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagactgganctgaagtattttgcagtgttattactgtcagtcagtacggtagttcatctccggtacgttcggaccgtaagggaccaagggtggaaaatcgaaaacgacgtgtacggctacgactaccgatctgtacttcgacttccgttcccgcctattctacgtatcgtacnctaactcgtaggagccgggntacgggcgtaaggcgacatcgnnnnnnnnnnnnnn

SEQ ID NO: 118384 - DNA, 709 bp, Homo sapiens
  misc_feature: GYAE6OF01DAQLE.29.60.F05.1.454.CMB.1.raw
  modified_base (247)..(247): a, c, t, g, unknown or other
  misc_feature (247)..(247): n is a, c, g, or t
  modified_base (329)..(329): a, c, t, g, unknown or other
  misc_feature (329)..(329): n is a, c, g, or t
  modified_base (627)..(627): a, c, t, g, unknown or other
  misc_feature (627)..(627): n is a, c, g, or t
  modified_base (654)..(654): a, c, t, g, unknown or other
  misc_feature (654)..(654): n is a, c, g, or t
  modified_base (667)..(668): a, c, t, g, unknown or other
  misc_feature (667)..(668): n is a, c, g, or t
  modified_base (672)..(672): a, c, t, g, unknown or other
  misc_feature (672)..(672): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (688)..(690): a, c, t, g, unknown or other
  misc_feature (688)..(690): n is a, c, g, or t
  modified_base (692)..(692): a, c, t, g, unknown or other
  misc_feature (692)..(692): n is a, c, g, or t
  modified_base (694)..(694): a, c, t, g, unknown or other
  misc_feature (694)..(694): n is a, c, g, or t
  modified_base (696)..(697): a, c, t, g, unknown or other
  misc_feature (696)..(697): n is a, c, g, or t
  modified_base (701)..(701): a, c, t, g, unknown or other
  misc_feature (701)..(701): n is a, c, g, or t
  modified_base (704)..(704): a, c, t, g, unknown or other
  misc_feature (704)..(704): n is a, c, g, or t
  modified_base (706)..(706): a, c, t, g, unknown or other
  misc_feature (706)..(706): n is a, c, g, or t
  modified_base (708)..(709): a, c, t, g, unknown or other
  misc_feature (708)..(709): n is a, c, g, or t
tcagatagagtactcacgaccggtgctcgatttagtacgtcatcagggaaaggccaccctctcttgtagggccagtcagagtgttagcagcaactacttagccgtggtaccagcagaccacctggccaggctcccaggctcctcatccatggtgcatccgaccgagggcctactggcactcccgagacgtacggtttcaggtggacgaggtcgggtacgtcgggacaaggtacctttctactttccnccacctatacacgacgttagacgttggacgtaccgtaggtaagttagtttttcgacgttaggttagtttaacgttaccgttntaccggtaagtacgtaacgggtttaaccggtttacgttaccgttaacttacccggttacccggttaaccgggtttacccggggaacccggttaaacggggaacccgtttaaagggtaaacggtaaaccgtacctaaaacggtaaccgttggtcggtacgacgacgtaaccctgtccgttcgttccttacgtaccctttcccgtacccgtcttacggttaccgtagttacgttacgtaccctaagtacccgttacggtaacgggcgggtcccgggttacggaacgggaccggggttaanaccggtaaggtaactaggccttacggngagactgactcgnngacngagacgagngngngannnantnannacanagnantnn

SEQ ID NO: 118385 - DNA, 522 bp, Homo sapiens
  misc_feature: GYAE6OF01CI0NO.29.60.F05.1.454.CMB.1.raw
  modified_base (200)..(200): a, c, t, g, unknown or other
  misc_feature (200)..(200): n is a, c, g, or t
  modified_base (249)..(249): a, c, t, g, unknown or other
  misc_feature (249)..(249): n is a, c, g, or t
  modified_base (446)..(446): a, c, t, g, unknown or other
  misc_feature (446)..(446): n is a, c, g, or t
  modified_base (494)..(494): a, c, t, g, unknown or other
  misc_feature (494)..(494): n is a, c, g, or t
  modified_base (498)..(499): a, c, t, g, unknown or other
  misc_feature (498)..(499): n is a, c, g, or t
  modified_base (501)..(522): a, c, t, g, unknown or other
  misc_feature (501)..(522): n is a, c, g, or t
tcagatagagtactcacgaccggtgctcgatttagtacgtcatcagggaaagggccacccctctcttgtagggccagtcagagtgttagcagcaactacttagcctggtaccagcagacacctggccaggctcccaggctcctcatccatggtgcatcccaccagggcccactggcatccccagactaggttcagtggcnggtgggtctgggacagtacttctattcctccaccatcagcagactggancctgaagtatttgactaggtgtattcgtgtcagtcgtaaggtacggttagtttaccactccgttaccggtaccggttccgggaccggaaacgggaccgtaagggtacggaaaactacgaaaaccgtactggtcggctcgacactatctcgttctactactccctcccgctacttctgtactcgtacgctaccgtcgngggacggtccgggtcgtaccgggacggtaacggccggtaactagtagntcgnngnnnnnnnnnnnnnnnnnnnnnn

SEQ ID NO: 118386 - DNA, 440 bp, Homo sapiens
  misc_feature: GYAE6OF01DUBZI.29.60.F05.1.454.CMB.1.raw
  modified_base (378)..(378): a, c, t, g, unknown or other
  misc_feature (378)..(378): n is a, c, g, or t
  modified_base (414)..(440): a, c, t, g, unknown or other
  misc_feature (414)..(440): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagttacggtagtttcatctccgacgtttcggccaagggaccaaggtcggaaatcaaacgaactgtggctgcaccatctgtcttcactcttcccgcatctgactcgtancactcgtgacgcgggctggacacgggtcgcagtcgnnnnnnnnnnnnnnnnnnnnnnnnnnn

SEQ ID NO: 118387 - DNA, 724 bp, Homo sapiens
  misc_feature: GYAE6OF01ALZWY.29.60.F05.1.454.CMB.1.raw
  modified_base (658)..(658): a, c, t, g, unknown or other
  misc_feature (658)..(658): n is a, c, g, or t
  modified_base (669)..(669): a, c, t, g, unknown or other
  misc_feature (669)..(669): n is a, c, g, or t
  modified_base (678)..(678): a, c, t, g, unknown or other
  misc_feature (678)..(678): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggcctcccaggctcctgatccagtggtagctatcccgaccgagggtcccagtcggcacgtcccaggacgtacggttcaggtggccagggtcgggtccgtgggactacgtaccttacgtactttccacaacctatccgacgacgtacgtaacgtcggacgtccgtaagtaaggttacgttttgaccggtagttacgttagttaccgtgtaccgacggtccgttaaggttaccggttacgttccgtacgttcccgtaccggtacggttccggaaccgtaaccgggtaaccgtaaggtacgtaaacgtaacgtaaacgtacggtacgtcggactacgaccgtactacgtcttcgtaccgtttactacccggttactcccccgtagtactcgtttaaccgtacgttccgtaagtaccttacgtacgtccggacgggtccgggtacgtccgggtaacggtaccggtacgtaacgtacggtaacgtacgcccgttagaccgttagtaaccgcgttaacgtccgcgttaacgttaccncggtactacgngtactccgngtaccgtggccgacgtcgagtccgtagacgtcgagtccgtcgtgcg

SEQ ID NO: 118388 - DNA, 677 bp, Homo sapiens
  misc_feature: GYAE6OF01BLEWQ.29.60.F05.1.454.CMB.1.raw
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
  modified_base (649)..(651): a, c, t, g, unknown or other
  misc_feature (649)..(651): n is a, c, g, or t
  modified_base (653)..(658): a, c, t, g, unknown or other
  misc_feature (653)..(658): n is a, c, g, or t
  modified_base (660)..(661): a, c, t, g, unknown or other
  misc_feature (660)..(661): n is a, c, g, or t
  modified_base (663)..(663): a, c, t, g, unknown or other
  misc_feature (663)..(663): n is a, c, g, or t
  modified_base (665)..(667): a, c, t, g, unknown or other
  misc_feature (665)..(667): n is a, c, g, or t
  modified_base (669)..(669): a, c, t, g, unknown or other
  misc_feature (669)..(669): n is a, c, g, or t
  modified_base (671)..(675): a, c, t, g, unknown or other
  misc_feature (671)..(675): n is a, c, g, or t
  modified_base (677)..(677): a, c, t, g, unknown or other
  misc_feature (677)..(677): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagtacttcattctcaccatcagcagacgtggagtcctaggtaagttagttttgacctagttgttaactttacgttagtacagtcgtaacggttacggttagttacctacgttccgtaccggtaccggtttaccggaacccggaaacggggtaaacccgtaaagggttaagggaaaaacgttaaccgtaaaaaccggtaaaccgttagggtacggggtaccttacggaaccctaaccgtaacgttccgtttcggttacctttaccggttacctttaccccgtttcccccgaacccttacgtttaccgtacggttaccgtacgttaccgacccgtttacgttacccgggtaggtaccccggggtaccggggtccgttaaacggggaccggtaacccggggtaccgtacccggttaaagtgccttcgtcgcgngncngctgannngnnnnnngnnancnnncncnnnnngn

SEQ ID NO: 118389 - DNA, 730 bp, Homo sapiens
  misc_feature: GYAE6OF01DXDSJ.29.60.F05.1.454.CMB.1.raw
  modified_base (670)..(670): a, c, t, g, unknown or other
  misc_feature (670)..(670): n is a, c, g, or t
  modified_base (690)..(690): a, c, t, g, unknown or other
  misc_feature (690)..(690): n is a, c, g, or t
  modified_base (696)..(696): a, c, t, g, unknown or other
  misc_feature (696)..(696): n is a, c, g, or t
  modified_base (701)..(702): a, c, t, g, unknown or other
  misc_feature (701)..(702): n is a, c, g, or t
  modified_base (706)..(706): a, c, t, g, unknown or other
  misc_feature (706)..(706): n is a, c, g, or t
  modified_base (714)..(714): a, c, t, g, unknown or other
  misc_feature (714)..(714): n is a, c, g, or t
  modified_base (716)..(716): a, c, t, g, unknown or other
  misc_feature (716)..(716): n is a, c, g, or t
  modified_base (721)..(722): a, c, t, g, unknown or other
  misc_feature (721)..(722): n is a, c, g, or t
  modified_base (724)..(725): a, c, t, g, unknown or other
  misc_feature (724)..(725): n is a, c, g, or t
  modified_base (727)..(730): a, c, t, g, unknown or other
  misc_feature (727)..(730): n is a, c, g, or t
tcagatagagtactcacgaccggtgctcgatttagtacgtcatcagggaaagggccaccctctcttgtaggccagtcagagtgttagcagcaactacttagcctggtaccagcagacacctggccaggcctcccgaggcctcctcatccatggtgcactccaccgagggccacgtggcactcccagacaggttcagtggcaggttgggtctgggacagtacttctacttctacgaccatcgagaccgagacgtaggacgtccgtagtaaagttatttttcgacgtaagttagttactttaaccgtgttacgaacggtacctaaggttacgggttaatttaccgacgtttccgtaaccgggttaccggtttaccggggaccgtaaaacggggtaacctaaaacggggttaaacgggtaaaaccttaaacccgtaaaaacggggtaaccttttgggtaccggggttaacgtcggtaaacccttaaccgtaacgtttccggtttactttcccggttttaacaacccgtttttccccggtcccccgtttaaagtaccgttttacggtacggttaacgttccggtaacctaccgttacgttacggtcggggtaaaccggtccggggtaactaccgggaacggttaccggaccgtacgtaacgtaacgcgtacganacgtcacgacgacgacgacnctacgngacgnncgancgcgcganancacgnngnnannnn

SEQ ID NO: 118390 - DNA, 581 bp, Homo sapiens
  misc_feature: GYAE6OF01C6GQN.29.60.F05.1.454.CMB.1.raw
  modified_base (246)..(246): a, c, t, g, unknown or other
  misc_feature (246)..(246): n is a, c, g, or t
  modified_base (558)..(559): a, c, t, g, unknown or other
  misc_feature (558)..(559): n is a, c, g, or t
  modified_base (561)..(581): a, c, t, g, unknown or other
  misc_feature (561)..(581): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggcctcctcatccatggtgcatccaccagggcccactggcactcccagacaggttcagtggcaggtgggcgtgggacagtacttcattcctcaccatcagcagactggacnctagagtatttgctagttgttattactgtcagcgtaaggtacggttagttctacttccgttcccggaccggtttaccggaccggaaacgggtaccgtaaagggtacggaaaacgtaccgaaaaacgtacgtggtacggaccttacgaccctaaccgtacgtttcgtttaccggttacctttccgttaaccgtttcccgtttccccgaccttaaccgttccgttacgttaaccgttaccggttaacgacccttaacccgttacggtacggggaccgggtccgggtcgtacgggaccggacggacgtcagtagnngnnnnnnnnnnnnnnnnnnnnn

SEQ ID NO: 118391 - DNA, 483 bp, Homo sapiens
  misc_feature: GYAE6OF01A7EPT.29.60.F05.1.454.CMB.1.raw
  modified_base (381)..(381): a, c, t, g, unknown or other
  misc_feature (381)..(381): n is a, c, g, or t
  modified_base (419)..(419): a, c, t, g, unknown or other
  misc_feature (419)..(419): n is a, c, g, or t
  modified_base (454)..(456): a, c, t, g, unknown or other
  misc_feature (454)..(456): n is a, c, g, or t
  modified_base (458)..(458): a, c, t, g, unknown or other
  misc_feature (458)..(458): n is a, c, g, or t
  modified_base (460)..(483): a, c, t, g, unknown or other
  misc_feature (460)..(483): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtgggtctgggacagacttcattctcaccatcagcagacgtggagcctgaagtattttgctagtgtattactgtcagctaaggtacggttagttcattccgtccgtacggttcggaccgaagggaccaaagggtaggaaactacgaaaacgtaacgtggtggctaggccaacatcgtgtcttacncttcctcccgcactctagattcgtacgctactcgaggnggtccgggcgtacgggacgacgggcgacagtacgnnnancnnnnnnnnnnnnnnnnnnnnnnnn

SEQ ID NO: 118392 - DNA, 155 bp, Homo sapiens
  misc_feature: GYAE6OF01BDXJN.29.60.F05.1.454.CMB.1.raw
  modified_base (145)..(145): a, c, t, g, unknown or other
  misc_feature (145)..(145): n is a, c, g, or t
  modified_base (151)..(155): a, c, t, g, unknown or other
  misc_feature (151)..(155): n is a, c, g, or t
tcagatagagtactcacgaccggtgctcgatttagtacgtcatcagggaaagggaccaaggtggaagtcaaaggaactgtggctgcaccatctgtcttcatcttcccgcatctgatatgtatactctgagcgggctggcaaggcncatagnnnnn

SEQ ID NO: 118393 - DNA, 613 bp, Homo sapiens
  misc_feature: GYAE6OF01E5AFX.29.60.F05.1.454.CMB.1.raw
  modified_base (144)..(144): a, c, t, g, unknown or other
  misc_feature (144)..(144): n is a, c, g, or t
  modified_base (274)..(274): a, c, t, g, unknown or other
  misc_feature (274)..(274): n is a, c, g, or t
  modified_base (531)..(531): a, c, t, g, unknown or other
  misc_feature (531)..(531): n is a, c, g, or t
  modified_base (544)..(544): a, c, t, g, unknown or other
  misc_feature (544)..(544): n is a, c, g, or t
  modified_base (554)..(554): a, c, t, g, unknown or other
  misc_feature (554)..(554): n is a, c, g, or t
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
  modified_base (574)..(574): a, c, t, g, unknown or other
  misc_feature (574)..(574): n is a, c, g, or t
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
  modified_base (591)..(591): a, c, t, g, unknown or other
  misc_feature (591)..(591): n is a, c, g, or t
  modified_base (605)..(606): a, c, t, g, unknown or other
  misc_feature (605)..(606): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggcctccaggctccctnatccagtgtgcatccaccacgggccacgtggcactccagacgaggttcagtgcaggtgggtcgtcgggacagtacttcattccgtcaccatcagcagacgtcggagtcctagaagtagtttgacctagtnttattaacgtcgtagacgtacgtacgttaccggtacgtttcacgttacccgttccggtacccggtttcgggaaacccgtaaacggggaaccctaaaaggggtacgtaaaagtaaccgtaaacgaacgtttgacggtactcgacaccgtagttctacgttcttacctacgtccttaccccggacctagtcctacggtacttccggtacgtacctaccgtcgttacggacgggtcggtcgtacggtagacgggtaccanacggtcaaggtcnccgtagagtncgtagcgtangcgtangagntagacngtcgtntactntcgtgcacgtagannatgtgtc

SEQ ID NO: 118394 - DNA, 729 bp, Homo sapiens
  misc_feature: GYAE6OF01D5DHU.29.60.F05.1.454.CMB.1.raw
  modified_base (148)..(148): a, c, t, g, unknown or other
  misc_feature (148)..(148): n is a, c, g, or t
  modified_base (325)..(325): a, c, t, g, unknown or other
  misc_feature (325)..(325): n is a, c, g, or t
  modified_base (663)..(663): a, c, t, g, unknown or other
  misc_feature (663)..(663): n is a, c, g, or t
  modified_base (671)..(671): a, c, t, g, unknown or other
  misc_feature (671)..(671): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
  modified_base (680)..(681): a, c, t, g, unknown or other
  misc_feature (680)..(681): n is a, c, g, or t
  modified_base (683)..(683): a, c, t, g, unknown or other
  misc_feature (683)..(683): n is a, c, g, or t
  modified_base (685)..(686): a, c, t, g, unknown or other
  misc_feature (685)..(686): n is a, c, g, or t
  modified_base (698)..(698): a, c, t, g, unknown or other
  misc_feature (698)..(698): n is a, c, g, or t
  modified_base (706)..(706): a, c, t, g, unknown or other
  misc_feature (706)..(706): n is a, c, g, or t
  modified_base (709)..(710): a, c, t, g, unknown or other
  misc_feature (709)..(710): n is a, c, g, or t
  modified_base (713)..(713): a, c, t, g, unknown or other
  misc_feature (713)..(713): n is a, c, g, or t
  modified_base (718)..(718): a, c, t, g, unknown or other
  misc_feature (718)..(718): n is a, c, g, or t
  modified_base (720)..(720): a, c, t, g, unknown or other
  misc_feature (720)..(720): n is a, c, g, or t
  modified_base (725)..(726): a, c, t, g, unknown or other
  misc_feature (725)..(726): n is a, c, g, or t
tcagatagagtactcacgaccggtgctcgatttagtacgtcatcagggaagggccaccctctcttgtagggccagtcagagtgttagcagcaactacttagcctaggtaccagcagacaccgtggccaggcctacccgaggcctcctnactccagtggtgactactcccgaaccgagggacccagtggaccacgtccccgaagtaccgtaggtttaccgaggtcggtctagggtttcggggtacgaggggaaccaggttacctttcgtacttacctacccgactacgtacgacgtacgagaacgtggacgaccttaggtaagttntttagacgttagttatttagttactagacgtacgtacgttaggttaacgttagttacctacgttccgttaccgtacggttaccggacggtaacgggactaaagggtataaaaccgtaacggtaaaccgaggttaggtaccgttacgaaccgtaccggttaaccctagtttcccgttacgtttaacccgtttacctaacgtttaccccccgttacccgtaggttaaccttacggttaaccggttaacgttaccggtaaccgtaccgttaccgttacggtaccgggtacgggtaccgggttacgacggtaacggaccggccgttaacgttagacgttcgngtactagnacgtnanannanannagagacgtacgnagagctanacnngtnagtananagtcnngtg

SEQ ID NO: 118395 - DNA, 549 bp, Homo sapiens
  misc_feature: GYAE6OF01AWAW5.29.60.F05.1.454.CMB.1.raw
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (307)..(307): a, c, t, g, unknown or other
  misc_feature (307)..(307): n is a, c, g, or t
  modified_base (517)..(549): a, c, t, g, unknown or other
  misc_feature (517)..(549): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctccctcatccatgggtgcatcccaccagggccacgtggcactcccagacgaggttcagtgggccaggtggggtctgggacagacttcattcncaccntcagcaggactggactcctgaacgattttgctagtcgttaattactgtcagtctaagtacggttagtcatcnccggtacgttccggaccgaagggtacccaagggtacggaaattacgaaacgaaccgtggtcggactagaccaacccgtatccgttcggttaccttactacttcccgttaccccggcctaacgttccgtagtacgtttaccgactccgtacttccgacggtaacgggtccgggacgttccgggaccggaacgggtcgaaacgtgtaacggnnnnnnnnnnnnnnnnnnnnnnnnnnnnnnnnn

SEQ ID NO: 118396 - DNA, 261 bp, Homo sapiens
  misc_feature: GYAE6OF01BDF59.29.60.F05.1.454.CMB.1.raw
  modified_base (131)..(131): a, c, t, g, unknown or other
  misc_feature (131)..(131): n is a, c, g, or t
  modified_base (155)..(155): a, c, t, g, unknown or other
  misc_feature (155)..(155): n is a, c, g, or t
  modified_base (158)..(159): a, c, t, g, unknown or other
  misc_feature (158)..(159): n is a, c, g, or t
  modified_base (162)..(261): a, c, t, g, unknown or other
  misc_feature (162)..(261): n is a, c, g, or t
tcagatagagtactcacgaccggtgctcgatttagtacgtcatcagggaaaagggaccaaggtggaagtcaaaggactgtggctgcaccatctgcttcatcttccccgcatctgatctctcgatctgacgngggctggcaaaggcgactagtagntcnngcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 118397 - DNA, 150 bp, Homo sapiens
  misc_feature: GYAE6OF02FY083.29.60.F05.1.454.CMB.1.raw
  modified_base (149)..(150): a, c, t, g, unknown or other
  misc_feature (149)..(150): n is a, c, g, or t
tcagatagagtactcacgaccggtgctcgatttagtacgtcatcagggaaggaccaaggtggaagtcaaggaactgtggctgcaccatctgtcttcatcttcccgccatctgatctctcgactctgagcgggctggcaaggcgcatagnn

SEQ ID NO: 118398 - DNA, 158 bp, Homo sapiens
  misc_feature: GYAE6OF02GSGA2.29.60.F05.1.454.CMB.1.raw
  modified_base (153)..(158): a, c, t, g, unknown or other
  misc_feature (153)..(158): n is a, c, g, or t
tcagatagagtactcacgaccggtgctcgatttagtacgtcatcagggaaagggaccgaaggtggaagtcaaaggaactgtggctgcaccatctgtcttcatcttcccgccatctgatctctcgactctgagcgggctggcaaggcgcatagnnnnnn

SEQ ID NO: 118399 - DNA, 154 bp, Homo sapiens; identical to SEQ ID NO: 118324
  misc_feature: GYAE6OF02HIOQT.29.60.F05.1.454.CMB.1.raw
  modified_base (152)..(154): a, c, t, g, unknown or other
  misc_feature (152)..(154): n is a, c, g, or t

SEQ ID NO: 118400 - DNA, 196 bp, Homo sapiens
  misc_feature: GYAE6OF02IPZDV.29.60.F05.1.454.CMB.1.raw
  modified_base (156)..(196): a, c, t, g, unknown or other
  misc_feature (156)..(196): n is a, c, g, or t
tcagatagagtactcacgaccggtgctcgatttagtacgtcatcagggaaagggtaccgaaggtggaagtcaaaggaactgtggctgcaccatctgtcttcactcttcccgccatctggatctctcgactctgagcgggctggcaaggcgcatagnnnnnnnnnnnnnnnnnnnnnnnnnnnnnnnnnnnnnnnnn

SEQ ID NO: 118401 - DNA, 157 bp, Homo sapiens
  misc_feature: GYAE6OF02GQFVC.29.60.F05.1.454.CMB.1.raw
  modified_base (152)..(157): a, c, t, g, unknown or other
  misc_feature (152)..(157): n is a, c, g, or t
tcagatagagtactcacgaccggtgctcgatttagtacgtcatcagggaaagggaccaaggtggaagtcaaaggaactgtggctgcaccatctgtcttcatcttcccgccatctgatctctcgactctgagcgggctggcaaggcgcatagnnnnnn

SEQ ID NO: 118402 - DNA, 153 bp, Homo sapiens; identical to SEQ ID NO: 118362
  misc_feature: GYAE6OF02HV6M4.29.60.F05.1.454.CMB.1.raw
  modified_base (152)..(153): a, c, t, g, unknown or other
  misc_feature (152)..(153): n is a, c, g, or t

SEQ ID NO: 118403 - DNA, 152 bp, Homo sapiens; identical to SEQ ID NO: 118326
  misc_feature: GYAE6OF02IMB3N.29.60.F05.1.454.CMB.1.raw
  modified_base (152)..(152): a, c, t, g, unknown or other
  misc_feature (152)..(152): n is a, c, g, or t

SEQ ID NO: 118404 - DNA, 406 bp, Homo sapiens
  misc_feature: GYAE6OF02IESAV.29.60.F05.1.454.CMB.1.raw
  modified_base (372)..(372): a, c, t, g, unknown or other
  misc_feature (372)..(372): n is a, c, g, or t
  modified_base (402)..(406): a, c, t, g, unknown or other
  misc_feature (402)..(406): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttccgccatctgatcgtancactctgagcgggctggcaaggcgcatagnnnnn

SEQ ID NO: 118405 - DNA, 155 bp, Homo sapiens
  misc_feature: GYAE6OF02HE3R6.29.60.F05.1.454.CMB.1.raw
  modified_base (153)..(155): a, c, t, g, unknown or other
  misc_feature (153)..(155): n is a, c, g, or t
tcagatagagtactcacgaccggtgctcgatttagtacgtcatcagggaaagggaccaaggtggaagtcaaaggaactgtggatgcaccatctgtcttcatcttcccgccatctgatctctccgactctgagcgggctggcaaggcgcatagnnn

SEQ ID NO: 118406 - DNA, 406 bp, Homo sapiens
  misc_feature: GYAE6OF02GI3H3.29.60.F05.1.454.CMB.1.raw
  modified_base (402)..(406): a, c, t, g, unknown or other
  misc_feature (402)..(406): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttccgccatctgatcgtagcactctgagcgggctggcaaggcgcatagnnnnn

SEQ ID NO: 118407 - DNA, 434 bp, Homo sapiens
  misc_feature: GYAE6OF02H40XH.29.60.F05.1.454.CMB.1.raw
  modified_base (411)..(434): a, c, t, g, unknown or other
  misc_feature (411)..(434): n is a, c, g, or t
tcagatagagtactcacgaccggtgctcgatttagtacgtcatcagggaaagggccgaccctctcttgtacgggccagtcagagtgttagcagcaactacttagcctggtaccagcagacacctggccaggctcccaggctcctcatccatggtgcatccaccagggccactggcatcccagacaggttcagtggcagtgggtctgggactagacttcattctcaccatcagcaggactgggagcctgaacgattttgcagtgtattactgtcagcagtacggtagttcatctccgacgttcggccaagggaccaaggtggaaatcaaaacgaactgtggctgcaccatctgtctacatcttcccgcatctgatcgtagcactctgagcgggctggcaaaggtcgcatagnnnnnnnnnnnnnnnnnnnnnnnn

SEQ ID NO: 118408 - DNA, 405 bp, Homo sapiens
  misc_feature: GYAE6OF02G3Z3E.29.60.F05.1.454.CMB.1.raw
  modified_base (401)..(405): a, c, t, g, unknown or other
  misc_feature (401)..(405): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttcccgccatctgatcgtagcactctgagcgggctggcaggcgcatagnnnnn

SEQ ID NO: 118409 - DNA, 162 bp, Homo sapiens
  misc_feature: GYAE6OF02HNDE0.29.60.F05.1.454.CMB.1.raw
  modified_base (154)..(162): a, c, t, g, unknown or other
  misc_feature (154)..(162): n is a, c, g, or t
tcagatagagtactcacgaccggtgctcgatttagtacgtcatcagggaaagggaccgaaggtggaagtcaaaggaactgtggctgcaccatctgtcttcatcttcccgccatctgactctctcgactctgagcgggctggcaaggcgcatagnnnnnnnnn

SEQ ID NO: 118410 - DNA, 406 bp, Homo sapiens
  misc_feature: GYAE6OF02H6Y38.29.60.F05.1.454.CMB.1.raw
  modified_base (401)..(406): a, c, t, g, unknown or other
  misc_feature (401)..(406): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaaggtggaaatcaaacgactgtgctgcacatctgtcttcatcttcccgccatctgatcgtagcactctgagcgggctggcaaggcgcatagnnnnnn

SEQ ID NO: 118411 - DNA, 453 bp, Homo sapiens
  misc_feature: GYAE6OF02GH6RN.29.60.F05.1.454.CMB.1.raw
  modified_base (381)..(381): a, c, t, g, unknown or other
  misc_feature (381)..(381): n is a, c, g, or t
  modified_base (421)..(437): a, c, t, g, unknown or other
  misc_feature (421)..(437): n is a, c, g, or t
  modified_base (439)..(453): a, c, t, g, unknown or other
  misc_feature (439)..(453): n is a, c, g, or t
tcagatagagtactcacgaccggtgctcgatttagtacgtcatcagggaaagggccaccctacggtcttgtagggccagtcagagtgttagcagcaactacttagcctggtaccaggcagacacctggccaggctcccaggctcctcagtccatgggtgcgactccaccagggcccactggcatccccagaccaggttcagtggcagtgggtctgggacagacttcattctcaccatcagcagactggagcctgaagatttgcagtgtattactgtcagcacgtacgtagttccaatctccgacgttcggccaagggaccaaggtggaaatcgaaacgaacgttgtaggctgcacatctagtcttcatcttcccgccatcngatcgtagcactctgacgcgggctggcaaggcgcattagnnnnnnnnnnnnnnnnngnnnnnnnnnnnnnnn

SEQ ID NO: 118412 - DNA, 152 bp, Homo sapiens; identical to SEQ ID NO: 118326
  misc_feature: GYAE6OF02HAGT5.29.60.F05.1.454.CMB.1.raw
  modified_base (152)..(152): a, c, t, g, unknown or other
  misc_feature (152)..(152): n is a, c, g, or t

SEQ ID NO: 118413 - DNA, 406 bp, Homo sapiens
  misc_feature: GYAE6OF02GV1RP.29.60.F05.1.454.CMB.1.raw
  modified_base (401)..(406): a, c, t, g, unknown or other
  misc_feature (401)..(406): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcacatctgtcttcatcttcccgccatctgatcgtagcactctgagcgggctggcaaggcgcatagnnnnnn

SEQ ID NO: 118414 - DNA, 154 bp, Homo sapiens; identical to SEQ ID NO: 118324
  misc_feature: GYAE6OF02ICMP0.29.60.F05.1.454.CMB.1.raw
  modified_base (152)..(154): a, c, t, g, unknown or other
  misc_feature (152)..(154): n is a, c, g, or t

SEQ ID NO: 118415 - DNA, 152 bp, Homo sapiens; identical to SEQ ID NO: 118326
  misc_feature: GYAE6OF02H3L57.29.60.F05.1.454.CMB.1.raw
  modified_base (152)..(152): a, c, t, g, unknown or other
  misc_feature (152)..(152): n is a, c, g, or t

SEQ ID NO: 118416 - DNA, 152 bp, Homo sapiens; identical to SEQ ID NO: 118330
  misc_feature: GYAE6OF02HW6J9.29.60.F05.1.454.CMB.1.raw
  modified_base (152)..(152): a, c, t, g, unknown or other
  misc_feature (152)..(152): n is a, c, g, or t

SEQ ID NO: 118417 - DNA, 404 bp, Homo sapiens
  misc_feature: GYAE6OF02IX6E3.29.60.F05.1.454.CMB.1.raw
  modified_base (371)..(371): a, c, t, g, unknown or other
  misc_feature (371)..(371): n is a, c, g, or t
  modified_base (394)..(394): a, c, t, g, unknown or other
  misc_feature (394)..(394): n is a, c, g, or t
  modified_base (399)..(404): a, c, t, g, unknown or other
  misc_feature (399)..(404): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaaggtgaaatcaaacgaactgtggctgcacatctgtcttcatcttcccgcatctgatcgtancactctgagcggctggcaaggcnatagnnnnnn

SEQ ID NO: 118418 - DNA, 525 bp, Homo sapiens
  misc_feature: GYAE6OF02JPRZN.29.60.F05.1.454.CMB.1.raw
  modified_base (500)..(525): a, c, t, g, unknown or other
  misc_feature (500)..(525): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattcctcaccatcagacagacgtggacgcctagaagtatttgtacgagtgttattacttagtcgagacgtagtacggtagttactactcctccgtaccggttaccggtaccgaacgggaaccgtaacggtaggtaaacgtaacgaaacgaacgtaggtacggtacgtacgacacctactacgtcgttcttactacttccttcccgtacctactactacgtacgtacgtacgtactacctcgtcgtacggtcgggtcggtacggacggaacggacgacgtagtagnnnnnnnnnnnnnnnnnnnnnnnnnn

SEQ ID NO: 118419 - DNA, 156 bp, Homo sapiens
  misc_feature: GYAE6OF02FMT8V.29.60.F05.1.454.CMB.1.raw
  modified_base (152)..(156): a, c, t, g, unknown or other
  misc_feature (152)..(156): n is a, c, g, or t
tcagatagagtactcacgaccggtgctcgatttagtacgtcatcagggaaagggaccaaggtggaagtcaaaggaactgtggctgcaccatctgtcttcatcttcccgccatctgatctctcgactctgagcgggctggcaaggcgcatagnnnnn

SEQ ID NO: 118420 - DNA, 411 bp, Homo sapiens
  misc_feature: GYAE6OF02GD4HU.29.60.F05.1.454.CMB.1.raw
  modified_base (397)..(397): a, c, t, g, unknown or other
  misc_feature (397)..(397): n is a, c, g, or t
  modified_base (403)..(411): a, c, t, g, unknown or other
  misc_feature (403)..(411): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtaggctgcaccatctgtcttcatcttcccgcatctgatcgtagcactctgagtcgggctggcaaggcncatagnnnnnnnnn

SEQ ID NO: 118421 - DNA, 421 bp, Homo sapiens
  misc_feature: GYAE6OF02GD6SH.29.60.F05.1.454.CMB.1.raw
  modified_base (404)..(421): a, c, t, g, unknown or other
  misc_feature (404)..(421): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcgaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgatcgtagcactctgagcgggctggcaaggcgacatagnnnnnnnnnnnnnnnnnn

SEQ ID NO: 118422 - DNA, 438 bp, Homo sapiens
  misc_feature: GYAE6OF02G1YXO.29.60.F05.1.454.CMB.1.raw
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (408)..(438): a, c, t, g, unknown or other
  misc_feature (408)..(438): n is a, c, g, or t
tcagatagagtactcacgaccggtgctcgatttagtacgtcatcagggaaaggggccaccctctcttgtagggccagtcagagtgttagcagcaactacttagcctggtaccagcagacacctggccaggctcccaggctcctcattccatggtgctatccaccagggccactggcatcccagacaggttcgagtggcagtgggtctgggacagacttcattctcaccatcagcagactggagcctgaagattttgctaatttattactgtcagcagtataataactggcctcgtacacttttggccagggaccaagcctggagatcaaacgactgtgctgcacatctgtctcatcttcccgcatctnatcgtancactctagacgcggctggcaaggcgacagtagnnnnnnnnnnnnnnnnnnnnnnnnnnnnnnn

SEQ ID NO: 118423 - DNA, 151 bp, Homo sapiens
  misc_feature: GYAE6OF02FI25M.29.60.F05.1.454.CMB.1.raw
  modified_base (151)..(151): a, c, t, g, unknown or other
  misc_feature (151)..(151): n is a, c, g, or t
tcagatagagtactcacgaccggtgctcgatttagtacgtcatcagggaagggaccaaggtggaagtcaaaggaactgtggctgcaccatctgtcttcatcttcccgccatctgatctctcgactctgagcgggctggcaaggcgcatagn

SEQ ID NO: 118424 - DNA, 426 bp, Homo sapiens
  misc_feature: GYAE6OF02JF4OV.29.60.F05.1.454.CMB.1.raw
  modified_base (239)..(239): a, c, t, g, unknown or other
  misc_feature (239)..(239): n is a, c, g, or t
  modified_base (338)..(338): a, c, t, g, unknown or other
  misc_feature (338)..(338): n is a, c, g, or t
  modified_base (406)..(426): a, c, t, g, unknown or other
  misc_feature (406)..(426): n is a, c, g, or t
tcagatagagtactcacgaccggtgctcgatttagtacgtcatcagggaaagggccaccctctcttgtagggccagtcagagtgttagcagcaactacttagcctggtaccagcagacacctggcaaggctcccaggctcctcatccatggtgcatccaccagggccactggcatcccagacaggttcagtggcagtgggtctgggacagacttcattctcaccatcagcagactggancctgaagatttgcagtgtattactgtcagcagtacggtagttcatctccgacgttcgccaagggccaaggtggaaatcaaagaactgtgctgcacatcngtcttcatcttcccgccatctgatcgtagcactctgagcgggtctgggctaagggcgtcacgtagcgnnnnnnnnnnnnnnnnnnnnn

SEQ ID NO: 118425 - DNA, 409 bp, Homo sapiens
  misc_feature: GYAE6OF02GZKES.29.60.F05.1.454.CMB.1.raw
  modified_base (401)..(409): a, c, t, g, unknown or other
  misc_feature (401)..(409): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgcatctgatcgtagcactctgagcgggctggcaaggcgcatagnnnnnnnnn

SEQ ID NO: 118426 - DNA, 152 bp, Homo sapiens; identical to SEQ ID NO: 118326
  misc_feature: GYAE6OF02H6MNB.29.60.F05.1.454.CMB.1.raw
  modified_base (152)..(152): a, c, t, g, unknown or other
  misc_feature (152)..(152): n is a, c, g, or t

SEQ ID NO: 118427 - DNA, 152 bp, Homo sapiens; identical to SEQ ID NO: 118326
  misc_feature: GYAE6OF02GEE94.29.60.F05.1.454.CMB.1.raw
  modified_base (152)..(152): a, c, t, g, unknown or other
  misc_feature (152)..(152): n is a, c, g, or t

SEQ ID NO: 118428 - DNA, 413 bp, Homo sapiens
  misc_feature: GYAE6OF02HKDC9.29.60.F05.1.454.CMB.1.raw
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
  modified_base (403)..(413): a, c, t, g, unknown or other
  misc_feature (403)..(413): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgatcgtancactctgagcgggctggcaagggcncatagnnnnnnnnnnn

SEQ ID NO: 118429 - DNA, 405 bp, Homo sapiens
  misc_feature: GYAE6OF02JFS6J.29.60.F05.1.454.CMB.1.raw
  modified_base (394)..(394): a, c, t, g, unknown or other
  misc_feature (394)..(394): n is a, c, g, or t
  modified_base (400)..(405): a, c, t, g, unknown or other
  misc_feature (400)..(405): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatcttcccgcatctgatcgtagcactctgagcggctggcaaggcncatagnnnnnn

SEQ ID NO: 118430 - DNA, 409 bp, Homo sapiens
  misc_feature: GYAE6OF02IM643.29.60.F05.1.454.CMB.1.raw
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccgactggcatcccacgacaggttcagtggcagtgggtcgtgggacagacttcattctcaccatcagcagactggagcctgaagattttgcagtgtattactgtcagcagtacggtagttcatctccgacggttcggccaagggaccaaggtaggaaatacaaacgaactgtggctgcaccatctgtcttcatccttcccgccatctgatcgtagccatctgagcgggntggcaagcgnatagn

SEQ ID NO: 118431 - DNA, 408 bp, Homo sapiens
  misc_feature: GYAE6OF02GAVGZ.29.60.F05.1.454.CMB.1.raw
  modified_base (394)..(394): a, c, t, g, unknown or other
  misc_feature (394)..(394): n is a, c, g, or t
  modified_base (400)..(408): a, c, t, g, unknown or other
  misc_feature (400)..(408): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcaccatctgtcttcatctcccgcatctgatcgtagcactctgagcgggctggcaaggcncatagnnnnnnnnn

SEQ ID NO: 118432 - DNA, 415 bp, Homo sapiens
  misc_feature: GYAE6OF02JMK0O.29.60.F05.1.454.CMB.1.raw
  modified_base (403)..(415): a, c, t, g, unknown or other
  misc_feature (403)..(415): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcgccaagggaccaaggtggaaatcaaacgaactgtggctgcacatctgtcttcatcttcccgctatctgatcgtagcactctgacgcggctgggcaaggcgacatagnnnnnnnnnnnnn

SEQ ID NO: 118433 - DNA, 407 bp, Homo sapiens
  misc_feature: GYAE6OF02H38HE.29.60.F05.1.454.CMB.1.raw
  modified_base (394)..(394): a, c, t, g, unknown or other
  misc_feature (394)..(394): n is a, c, g, or t
  modified_base (400)..(407): a, c, t, g, unknown or other
  misc_feature (400)..(407): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacgtagttcatctccgacgttcggccaagggaccaaggtggaaatcaaacgactgtggctgcacatctgtcttcatcttcccgccatctgatcgtagcactctgagcgggctggcaaggcncatagnnnnnnnn

SEQ ID NO: 118434 - DNA, 153 bp, Homo sapiens; identical to SEQ ID NO: 118362
  misc_feature: GYAE6OF02HID98.29.60.F05.1.454.CMB.1.raw
  modified_base (152)..(153): a, c, t, g, unknown or other
  misc_feature (152)..(153): n is a, c, g, or t

SEQ ID NO: 118435 - DNA, 411 bp, Homo sapiens
  misc_feature: GYAE6OF02GIFY1.29.60.F05.1.454.CMB.1.raw
  modified_base (396)..(396): a, c, t, g, unknown or other
  misc_feature (396)..(396): n is a, c, g, or t
  modified_base (402)..(411): a, c, t, g, unknown or other
  misc_feature (402)..(411): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttccgccatctgatcgtagcactctgagcgggctggcaaggcncatagnnnnnnnnnn

SEQ ID NO: 118436 - DNA, 410 bp, Homo sapiens
  misc_feature: GYAE6OF02G8GAJ.29.60.F05.1.454.CMB.1.raw
  modified_base (402)..(410): a, c, t, g, unknown or other
  misc_feature (402)..(410): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgactgtggctgcacatctgtcttcatcttcccgcatctgatcgtagctactctgagcgggctgggcaaggcgcatagnnnnnnnnn

SEQ ID NO: 118437 - DNA, 410 bp, Homo sapiens
  misc_feature: GYAE6OF02GWH3D.29.60.F05.1.454.CMB.1.raw
  modified_base (239)..(239): a, c, t, g, unknown or other
  misc_feature (239)..(239): n is a, c, g, or t
  modified_base (397)..(397): a, c, t, g, unknown or other
  misc_feature (397)..(397): n is a, c, g, or t
  modified_base (402)..(410): a, c, t, g, unknown or other
  misc_feature (402)..(410): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtgaaatcaaacgaactgtggctgcaccatctgtcttcatcttcccgcatctgatcgtacgcactctgaggcgggctggacaggcnatagnnnnnnnnn

SEQ ID NO: 118438 - DNA, 436 bp, Homo sapiens
  misc_feature: GYAE6OF02IOG2U.29.60.F05.1.454.CMB.1.raw
  modified_base (238)..(238): a, c, t, g, unknown or other
  misc_feature (238)..(238): n is a, c, g, or t
  modified_base (420)..(436): a, c, t, g, unknown or other
  misc_feature (420)..(436): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctccaggctcctcatccatggtgcatccaccagggccactggcatcccagacaggttcagtggcagtgggtctgggacagacttcattctcaccatcagcagactggancctagaacgtattttgcagtgtattactgtcagcaggtacggtgtcatctcgacgttcggacaagggaccaaggtgaaatcaaacgacgtgtggctgacacatctgtcttcattccttcccgctactctgactcgtacgactactcgtggagtcgggcttgggacaaggtccgactatacgnnnnnnnnnnnnnnnnn

SEQ ID NO: 118439 - DNA, 412 bp, Homo sapiens
  misc_feature: GYAE6OF02FIANC.29.60.F05.1.454.CMB.1.raw
  modified_base (400)..(400): a, c, t, g, unknown or other
  misc_feature (400)..(400): n is a, c, g, or t
  modified_base (406)..(412): a, c, t, g, unknown or other
  misc_feature (406)..(412): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcaatttattactgtcagcagtataataactggcctccgtacacttttggccaggggaccaagctggagatcaaacgaactgtggctgcacatctgtcttcatccttcccgccatctgatcgtagcactctgagcgggctggcaaggcncatagnnnnnnn

SEQ ID NO: 118440 - DNA, 406 bp, Homo sapiens
  misc_feature: GYAE6OF02JBOJD.29.60.F05.1.454.CMB.1.raw
  modified_base (401)..(406): a, c, t, g, unknown or other
  misc_feature (401)..(406): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtgaaatcaaacgactgtgctgcacatctgtcttcactcttcccgccatcctgatcgacgcactctgaggcggctggcaaggcgtcatagnnnnnn

SEQ ID NO: 118441 - DNA, 487 bp, Homo sapiens
  misc_feature: GYAE6OF02FP369.29.60.F05.1.454.CMB.1.raw
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (448)..(449): a, c, t, g, unknown or other
  misc_feature (448)..(449): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
  modified_base (471)..(473): a, c, t, g, unknown or other
  misc_feature (471)..(473): n is a, c, g, or t
  modified_base (475)..(477): a, c, t, g, unknown or other
  misc_feature (475)..(477): n is a, c, g, or t
  modified_base (479)..(480): a, c, t, g, unknown or other
  misc_feature (479)..(480): n is a, c, g, or t
  modified_base (482)..(487): a, c, t, g, unknown or other
  misc_feature (482)..(487): n is a, c, g, or t
tcagatagagtactcacgaccggtgctcgatttagtacgtcatcagggaaagggaccgaccctactcttgtagggccagtcagacgtgttaggcagcaaacctacttagcctggtaccagcagacacctggccaggctcccaggctcctcatccaatggtgcatccaccagggcccactggccatcccctagacaggttcgaagtggcagtgggtctgggacaggacttcattctcaccatcaagtctaggacctggacgcctgaagaattttgcagtgtattacctgtcagcagtataatactgcctcgtacnctttggccaggggaccaagctggacgatacaaacgactgtggctgcacngtctgtcttcattcttcccgctatcctgactcgtagctactctagacggtcgggtctaggacgtaaggtccgcgatacgngtngnngacnctgacncgtncgcagcannnannngnncnnnnnn

SEQ ID NO: 118442 - DNA, 405 bp, Homo sapiens
  misc_feature: GYAE6OF02GNWSQ.29.60.F05.1.454.CMB.1.raw
  modified_base (400)..(405): a, c, t, g, unknown or other
  misc_feature (400)..(405): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggccaaggtggaaatcaaacgaactgtggctgcacatctgtcttcatcttcccgcatctgatcgtagcactctgagcgggctggcgaggcgcatagnnnnnn

SEQ ID NO: 118443 - DNA, 415 bp, Homo sapiens
  misc_feature: GYAE6OF02G2DO4.29.60.F05.1.454.CMB.1.raw
  modified_base (406)..(415): a, c, t, g, unknown or other
  misc_feature (406)..(415): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcaatttattactgtcagcagtataataactggcctccgtacacttttggccaggggaccaagctggagatacaaacgaactgtggctgcaccatctgtcttcatcttcccgccatctgatcgtagcactctgagcgggctggcaaggcgcatgnnnnnnnnnn

SEQ ID NO: 118444 - DNA, 414 bp, Homo sapiens
  misc_feature: GYAE6OF02GFWAJ.29.60.F05.1.454.CMB.1.raw
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
  modified_base (403)..(414): a, c, t, g, unknown or other
  misc_feature (403)..(414): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttccgcatctanctcgtancactctgagcgggctgggcaaggcncagtagnnnnnnnnnnnn

SEQ ID NO: 118445 - DNA, 420 bp, Homo sapiens
  misc_feature: GYAE6OF02G0PZI.29.60.F05.1.454.CMB.1.raw
  modified_base (405)..(420): a, c, t, g, unknown or other
  misc_feature (405)..(420): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaaacgaactgtggctgcacatctgtcttcatcttccgccatctgatcgtagcactctgagcgggctgggcaaggcgcaagtgcnnnnnnnnnnnnnnnn

SEQ ID NO: 118446 - DNA, 412 bp, Homo sapiens
  misc_feature: GYAE6OF02FOO5B.29.60.F05.1.454.CMB.1.raw
  modified_base (367)..(367): a, c, t, g, unknown or other
  misc_feature (367)..(367): n is a, c, g, or t
  modified_base (400)..(400): a, c, t, g, unknown or other
  misc_feature (400)..(400): n is a, c, g, or t
  modified_base (403)..(412): a, c, t, g, unknown or other
  misc_feature (403)..(412): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgctagtgtattactgtcagcagtacggtagttcatctccgacgttcggccaagggaccaaggtggaaatacaaacgaactgtggctgcaccatctgtcttcatctccgccatctgntcgtagcactctgagcgggctggcaaggcgcanagnnnnnnnnnn

SEQ ID NO: 118447 - DNA, 180 bp, Homo sapiens
  misc_feature: GYAE6OF02GG9HY.29.60.F05.1.454.CMB.1.raw
  modified_base (156)..(180): a, c, t, g, unknown or other
  misc_feature (156)..(180): n is a, c, g, or t
tcagatagagtactcacgaccggtgctcgatttagtacgtcatcagggaaagggaccaaggtggaagtcaaaggaactgtggctgctaccatcttgtcttcatcttcccgccatctgatctctcgactctgagcggggctggcaaggcgcattagnnnnnnnnnnnnnnnnnnnnnnnnn

SEQ ID NO: 118448 - DNA, 435 bp, Homo sapiens
  misc_feature: GYAE6OF02HZZFB.29.60.F05.1.454.CMB.1.raw
  modified_base (239)..(239): a, c, t, g, unknown or other
  misc_feature (239)..(239): n is a, c, g, or t
  modified_base (377)..(377): a, c, t, g, unknown or other
  misc_feature (377)..(377): n is a, c, g, or t
  modified_base (415)..(415): a, c, t, g, unknown or other
  misc_feature (415)..(415): n is a, c, g, or t
  modified_base (422)..(435): a, c, t, g, unknown or other
  misc_feature (422)..(435): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacgtagttcatctcgacgttcggcctaagggacctaggtaggaaatcgaaaacgaactgtggctgcaccatctgtcttcatccttccgcctatctgactcgtanctacttcgtgaggcgggtcgtggccgtaaaggccgtanacgtagnnnnnnnnnnnnnn

SEQ ID NO: 118449 - DNA, 443 bp, Homo sapiens
  misc_feature: GYAE6OF02GCGMN.29.60.F05.1.454.CMB.1.raw
  modified_base (423)..(443): a, c, t, g, unknown or other
  misc_feature (423)..(443): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggacgcctgaagattttgcagtgtattactgtcagctaggtacggtagttcatctccgacgttcggccaagggaccaaggtaggaaatcaaacgactgtggctgcacatctgtcttcactccttcccgcctatctgactcgtacgctactcgtggagcgggtctcgggacctaagggcgacagtacgnnnnnnnnnnnnnnnnnnnnn

SEQ ID NO: 118450 - DNA, 416 bp, Homo sapiens
  misc_feature: GYAE6OF02IU27M.29.60.F05.1.454.CMB.1.raw
  modified_base (239)..(239): a, c, t, g, unknown or other
  misc_feature (239)..(239): n is a, c, g, or t
  modified_base (407)..(416): a, c, t, g, unknown or other
  misc_feature (407)..(416): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacgtagttcatctcgacgttcggccaagggaccaaggtggaaaatcgaaaacgaactgtaggctgcaaccatctgtcttcatcttcccgcatctgatcgtagcactctgagcgggctggacaaggcgacatagnnnnnnnnnn

SEQ ID NO: 118451 - DNA, 152 bp, Homo sapiens
  misc_feature: GYAE6OF02HX404.29.60.F05.1.454.CMB.1.raw
tcagatagagtactcacgaccggtgctcgatttagtacgtcatcagggaaagggaccaaggtggaagtcaaaggaactgtggctgcaccatctgtcttcatcttccccgccatctgatctctcgactctgagcgggctggcaaggcgcatag

SEQ ID NO: 118452 - DNA, 439 bp, Homo sapiens
  misc_feature: GYAE6OF02F1YBN.29.60.F05.1.454.CMB.1.raw
  modified_base (428)..(439): a, c, t, g, unknown or other
  misc_feature (428)..(439): n is a, c, g, or t
tcagatagagtactcacgaccggtgctcgatttagtacgtcatcagggaaagggccaccctctcgttgtagggccagtcagagtgttagcagcaactacttagacctggtaccagcagacacctggccaggctcccaggctcctcatccatggtgcatccaccagggccactggcatcccagacaggttcagtggcagtggtctgggacagacttcattctcaccatcagcagactggacgcctagaagattttgctaggtgtattactgtcagcagtacgtagttcatcgtccgcgttcggccaacgggccaaggtcgaactcgaaacgactgcgctgcgacatctcgtcttcacttcctccccgctactcctgtactcgtacgcactcgtgacggccggggcttcggacgaacgggcgacagtagnnnnnnnnnnnn

SEQ ID NO: 118453 - DNA, 439 bp, Homo sapiens
  misc_feature: GYAE6OF02HWPOG.29.60.F05.1.454.CMB.1.raw
  modified_base (239)..(239): a, c, t, g, unknown or other
  misc_feature (239)..(239): n is a, c, g, or t
  modified_base (287)..(287): a, c, t, g, unknown or other
  misc_feature (287)..(287): n is a, c, g, or t
  modified_base (401)..(401): a, c, t, g, unknown or other
  misc_feature (401)..(401): n is a, c, g, or t
  modified_base (411)..(439): a, c, t, g, unknown or other
  misc_feature (411)..(439): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtattcattcnccgacgttcggccaagggaccaaggtggaaatcaaagactgtggctgcacatctgtctcatctccgcctatctgtatcgtagctactcgtgagcgggctggccaaaggtccganagtaggcagnnnnnnnnnnnnnnnnnnnnnnnnnnnnn

SEQ ID NO: 118454 - DNA, 409 bp, Homo sapiens
  misc_feature: GYAE6OF02GJAAY.29.60.F05.1.454.CMB.1.raw
  modified_base (364)..(364): a, c, t, g, unknown or other
  misc_feature (364)..(364): n is a, c, g, or t
  modified_base (395)..(395): a, c, t, g, unknown or other
  misc_feature (395)..(395): n is a, c, g, or t
  modified_base (400)..(409): a, c, t, g, unknown or other
  misc_feature (400)..(409): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtgaaatcaaacgactgtggctgcacatctgtcttcatcttcccgcatctgtntcgtagcactctgagcggtctggcaggcganatagnnnnnnnnnn

SEQ ID NO: 118455 - DNA, 514 bp, Homo sapiens
  misc_feature: GYAE6OF02G4OL1.29.60.F05.1.454.CMB.1.raw
  modified_base (239)..(239): a, c, t, g, unknown or other
  misc_feature (239)..(239): n is a, c, g, or t
  modified_base (498)..(499): a, c, t, g, unknown or other
  misc_feature (498)..(499): n is a, c, g, or t
  modified_base (501)..(514): a, c, t, g, unknown or other
  misc_feature (501)..(514): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagtattttgctagttttattattgtcagcagacgaaacacgtcggcctccgttggaccggttccggaccgaaaggggtacccaaagggtggaaaactaccgaaaacggtaacgtggtacggaccttggacctaaccgtattaccgttgttcctttacacttcccgtttaccccgcctaacgttcctagtactcggtacgtacctaccgtccgtaggacggtcgggtacgtcggaccgaacgggccgactagtgnngnnnnnnnnnnnnnn

SEQ ID NO: 118456 - DNA, 153 bp, Homo sapiens
  misc_feature: GYAE6OF02HXGVD.29.60.F05.1.454.CMB.1.raw
  modified_base (151)..(153): a, c, t, g, unknown or other
  misc_feature (151)..(153): n is a, c, g, or t
tcagatagagtactcacgaccggtgctcgatttagtacgtcatcagggaaagggaccaaggtggaagtcaaaggaactgtggctgcaccatctgtcttcatcttcccgcatctgatatgtatactctgagcgggctggcaaggcgcatagnnn

SEQ ID NO: 118457 - DNA, 440 bp, Homo sapiens
  misc_feature: GYAE6OF02FF6X4.29.60.F05.1.454.CMB.1.raw
  modified_base (153)..(153): a, c, t, g, unknown or other
  misc_feature (153)..(153): n is a, c, g, or t
  modified_base (333)..(333): a, c, t, g, unknown or other
  misc_feature (333)..(333): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
  modified_base (400)..(400): a, c, t, g, unknown or other
  misc_feature (400)..(400): n is a, c, g, or t
  modified_base (406)..(407): a, c, t, g, unknown or other
  misc_feature (406)..(407): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
  modified_base (413)..(415): a, c, t, g, unknown or other
  misc_feature (413)..(415): n is a, c, g, or t
  modified_base (417)..(440): a, c, t, g, unknown or other
  misc_feature (417)..(440): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtncatccaccagggccactggcatcccagacaggttcagtgcagtgggtctgggacagactttcattctcaccatcagcagctggagcctgaatattttgcagtgttatactgtcagcagtacggtattcatctccgtacgttccgcgaagggaccaaggtggaaaactcaaaacgactggngctgcacatctgtcttcatcctcccgcatctnactctagctacnctgacgcgggctgacgagcgtanagtagnngncntnnntnnnnnnnnnnnnnnnnnnnnnnnn

SEQ ID NO: 118458 - DNA, 549 bp, Homo sapiens
  misc_feature: GYAE6OF02JF1F2.29.60.F05.1.454.CMB.1.raw
  modified_base (240)..(240): a, c, t, g, unknown or other
  misc_feature (240)..(240): n is a, c, g, or t
  modified_base (519)..(519): a, c, t, g, unknown or other
  misc_feature (519)..(519): n is a, c, g, or t
  modified_base (521)..(549): a, c, t, g, unknown or other
  misc_feature (521)..(549): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactgggancctgaagtattttgctagttgttattactgtcagtcaggtacggttagttacattcctaccggtaccgttcgggacccgaaagggtacctaaagggtacggaaaactaacgaaaaccggtaacgtggtacggtacgtacgaccaaccgtattccgttcgttacttactaactttcccgtaccccgtaccgtaacttccgttacgtacttaccggttacgtcctaaccgtccgtcgggtaggccgggtcgtacgggacgtaacggggcacgtaagtacgntnnnnnnnnnnnnnnnnnnnnnnnnnnnnn

SEQ ID NO: 118459 - DNA, 423 bp, Homo sapiens
  misc_feature: GYAE6OF02HOV4Z.29.60.F05.1.454.CMB.1.raw
  modified_base (403)..(423): a, c, t, g, unknown or other
  misc_feature (403)..(423): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtgttcatctcgacgttcgccaagggccaaggtggaaatcaaacgaactgtagctgcaccatctgtcttcattcttcccgctatctgatcgtagctactctgagcgggctgggcaaggcgcagtagnnnnnnnnnnnnnnnnnnnnn

SEQ ID NO: 118460 - DNA, 178 bp, Homo sapiens
  misc_feature: GYAE6OF02I6IFY.29.60.F05.1.454.CMB.1.raw
  modified_base (156)..(178): a, c, t, g, unknown or other
  misc_feature (156)..(178): n is a, c, g, or t
tcagatagagtactcacgaccggtgctcgatttagtacgtcatcagggaaagggacccaaggtggaagtccaaaggaactgtggcctgccaccatctgtcttcatcttcccgcatctgatctctcgactctgagcgggctggcaaggccgcatagnnnnnnnnnnnnnnnnnnnnnnn

SEQ ID NO: 118461 - DNA, 443 bp, Homo sapiens
  misc_feature: GYAE6OF02H4WCE.29.60.F05.1.454.CMB.1.raw
  modified_base (420)..(443): a, c, t, g, unknown or other
  misc_feature (420)..(443): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgcagtgtattactgtcagcagtacggtagttcatctccgacgttcggccaagggaccaagggtggaaaatcaaaacgactgtggactgcaccatctgtcttcatcttcccgctatctgatcgtgacctactctggacgcggggctgggacgaagggcgacgattaggnnnnnnnnnnnnnnnnnnnnnnnn

SEQ ID NO: 118462 - DNA, 535 bp, Homo sapiens
  misc_feature: GYAE6OF02IQ01B.29.60.F05.1.454.CMB.1.raw
  modified_base (500)..(500): a, c, t, g, unknown or other
  misc_feature (500)..(500): n is a, c, g, or t
  modified_base (502)..(504): a, c, t, g, unknown or other
  misc_feature (502)..(504): n is a, c, g, or t
  modified_base (506)..(535): a, c, t, g, unknown or other
  misc_feature (506)..(535): n is a, c, g, or t
tcagatagagtactcacgaccggtgctcgatttagtacgtcatcagggaaagagccaccctctcctgcagggccagtgagagtattgacatcttcttggcctggtaccaacagaaacctggccaggctccccgactcctcatttatgatgcataccaaaagggtcgttggcatcccagccagttcagtggcagtgggtctgggacagattcactctcacatcacagactagacgcctagaacgtattttgctagttttacttactgtcagacagcgtaacaacgtggtctcgtcgtttcgggcggacgggaccgtaagggtaggaggatacgaaaacgacgtggtcggctggaccaaccgtatcgtacgttcttaccgacttcccgtttccccgacgtaacttcgtacgtacgttaccgtaacgtccctaccgttactacggggaacgggtccgggtccggttagggaccgtaaacggggcctaacgtaaagttcgctgngnnncnnnnnnnnnnnnnnnnnnnnnnnnnnnnnn

SEQ ID NO: 118463 - DNA, 423 bp, Homo sapiens
  misc_feature: GYAE6OF02F41UZ.29.60.F05.1.454.CMB.1.raw
  modified_base (406)..(423): a, c, t, g, unknown or other
  misc_feature (406)..(423): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagtctgcaacctgaagattttgcaacttactactgtcaacagagttacaatttgcccatcactttcggcctaaggacacgactggagataaacgaactgtgctgcacatctgtcttcactcttcccgctactctagtactcgtagcactctgacgcgggctggacaggcgcatagnnnnnnnnnnnnnnnnnn

SEQ ID NO: 118464 - DNA, 172 bp, Homo sapiens
  misc_feature: GYAE6OF02GOU27.29.60.F05.1.454.CMB.1.raw
  modified_base (128)..(128): a, c, t, g, unknown or other
  misc_feature (128)..(128): n is a, c, g, or t
  modified_base (154)..(155): a, c, t, g, unknown or other
  misc_feature (154)..(155): n is a, c, g, or t
  modified_base (157)..(172): a, c, t, g, unknown or other
  misc_feature (157)..(172): n is a, c, g, or t
tcagatagagtactcacgaccggtgctcgatttagtacgtcatcagggaaagggaccgaaggtggaagtcaaaggaactgtggctgcaccatctgtcttcatcttcccgccatctgatctctcgactntgagtcgggctggcaaggcgcatagnntnnnnnnnnnnnnnnnn

SEQ ID NO: 118465 - DNA, 715 bp, Homo sapiens
  misc_feature: GYAE6OF02JF1EF.29.60.F05.1.454.CMB.1.raw
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
  modified_base (635)..(635): a, c, t, g, unknown or other
  misc_feature (635)..(635): n is a, c, g, or t
  modified_base (640)..(640): a, c, t, g, unknown or other
  misc_feature (640)..(640): n is a, c, g, or t
  modified_base (687)..(687): a, c, t, g, unknown or other
  misc_feature (687)..(687): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccacaggccactggcctatcccgagacaggttcaggtggcaggtggtctagggacagtacttcacttctcaccatcgacgcgtacgactgggacnccgtaggaagttntttcgactaaggttcgttattaccgtgtacacgtcgtaaggttaccggttagttacacttccggtaccggttaccggttacggtaacccgtaaacggggtacctaaaggggtaacggtaaactaaccgtaaaacggtaaccgttgggtaaccggtccgttaaccgtaccgaacccttaggttaccgtttaccggttactttaccgttacggttccccgtttacccgaccgtttacgttaccggtacggttaaccgtttacgttaaccggacccgtttaaccggtccggtttaacggggtccggtaaccggggtcgtttaaccggggaaacggaaccgggttcgaaaccggtttaccggagctacgtacgtntacgngtacgacgacgcgctcgtcgagtacgtcgtgtgcgtcgcgtctcgtnactgtcgcgtcgtacgcgtcgtacgtcg

SEQ ID NO: 118466 - DNA, 694 bp, Homo sapiens
  misc_feature: GYAE6OF02HQRYK.29.60.F05.1.454.CMB.1.raw
  modified_base (662)..(662): a, c, t, g, unknown or other
  misc_feature (662)..(662): n is a, c, g, or t
  modified_base (665)..(666): a, c, t, g, unknown or other
  misc_feature (665)..(666): n is a, c, g, or t
  modified_base (669)..(670): a, c, t, g, unknown or other
  misc_feature (669)..(670): n is a, c, g, or t
  modified_base (672)..(672): a, c, t, g, unknown or other
  misc_feature (672)..(672): n is a, c, g, or t
  modified_base (674)..(678): a, c, t, g, unknown or other
  misc_feature (674)..(678): n is a, c, g, or t
  modified_base (680)..(682): a, c, t, g, unknown or other
  misc_feature (680)..(682): n is a, c, g, or t
  modified_base (684)..(688): a, c, t, g, unknown or other
  misc_feature (684)..(688): n is a, c, g, or t
  modified_base (690)..(694): a, c, t, g, unknown or other
  misc_feature (690)..(694): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatccccagacaggttcagtggcaggtgggtctgggacaggtagttcacctctccaccatcagcagcctgcagtctagagtatttgactaatttattactgtcagctagtaattaaacttacgtggtccctaccggttacttaccgttttacgggcccggtaacgggggtaaccccaaagggtccgttaacggggaagtaaacgttaacccgtaaaaaaccggtaaaccggttcgggtacggggaccttacgggacccgtaaccccttaaacgtttccggtttacggtttacccttttaccttaaaacccgttttccccgttttaacccccggtacccgttaactttacccgtttaccggttaaccgtttaacccgggttacggtaacccttaacccggttaccggtacggggtaaccgggttccgggggtaccgtaccgggggtaaccgtaacggggaccggtacccgtaaagtacgcgtcgaccgtancgnncgnncngnnnnngnnncnnnnngnnnnn

SEQ ID NO: 118467 - DNA, 609 bp, Homo sapiens
  misc_feature: GYAE6OF02JYB8E.29.60.F05.1.454.CMB.1.raw
  modified_base (553)..(553): a, c, t, g, unknown or other
  misc_feature (553)..(553): n is a, c, g, or t
  modified_base (559)..(559): a, c, t, g, unknown or other
  misc_feature (559)..(559): n is a, c, g, or t
  modified_base (564)..(564): a, c, t, g, unknown or other
  misc_feature (564)..(564): n is a, c, g, or t
  modified_base (573)..(573): a, c, t, g, unknown or other
  misc_feature (573)..(573): n is a, c, g, or t
  modified_base (579)..(579): a, c, t, g, unknown or other
  misc_feature (579)..(579): n is a, c, g, or t
  modified_base (584)..(588): a, c, t, g, unknown or other
  misc_feature (584)..(588): n is a, c, g, or t
  modified_base (590)..(590): a, c, t, g, unknown or other
  misc_feature (590)..(590): n is a, c, g, or t
  modified_base (594)..(596): a, c, t, g, unknown or other
  misc_feature (594)..(596): n is a, c, g, or t
  modified_base (598)..(598): a, c, t, g, unknown or other
  misc_feature (598)..(598): n is a, c, g, or t
  modified_base (601)..(603): a, c, t, g, unknown or other
  misc_feature (601)..(603): n is a, c, g, or t
  modified_base (605)..(609): a, c, t, g, unknown or other
  misc_feature (605)..(609): n is a, c, g, or t
tcagatagagtactcacgaccggtgctcgatttagtacgtcatcaggaaagggccaccctctcttgtagggccagtcagagtgttagcagcaactacttagcctggtaccagcagacacctggccaggctcccaggctcctcatccatggtgcatccaccagggccactggcagtcccagaccaggttcagtggcagtgggtctgggacagacttcgattcgtcaccatcagtccagactggacgaccgtggaagtattttgacgtagttgttacgttacctgtccaagcgtaagtacgggttagttcaacgttcgtaccgtaccggtttcgggaccctaaacggggtacccgtaaagggttacggtaaacgtaacgtaaaaccggtaaaccgtggttaccggacgtttacggaaccctacccgtaagttccgtttacggtacctttacctacgtcccgtttaccccggacctacgtccttaagaccgttcggtacgtacctacgttcgacgtacggtcgggctacggaccgaggtccgaactaggttaacgngtacgntacgngtagtgcgngcgtgngtcgnnnnngnacgnnncncannncnnnnn

SEQ ID NO: 118468 - DNA, 435 bp, Homo sapiens
  misc_feature: GYAE6OF02GOYAL.29.60.F05.1.454.CMB.1.raw
  modified_base (417)..(435): a, c, t, g, unknown or other
  misc_feature (417)..(435): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgctagtgttattactgtcagcagtacggtagttcatctccgacgttcggccaagggaccaaggtagaaatacgaaacgaactggtgctgcacatctgtctcactcctcccgcctatctgatcgtacgctactctggacgtcgggctggaccgaaggcacagtagnnnnnnnnnnnnnnnnnnn

SEQ ID NO: 118469 - DNA, 587 bp, Homo sapiens
  misc_feature: GYAE6OF02IUAAV.29.60.F05.1.454.CMB.1.raw
  modified_base (227)..(227): a, c, t, g, unknown or other
  misc_feature (227)..(227): n is a, c, g, or t
  modified_base (548)..(548): a, c, t, g, unknown or other
  misc_feature (548)..(548): n is a, c, g, or t
  modified_base (553)..(555): a, c, t, g, unknown or other
  misc_feature (553)..(555): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (566)..(574): a, c, t, g, unknown or other
  misc_feature (566)..(574): n is a, c, g, or t
  modified_base (576)..(578): a, c, t, g, unknown or other
  misc_feature (576)..(578): n is a, c, g, or t
  modified_base (580)..(587): a, c, t, g, unknown or other
  misc_feature (580)..(587): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccaactggcatcccagacaggttcaggtcggcaggtcgggtctgggacacgacttcatttcncaccatcagcagctggacgcctgaagtacttttgactagttgtattactgtcagactacgttacggttagttccagttccgtaccgtacgtttccggaccgaacggggaccgtaaacgggtagggaaactaaccgaaaacggtaacgttacggtacgggtacctacgtaccgaaccctagttccgtttacgttacctttcgtaacgtttccccgttccccgtaccgttacgttaccgttagacgtttaccgtacgccctaaccgttctacgggacggtaccgggtcgtccgggaacgtaacgggccgacgtactaggaccngtcannngncnacngnannnnnnnnnannngnnnnnnnn

SEQ ID NO: 118470 - DNA, 421 bp, Homo sapiens
  misc_feature: GYAE6OF02GL4QR.29.60.F05.1.454.CMB.1.raw
  modified_base (403)..(421): a, c, t, g, unknown or other
  misc_feature (403)..(421): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctagaagtattttgctagtgtatactgtcagcagtacgtagttcatcctcgacgttcgccaagggtacaaggtcggaaatcaaacgactgtgctgcacatctgtcttcatcctccgcatctgatcgtagctactcgtgacgcgggctggacaggcgacatagnnnnnnnnnnnnnnnnnnn

SEQ ID NO: 118471 - DNA, 623 bp, Homo sapiens
  misc_feature: GYAE6OF02IYAIM.29.60.F05.1.454.CMB.1.raw
  modified_base (236)..(236): a, c, t, g, unknown or other
  misc_feature (236)..(236): n is a, c, g, or t
  modified_base (544)..(544): a, c, t, g, unknown or other
  misc_feature (544)..(544): n is a, c, g, or t
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
  modified_base (571)..(571): a, c, t, g, unknown or other
  misc_feature (571)..(571): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (598)..(598): a, c, t, g, unknown or other
  misc_feature (598)..(598): n is a, c, g, or t
  modified_base (607)..(607): a, c, t, g, unknown or other
  misc_feature (607)..(607): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccgagggcccactggcactcccagacaggttcacgtggcaggtcgggtctgggacagacttcattctcaccatcgngcagactggagcctagaagtatttgcgtagttgtattacgtgtacagtcgtaggtaccggttagttcacttcgtacccggtacggttccggacccgaaagggtacccgtaaggggtacgaaattaccgaaaacggtaactggtacggcctgccgaaccctagtcgttgttccttctacgttacccgttcccgtaccctagtttcccgtacgtacgtccggttaacgtcccgtaacgttccgtacgggtacggtaccgggggtccttacggggacccgtaaacggggcccgttacgtaacggttacgancgtcgctntcgntacgtctgtcacgtncgngngtcgcgtcgtacgctcgtcgcncgtcgtacncgacgagcgtctagcg

SEQ ID NO: 118472 - DNA, 455 bp, Homo sapiens
  misc_feature: GYAE6OF02G4BWX.29.60.F05.1.454.CMB.1.raw
  modified_base (383)..(383): a, c, t, g, unknown or other
  misc_feature (383)..(383): n is a, c, g, or t
  modified_base (431)..(431): a, c, t, g, unknown or other
  misc_feature (431)..(431): n is a, c, g, or t
  modified_base (437)..(455): a, c, t, g, unknown or other
  misc_feature (437)..(455): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggggacaggacttcattctcaccatcagcagactggagcctaggaagtacttttgactagttgttattactgtcagcagttacggtagttcattcctccggtacgttcggacctaagggaccaagggtcggaaatcgaaaacgtatgtggctgaccacatctgtcttacactccgtcccnctatcgtcgtagtcgtagcctctcgtgacgcgggtctggacgagcganagtagnnnnnnnnnnnnnnnnnnn

SEQ ID NO: 118473 - DNA, 546 bp, Homo sapiens
  misc_feature: GYAE6OF02F7Q15.29.60.F05.1.454.CMB.1.raw
  modified_base (252)..(252): a, c, t, g, unknown or other
  misc_feature (252)..(252): n is a, c, g, or t
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (498)..(498): a, c, t, g, unknown or other
  misc_feature (498)..(498): n is a, c, g, or t
  modified_base (507)..(546): a, c, t, g, unknown or other
  misc_feature (507)..(546): n is a, c, g, or t
tcagatagagtactcacgaccggtgctcgatttagtacgtcatcagggaaagggctggagtgggttggccgtattggaagcaaaactaacaattacgcgacaacatatgctgcgtcggtgaaaggcaggttcaccatctccagagatgattcaaagaacacggcgtatctgcaaatgagcagcctagaaaaccgaggaccacggccgtctaattaccgtgtgactagacctagtggctcgtccgactggtanaagttccgacccgtgggggcccggaaccctggtcaccgtctcctcggcctccaccaggcccagtccggtccttccccnggctccctgacctccgaggacnccncctaccgagacgtaccaacgaggtcccggccccgtgggggaccctgggtcccgtgggtacccaaaagggtaccctttacctttcccccgagtttcctacggtacgtggacgggtccgggcgtacgggacctaaagggcccganaacgtacgnnnnnnnnnnnnnnnnnnnnnnnnnnnnnnnnnnnnnnnn

SEQ ID NO: 118474 - DNA, 512 bp, Homo sapiens
  misc_feature: GYAE6OF02IG4G1.29.60.F05.1.454.CMB.1.raw
  modified_base (247)..(247): a, c, t, g, unknown or other
  misc_feature (247)..(247): n is a, c, g, or t
  modified_base (491)..(512): a, c, t, g, unknown or other
  misc_feature (491)..(512): n is a, c, g, or t
tcagatagagtactcacgaccggtgctcgatttagtacgtcatcagggaaagggccaccctctcgttgtagggccagtcagagtgttagcagcaactacttagcctggtaccagcagacacctggccaggctcccaggctcctcatccatcggtagcatcccaccagggccactggcactcccagacaggttcagtggcaggtgggtctgggacaggacttcattctcaccatcagcagacgtggancctgaagtattttgactagtgtattactgtcagcagtacgtgttcattccgtccggacgttcggacctaagggaaccaagggtagaaattaccgaaaacgtactggtagcgtcgacaccatcttagtcttcgacttccctttccccgacctacttccgtacgtaacttccggtataccctccgttcgtaacgggcggtaccggggtacgttacgggaccggtaacggccgtaacgttagaggcnnnnnnnnnnnnnnnnnnnnnn

SEQ ID NO: 118475 - DNA, 451 bp, Homo sapiens
  misc_feature: GYAE6OF02GHKLQ.29.60.F05.1.454.CMB.1.raw
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
  modified_base (423)..(451): a, c, t, g, unknown or other
  misc_feature (423)..(451): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtggtctgggacagacttcattctcaccatcagcagactggagcctgaagtattttgcagtgtattactgtcagcaggtacggtagttcatcgtccggacgttcggaccgaagggaccaaggtacgaaatacgaaacgtactgtggctgcacatctagtcttacatccttcccgctatcctgactcgtancactntggagcggtctggacaggcganactacgcgncnnnnnnnnnnnnnnnnnnnnnnnnnnnnn

SEQ ID NO: 118476 - DNA, 604 bp, Homo sapiens
  misc_feature: GYAE6OF02FEQVB.29.60.F05.1.454.CMB.1.raw
  modified_base (152)..(152): a, c, t, g, unknown or other
  misc_feature (152)..(152): n is a, c, g, or t
  modified_base (244)..(244): a, c, t, g, unknown or other
  misc_feature (244)..(244): n is a, c, g, or t
  modified_base (565)..(565): a, c, t, g, unknown or other
  misc_feature (565)..(565): n is a, c, g, or t
  modified_base (571)..(571): a, c, t, g, unknown or other
  misc_feature (571)..(571): n is a, c, g, or t
  modified_base (576)..(577): a, c, t, g, unknown or other
  misc_feature (576)..(577): n is a, c, g, or t
  modified_base (579)..(579): a, c, t, g, unknown or other
  misc_feature (579)..(579): n is a, c, g, or t
  modified_base (581)..(591): a, c, t, g, unknown or other
  misc_feature (581)..(591): n is a, c, g, or t
  modified_base (593)..(604): a, c, t, g, unknown or other
  misc_feature (593)..(604): n is a, c, g, or t
tcagatagagtactcacgaccggtgctcgatttagtacgtcatcagggaagggccaccctctcttgtagggccagtcagagtgttagcagcaactacttagcctggtaccagcagacacctggccaggctcccaggctcctcatccatggtncatccaccagggccactggcatcccagacaggttcagtggcagtgggtctgggacagacctttcattctcaccatcagcaggaccgtggacnccgttagaacgtaatttttggactaggtcggtttaattaccttggttacagcgtaagttacgggttagttctactcgttccgtaacgtttccgggaccaaggggaaccctaaggggttaacggaaaataccgaaaaccggtaaacttcgggtacggacctttaggcccgaaaccgtatttccgttaggttcccttttactaccgttaccccttttccccggccctaactttccgtacgtaactttccggttaacgacctaccgttccgtttacgggaacgttccggggaccttggggacctaaacgggcgacacgttagcngtagcngtacnntngnnnnnnnnnnncnnnnnnnnnnnn

SEQ ID NO: 118477 - DNA, 471 bp, Homo sapiens
  misc_feature: GYAE6OF02IT5J0.29.60.F05.1.454.CMB.1.raw
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (448)..(471): a, c, t, g, unknown or other
  misc_feature (448)..(471): n is a, c, g, or t
tcagatagagtactcacgaccggtgctcgatttagtacgtcatcagggaaagggccacccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagccgtagaagtacttttgcagtgtattactgtcagcagtacggtagttcattctccgtacgttcggaccgaagggaccgaaggtagaaagtacaaaacgaactgtggactgacaaccatctgtcttctacttcctcccgctactcctgtactcgtacgtccactctggacggcggtcgtcggacgaacgggcgtcagttagnagtcncnnnnnnnnnnnnnnnnnnnnnnnn

SEQ ID NO: 118478 - DNA, 563 bp, Homo sapiens
  misc_feature: GYAE6OF02HXBFA.29.60.F05.1.454.CMB.1.raw
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (485)..(485): a, c, t, g, unknown or other
  misc_feature (485)..(485): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (538)..(549): a, c, t, g, unknown or other
  misc_feature (538)..(549): n is a, c, g, or t
  modified_base (551)..(554): a, c, t, g, unknown or other
  misc_feature (551)..(554): n is a, c, g, or t
  modified_base (556)..(563): a, c, t, g, unknown or other
  misc_feature (556)..(563): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctccctcatccatggtgcatccaccagggccactggcatcccagacaggttcagtggcaggtgggtctgggacagacttnacttcnccaccatcacgcagacgtaggagaccgtgaagtatttttcgctaggttgtattactgtcagctaggtaccggtagttctatccgtaccgtacggttcggccgtaacgggaacctaagggtaggaaaactaccgaaaacggtaaccgtggtacggtacctacggtacaaccgtattcctagttccttacctacgttcccttaccccgacctacttcctaggtattcccggtacgtcctacgtccgtacggcgggtacccgggngtacggggtacgaacggggacctaccgacgttaggctacgnacgngtcagtcnnnnnnnnnnnngnnnncnnnnnnnn

SEQ ID NO: 118479 - DNA, 614 bp, Homo sapiens
  misc_feature: GYAE6OF02H05V6.29.60.F05.1.454.CMB.1.raw
  modified_base (152)..(152): a, c, t, g, unknown or other
  misc_feature (152)..(152): n is a, c, g, or t
  modified_base (250)..(250): a, c, t, g, unknown or other
  misc_feature (250)..(250): n is a, c, g, or t
  modified_base (295)..(295): a, c, t, g, unknown or other
  misc_feature (295)..(295): n is a, c, g, or t
  modified_base (574)..(574): a, c, t, g, unknown or other
  misc_feature (574)..(574): n is a, c, g, or t
  modified_base (580)..(580): a, c, t, g, unknown or other
  misc_feature (580)..(580): n is a, c, g, or t
  modified_base (582)..(583): a, c, t, g, unknown or other
  misc_feature (582)..(583): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (591)..(599): a, c, t, g, unknown or other
  misc_feature (591)..(599): n is a, c, g, or t
  modified_base (601)..(609): a, c, t, g, unknown or other
  misc_feature (601)..(609): n is a, c, g, or t
  modified_base (611)..(614): a, c, t, g, unknown or other
  misc_feature (611)..(614): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctccaggctcctcatccatggtncatcccaccagggccactggcactcccagacaggttcagtggctaggtgggtctgggacagtacttcattcctcaccgatcgagctaagacgtggacnccgtagaaagttagtttttgaccgtaggttagtaactttaaccgnggttaccaggtaccgtaagggttaacggttagttttaccacgttccgtaccggttacgggtttaccggaccgtaaacggggaaccctaagggtacgtaaaacttaacgaaacgtacgttggtaccggtactcggacctactagttccgttacgttaccgtttacaccgttccccgttacccgaccttaacgttccgtacgtacttacggtacgacctacgttcggtaggacggtaccggggtacgtacggacgtaaaccggtacaccgtaaagtcgtangcagtnannagtnangnnnnnnnnngnnnnnnnnnannnn

SEQ ID NO: 118480 - DNA, 564 bp, Homo sapiens
  misc_feature: GYAE6OF02HXAMP.29.60.F05.1.454.CMB.1.raw
  modified_base (533)..(533): a, c, t, g, unknown or other
  misc_feature (533)..(533): n is a, c, g, or t
  modified_base (536)..(564): a, c, t, g, unknown or other
  misc_feature (536)..(564): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggggacagattcatttcctcaccatcagcagactggagcctgaagtatttttcgcagttgttatttacgtgtcagctaggttacggttagtttcagttcctcccggtacggtttcggaccgaaacgggacctaaagggtacggaaaattaccgaaaaacggaacgttagggtcggacttcgggacctaaccgtattccgtacggttcctttacctaactttccctccccggtaccctaacgttccgtagtactttacggtaccgacctaccttccgtaggacggtccgggtcgacgggaccgtaaagggcccgtaataccgtaaggcagnacnnnnnnnnnnnnnnnnnnnnnnnnnnnnn

SEQ ID NO: 118481 - DNA, 565 bp, Homo sapiens
  misc_feature: GYAE6OF02H3HXA.29.60.F05.1.454.CMB.1.raw
  modified_base (254)..(254): a, c, t, g, unknown or other
  misc_feature (254)..(254): n is a, c, g, or t
  modified_base (431)..(431): a, c, t, g, unknown or other
  misc_feature (431)..(431): n is a, c, g, or t
  modified_base (530)..(531): a, c, t, g, unknown or other
  misc_feature (530)..(531): n is a, c, g, or t
  modified_base (536)..(537): a, c, t, g, unknown or other
  misc_feature (536)..(537): n is a, c, g, or t
  modified_base (539)..(565): a, c, t, g, unknown or other
  misc_feature (539)..(565): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatcccaccagggccactggcactcccagacaggtcagtggcaggtgggtctgggacagtacttcattcctcaccatcagcaggactggagcctgaaagtntttgctagttgtacttatgtacagcgagttacgtagttcattccgtccggacgttccggacgaacgggtaccaagggtacggaaacgtacgaaaaccgtaacgtggtacggcctacggtactacctaacgttcgtttaacgttccttaccgtaacttcccgttaccccgcccgttanaccgtttacggtagtttaccgaccggttacctaaccgttccggtggaaaccgggtccgggacgtcgggtaaccgaaggtaccgggactaacggtagtcnngcgcnngnnnnnnnnnnnnnnnnnnnnnnnnnnn

SEQ ID NO: 118482 - DNA, 653 bp, Homo sapiens
  misc_feature: GYAE6OF02G7KQX.29.60.F05.1.454.CMB.1.raw
  modified_base (143)..(143): a, c, t, g, unknown or other
  misc_feature (143)..(143): n is a, c, g, or t
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
  modified_base (523)..(523): a, c, t, g, unknown or other
  misc_feature (523)..(523): n is a, c, g, or t
  modified_base (545)..(545): a, c, t, g, unknown or other
  misc_feature (545)..(545): n is a, c, g, or t
  modified_base (571)..(571): a, c, t, g, unknown or other
  misc_feature (571)..(571): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggcctccaggctcctnatccatggtgcactccacgagggccacgtggcatcccagactggttcaggtgcgaggtggtcgtagggacngacttcattcctcaccgatcgaagcagtactggacncctggaagtatttggacgtagtgtacttactgactagacctaggtacggtatcgacttcggtccgtacgttccggaccgtaagggtaccgtaaagggtagtaaacgtaacgaaacggtacttggtgtaccgacgactaaccagttccgtacgttccttacgtaccttccccgtacccttcacgtttccgtacgtacgttaccggtatacctcggttacgtacggtacggcgggtacgtcgggaacccgtaacgggttaccgtactaacgggtntactacgtcaacggtcagtacncgtacgcgttagaccgtgaccgttanacgttacccgagttcgacggttacggaactcgggtacaccggttgtaacccgggtctaccggtacggtacgttcgaccgttc

SEQ ID NO: 118483 - DNA, 731 bp, Homo sapiens
  misc_feature: GYAE6OF02GWU0Z.29.60.F05.1.454.CMB.1.raw
  modified_base (241)..(241): a, c, t, g, unknown or other
  misc_feature (241)..(241): n is a, c, g, or t
  modified_base (620)..(620): a, c, t, g, unknown or other
  misc_feature (620)..(620): n is a, c, g, or t
  modified_base (638)..(638): a, c, t, g, unknown or other
  misc_feature (638)..(638): n is a, c, g, or t
  modified_base (642)..(642): a, c, t, g, unknown or other
  misc_feature (642)..(642): n is a, c, g, or t
  modified_base (648)..(648): a, c, t, g, unknown or other
  misc_feature (648)..(648): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctggacagacttcattctacaccatcgagcagactggacncctgaatgttttgcctagttgtaattactgttcagtacaggttaacggtagtttcagttcttccggacgtttccggaccgaaaggggacctaaagggtacgggaaacttacaaaaccggtaatcgggtaggtaccttggacccgtaacccgtaacgttccttacggttaccttttacccaaccgtttaccccggtttacccccgaaccccgtttaacgttcccgtttagggtaaccgtttacccgggtttaaccgtacccgttaacccgttaccccgtttaacgggtaaacggggtccccgggggggtaacctttacggggggaaacccgttaaaccggggggaccccgggttaacgttaaaacgttacggggttaacngtaaccgtgaccgtttanacgnacgtanacgtgagacgacgacgacacgtacgtacgtcgtacgtacgtacgtacgtacgttacgtcgtacgtacgtacgtacgtacgacg

SEQ ID NO: 118484 - DNA, 162 bp, Homo sapiens
  misc_feature: GYAE6OF02F6CWC.29.60.F05.1.454.CMB.1.raw
  modified_base (152)..(162): a, c, t, g, unknown or other
  misc_feature (152)..(162): n is a, c, g, or t
tcagatagagtactcacgaccggtgctcgatttagtacgtcatcagggaaagggaccaaggtggaagtcaaaggaactgtggctgcaccatctgtcttcatcttcccgccatctgatctctcgactctgagcgggctggcaaggcgcatagnnnnnnnnnnn

SEQ ID NO: 118485 - DNA, 551 bp, Homo sapiens
  misc_feature: GYAE6OF02GK9SV.29.60.F05.1.454.CMB.1.raw
  modified_base (216)..(216): a, c, t, g, unknown or other
  misc_feature (216)..(216): n is a, c, g, or t
  modified_base (517)..(517): a, c, t, g, unknown or other
  misc_feature (517)..(517): n is a, c, g, or t
  modified_base (520)..(523): a, c, t, g, unknown or other
  misc_feature (520)..(523): n is a, c, g, or t
  modified_base (525)..(551): a, c, t, g, unknown or other
  misc_feature (525)..(551): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctccctcatccatggtgcatccaccagggccactggcatcccagacaggttcagtggcagtgggtctgggacagacttnattctcaccatcagcagacgtggacgcctaggaagtattttgactaggtagttaattacgtgtacgagacctaggttaacgggtattctaacgttccgttaccggaccggtttccgggaacccggtaaacgggtaacccgaagggtaacgaaaacgtacctaaaacggaacgtagtggacctacgactaacctactcgtacgttctttactacttcctccccgtactaacttcctagtactccgtaacgtctaccgtcgtacggacggcggaccggtacggacggaacggcacgtataggnagnnnncnnnnnnnnnnnnnnnnnnnnnnnnnnn

SEQ ID NO: 118486 - DNA, 579 bp, Homo sapiens
  misc_feature: GYAE6OF02F5SLJ.29.60.F05.1.454.CMB.1.raw
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
  modified_base (505)..(506): a, c, t, g, unknown or other
  misc_feature (505)..(506): n is a, c, g, or t
  modified_base (510)..(510): a, c, t, g, unknown or other
  misc_feature (510)..(510): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
  modified_base (533)..(533): a, c, t, g, unknown or other
  misc_feature (533)..(533): n is a, c, g, or t
  modified_base (544)..(544): a, c, t, g, unknown or other
  misc_feature (544)..(544): n is a, c, g, or t
  modified_base (573)..(573): a, c, t, g, unknown or other
  misc_feature (573)..(573): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggccatcccagacaggttcagtggcaggtgggtctgggacagtacttcattctcaccatcagcagtacgtggactcctaggagtagttttgctagtacgttattacgtgtcagcgtagttacggtagttctactcgtaccgtacggttcggaccgaaggaccaaggtaggtaacgtaccgaaacggtacttggtacgtcgtacgaccgtactacgttctcggttacctttacaccgtttccctccccgacctacgttcctagtaccgttcgtaccgtacgtcttggcgtacggccgggtcgtagggaccgtaaggccgtagtactcgnactnacnncgangancgtncganactgcttagcgngctagagtacncgtacgcgtcgacgtgtacgacgtacggngtaccg

SEQ ID NO: 118487 - DNA, 647 bp, Homo sapiens
  misc_feature: GYAE6OF02F07CT.29.60.F05.1.454.CMB.1.raw
  modified_base (181)..(181): a, c, t, g, unknown or other
  misc_feature (181)..(181): n is a, c, g, or t
  modified_base (612)..(612): a, c, t, g, unknown or other
  misc_feature (612)..(612): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (637)..(637): a, c, t, g, unknown or other
  misc_feature (637)..(637): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
tcagatagagtactcacgaccggtgctcgatttagtacgtcatcagggaaagggccaccctctcttgtagggccagtcagagtgttagcagcaactacttagcctggtaccagcagacacctggccaggctcccaggctcctcatctatgatgcatccacgaagggccatgatatcccganccaggttcagtgcaggtgggtctgggacagtagttcactctccaccgatcagcgacgccgtgctacgtctagtaaagtattttacggaccttaaattttacgttacgttgtactagtactagttaattaacgttaactcggtaccttaccgttaacttaccgttttagggacccggaacggggaacccaaagtccgtaaggataacgtaccgaaacggtaacgtggtacgtacgttcgaccgtacctaacgttcttaggttccttacgtaccgttcccttacccgtacgtaccttcgtacgttacgttccggtacgtaccgtaccgttaccgttacgggtaccggacgggtacggttcggtaacccggtaaggacccgtaagtaacggtacggtacacgtcaacgctacggattccgatcggtagctacgngctagcactagacgngngtcgcgtntganangtcg

SEQ ID NO: 118488 - DNA, 493 bp, Homo sapiens
  misc_feature: GYAE6OF01AIL4I.42.37.D04.1.454.CMB.1.raw
  modified_base (483)..(483): a, c, t, g, unknown or other
  misc_feature (483)..(483): n is a, c, g, or t
  modified_base (488)..(493): a, c, t, g, unknown or other
  misc_feature (488)..(493): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagaatttgttgggggcttctttgactatagaggccagggtaccctggtcaccgtctcctcagcctccaccaagggcccatcggtcttccccctggcgccctgctccaggcgcacctccgagacgcacgagccggccctggggcctggccctggtccaaggactacttccacatacgtcactgagcgggctggcaggcncatgnnnnnn

SEQ ID NO: 118489 - DNA, 499 bp, Homo sapiens
  misc_feature: GYAE6OF01AMI4Y.42.37.D04.1.454.CMB.1.raw
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
  modified_base (492)..(499): a, c, t, g, unknown or other
  misc_feature (492)..(499): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagaatttgttgggggcttcgtttgactatagaggccagggtaccctggtcaccgtctcctcagcctccaccaaggcccatccggtcttccccctggccgccctgcctccaggacgccacctccgagacgcacagccggccctgggcctgcctggtccaaggctaccttccacatacgtcactgagcgggctggcaggcncagtgngnnnnnnnn

SEQ ID NO: 118490 - DNA, 479 bp, Homo sapiens
  misc_feature: GYAE6OF01B5JXL.42.37.D04.1.454.CMB.1.raw
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
  modified_base (471)..(479): a, c, t, g, unknown or other
  misc_feature (471)..(479): n is a, c, g, or t
tcagtgacgtatgtcacgaccggtgctcgatttagtagcatactgttgggtttgagggcccagtctgtgttgacgcagccgccctcaatgtctgcggccccaggacagaaggtcaccatctcctgctctggaagcagctccaacattggaggtaattatgtctcctggtaccagcagctcccaagaacagcccccaaaacttctcatttatgacaatgataagcggccctnagggattcctgaccgattctctggctccaagtctggcacgtctgccaccctggccatcaccggactccagactgganacgaggccgattattactgcggaacgtgggataccagcctgagtgcgggctagtcggcggaggaccaagctgaccgtctaggtcagcccaaggctgcccctggtcactctcgttcccgccctcctcacactacgtcactgacgcggctggcaaggcgcatagnnnnnnnnn

SEQ ID NO: 118491 - DNA, 492 bp, Homo sapiens
  misc_feature: GYAE6OF01CLRY8.42.37.D04.1.454.CMB.1.raw
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
  modified_base (324)..(324): a, c, t, g, unknown or other
  misc_feature (324)..(324): n is a, c, g, or t
  modified_base (354)..(354): a, c, t, g, unknown or other
  misc_feature (354)..(354): n is a, c, g, or t
  modified_base (482)..(492): a, c, t, g, unknown or other
  misc_feature (482)..(492): n is a, c, g, or t
tcagtgacgtatgtcacgaccggtgctcgatttagtagcatactgttgggtttgagggcccagtctgtgttgacgcagccgccctcaatgtctgccggccccaggacagaaggtcaccatctcctgctctggaagcagctccaacattggagtaattatgtctcctggtaccagcagctcccaaagaacagcccccaaattctcatttangacaatgataagcggccctnagggattcctgaccgattctctggctccaagtctggcacgtctgccaccctggccatcaccggactccagactggagacgagccgattattacngcgaacgtggataccagcctgagtgcgggntagttcggcggagggaccaagctgaccgtcgtaggtcagcccaaggcctcgccccctcggtcctactcctcgttcccgccctcctcacactacgtccacgtgacgcgggctggcaaggcgcatagcgnnnnnnnnnnn

SEQ ID NO: 118492 - DNA, 587 bp, Homo sapiens
  misc_feature: GYAE6OF01B8T51.42.37.D04.1.454.CMB.1.raw
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttattgactggaccagtcaccagttcttaccatccaaactggttccagcaaagacctggacacggcccacggcgttagttatggtgcgactaacaagcactcctggacccctgcccggttttcacggctcccgtcgtcggggcaaagctcgccctgactctcgtccggtgttcagcctgaggacgaggctgactattactcgccctcctcattgtatgatgacgtcgttggtagttttcgggcgggacgggacccggcgtcggtacccgtccgtgggtccgacgcccgaacggcctccggcccccgtcgggtcctaccgttccgtccgttcccccaccccttcccgtacccacactacccgtccgtacgtcggg

SEQ ID NO: 118493 - DNA, 521 bp, Homo sapiens
  misc_feature: GYAE6OF01C4KR0.42.37.D04.1.454.CMB.1.raw
  modified_base (404)..(404): a, c, t, g, unknown or other
  misc_feature (404)..(404): n is a, c, g, or t
  modified_base (511)..(521): a, c, t, g, unknown or other
  misc_feature (511)..(521): n is a, c, g, or t
tcagtgacgtatgtcacgaccggtgctcgatttagtagcatactgttgggtttcctgcaagacttctggattttcgttcacgacctactacatgcactgggtgcgacaggccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagtaatttggtggggtcttctttgactatagagcaggtaccctggtcacgtctctcagcctccacaaggcccatccggtcttccccgtgccgccctgctccgaggcgcacctccgagacnccacgaggccggcctggggcctcgcccgtggtaccgaaggtactaccgtttaccaaccgtattacccgtacactacgaggccgggcgtggacgaaggccgcagtagnnnnnnnnnnn

SEQ ID NO: 118494 - DNA, 490 bp, Homo sapiens
  misc_feature: GYAE6OF01DKOE5.42.37.D04.1.454.CMB.1.raw
  modified_base (327)..(327): a, c, t, g, unknown or other
  misc_feature (327)..(327): n is a, c, g, or t
  modified_base (473)..(473): a, c, t, g, unknown or other
  misc_feature (473)..(473): n is a, c, g, or t
  modified_base (479)..(490): a, c, t, g, unknown or other
  misc_feature (479)..(490): n is a, c, g, or t
tcagtgacgtatgtcacgaccggtgctcgatttagtagcatactgttgggtttgagggcccagtctgtgttgacgcagccgccctcaatgtctgcggccccaggacagaaggtcaccatctcctgctctggaagcagctccaacattggaggtaattatgtctcctggtaccagcagctcccaagaacagccccccaaaacttctcatttatgacaaatgataagcggccctcagggattcctgaccgattctctggctccaagtctggcacgtctgcccacctggccatcaccggactccagactggagacgaggccgattatacngcggaacgtggataccagcctgagtgcggggctagtcggcggagggaccaagctgaccgtcctaggtcagcccaaggctcgccccctggtccactctcgtccccaccctcctcacactaccgtcactgagcgggctgggcaaggcncatagnnnnnnnnnnnn

SEQ ID NO: 118495 - DNA, 485 bp, Homo sapiens
  misc_feature: GYAE6OF01C5W0L.42.37.D04.1.454.CMB.1.raw
  modified_base (326)..(326): a, c, t, g, unknown or other
  misc_feature (326)..(326): n is a, c, g, or t
  modified_base (356)..(356): a, c, t, g, unknown or other
  misc_feature (356)..(356): n is a, c, g, or t
  modified_base (413)..(413): a, c, t, g, unknown or other
  misc_feature (413)..(413): n is a, c, g, or t
  modified_base (430)..(430): a, c, t, g, unknown or other
  misc_feature (430)..(430): n is a, c, g, or t
  modified_base (472)..(473): a, c, t, g, unknown or other
  misc_feature (472)..(473): n is a, c, g, or t
  modified_base (475)..(485): a, c, t, g, unknown or other
  misc_feature (475)..(485): n is a, c, g, or t
tcagtgacgtatgtcacgaccggtgctcgatttagtagcatactgttgggtttgagggcccagtctgtgttgacgcagccgccctcaatgtctgcggccccaggacagaaggtcaccatctcctgctctggaagcagctccaacattggaggtaattatgtctcctggtaccagcagctcccaagaacagcccccaaaacttctcatttatgacaatgataagcggccctcagggattcctgaccgattctctggcctccaagtctggcacgtctgccaccctggccatccaccggactccagactggagacgaggccattatacngcggaagtggataccagctgagtgcgggtntagtcggcggaggaccaagctagaccgtcctaggtcagccaaggctcgccctcggcnctctcgtcccacctccncacactaccgtcactgacgcggctggcaacggcgacagtagnngnnnnnnnnnnn

SEQ ID NO: 118496 - DNA, 616 bp, Homo sapiens
  misc_feature: GYAE6OF01AXRAC.42.37.D04.1.454.CMB.1.raw
  modified_base (410)..(410): a, c, t, g, unknown or other
  misc_feature (410)..(410): n is a, c, g, or t
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttatgactggaccagtcaccagttcttaccatccaaactggttccagcaaagacctggacaccggcccacggcgttagtttatggtgcgactaacaagcactcctggacccctgccccggttttcacggtcctccccgtcggtccggggcaaacgctcgccctgactctcgtccggtgttcacgccgtgacggacgnggcgtgactattactcgtccctcctctattgtatgtatgacgtcggtggtacgttttcgggcgggtacgggacccggtcgtccggtaccggttccgtcgggtccacggcccgaacggtccgtaccggcccccgttccggtcctaccttccgttcccggttcccccgtccccttccctcctacctacttaccgtccgtacgtacggg

SEQ ID NO: 118497 - DNA, 614 bp, Homo sapiens
  misc_feature: GYAE6OF01DBJTM.42.37.D04.1.454.CMB.1.raw
  modified_base (170)..(170): a, c, t, g, unknown or other
  misc_feature (170)..(170): n is a, c, g, or t
  modified_base (395)..(395): a, c, t, g, unknown or other
  misc_feature (395)..(395): n is a, c, g, or t
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctnactgactgtgtcccccggagggacagtcactctcacatgtgctttattgactggaccagtcaccagttcttaccatccaaactggttccagcaaagacctgacacggcccaggcgttagttatggtgcgactaacaagcactcctggacccctgtcccggttttcacggctccctcggtcggggcaagctgccctgactcgtgtccggtgtcagcctgaggacgnggctgactattactcgcctcctcatgtatgatgacgcggttggtacgttttcgggcgggtacgggacccgggtccgtacggtacccggttaccgttcggggttaccgacggtcccgaaacgggtccgttccggcccccgttccgggtccgtaaccgtttccgttccggttccccggtccccttcccgtcctactacgttaacccgtcgtaccgtacggg

SEQ ID NO: 118498 - DNA, 580 bp, Homo sapiens
  misc_feature: GYAE6OF01DI8C4.42.37.D04.1.454.CMB.1.raw
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(580): a, c, t, g, unknown or other
  misc_feature (571)..(580): n is a, c, g, or t
tcagtgacgtatgtcacgaccggtgctcgatttagtagcatactgttgggtttcctgcaagacttctggattttcgttcacgacctactacatgcactgggtgcgacaggccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagtaatttggtggggctttctttgactatagaggccagggtaccctggtcaccgtctcctcacgcctccaccgaacgggcccagtccggtcttccccgttggcccgccctgcctccgaggcgccacctccggagacgccaacgacgcccggccctggggcctcggcccgtgggtacccaaacgggtaccttaccgttcccgaaccgtaacgttacccggtcctaaccgttcgggaacgggtccggggccgttcgggaccgaacggggccgaccgagttacggncngnnnnnnnnnn

SEQ ID NO: 118499 - DNA, 605 bp, Homo sapiens
  misc_feature: GYAE6OF01CKWLS.42.37.D04.1.454.CMB.1.raw
  modified_base (588)..(588): a, c, t, g, unknown or other
  misc_feature (588)..(588): n is a, c, g, or t
  modified_base (592)..(592): a, c, t, g, unknown or other
  misc_feature (592)..(592): n is a, c, g, or t
  modified_base (599)..(600): a, c, t, g, unknown or other
  misc_feature (599)..(600): n is a, c, g, or t
  modified_base (602)..(603): a, c, t, g, unknown or other
  misc_feature (602)..(603): n is a, c, g, or t
  modified_base (605)..(605): a, c, t, g, unknown or other
  misc_feature (605)..(605): n is a, c, g, or t
tcagtgacgtatgtcacgaccggtgctcgatttagtagcatactgttgggtttcctgcgaagacttctggattttcgttcacgacctactacatgcacctgggtgcgacaggcccctggacagggacttgagtggatgggaattatcatccctagttctgccgcaccaactacgcacagaagtttcagggcagagtcaccatggaccggggacacggtccacgaccacggtctacagtggactgagctagcctgagatatgacgacacggccatatattactgtgtcgagagtaatttggtggggtctttctttgactatagaggccaggtaccctggtcacgtcctcctcacgcctaccgaccgaacggccacgtcggtccttcccccgtaggccgtccgtcgcctccgacggaccgccgtaccctccgagacgaccgaacgacggcccggtcccgtgggccttcggcccgttggtaccgtaacgggtaccttaccgtttaccaaccgtaacgttaccgtacctacgtaggaacggtccggggaccgtagggaccgaacggggccgtacgaacgttaaggcgacgtnacgnacgcacnncnngn

SEQ ID NO: 118500 - DNA, 638 bp, Homo sapiens
  misc_feature: GYAE6OF01D4G4C.42.37.D04.1.454.CMB.1.raw
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtcgtcccccggagggacagtcactctcacatgtgctttattgactggaccagtcacagttctacatccaaatgttccagcaaagacctggacacggcccacggcgttagttatggtgcgactacaagcactcctcggacccctgtcccgttttcacggtctcccgtcggtcggggcaaagctcgcccgtgactctgtccggtgttcgagccgtagaggacgaggtctgtactattactcgtcccttcctactacgtgttacgtgtaagtcggacgtcggtacggttacggttttccgggacgggtaccgggacccggtccggtacggtacccggtccgtcgggttacccgacggccccgaacgggtcccgtcccggtacccccgtccggtcccgtaccttccgttcccgttaccccctacccctcccttacctaacctacgtacccgttcaccgtacggg

SEQ ID NO: 118501 - DNA, 603 bp, Homo sapiens
  misc_feature: GYAE6OF01DIJI6.42.37.D04.1.454.CMB.1.raw
  modified_base (597)..(597): a, c, t, g, unknown or other
  misc_feature (597)..(597): n is a, c, g, or t
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttattgactggaccagtcacagttcttaccatccaaactggttccagacaaagactggacacggcccaggcgttagttatggtgcgactaacagcactcctcggacccctgtcccgttttcacggtcctccgtcggtcggggacaaaggcctcgcccgtgactcgtcgtcggtgttcagccgtgaggacgaggtctagtacttacttactcgccctcctactattagtactgatgacgtcgtggtagtttcgggcggacgggcccggtcgtcgggtaccgttcgtcgggttccgacgtcccgaaggtcccgtaccggtccccgtacggtccctaccgttcccgtcccgttcccccgtcccttccctctacctacgtaccgtccncgtcgg

SEQ ID NO: 118502 - DNA, 599 bp, Homo sapiens
  misc_feature: GYAE6OF01EC5AT.42.37.D04.1.454.CMB.1.raw
  modified_base (208)..(208): a, c, t, g, unknown or other
  misc_feature (208)..(208): n is a, c, g, or t
  modified_base (551)..(551): a, c, t, g, unknown or other
  misc_feature (551)..(551): n is a, c, g, or t
  modified_base (573)..(573): a, c, t, g, unknown or other
  misc_feature (573)..(573): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (593)..(594): a, c, t, g, unknown or other
  misc_feature (593)..(594): n is a, c, g, or t
  modified_base (596)..(596): a, c, t, g, unknown or other
  misc_feature (596)..(596): n is a, c, g, or t
tcagtgacgtatgtcacgaccggtgctcgatttagtagcatactgttgggtttgaggccctaggtcttgtgttgacgcagccgccctcaatgtctgacggacccaggacagaacggtcacctattcctccctgcgtcgtggaacgccagcttccgaaccattcggaggttaattatcgtctcctggtaccaggccagctccaagaacncgccccaaattctctattactgacatgatagccgccctcgagggtacttcctgaccgtattctcgtggactacctaagtcgtggcacgtcctcgccgaccccggtggcctatcgaccggacttccgagacgttaggacgacgtacggcgtagttacttacgtgacggtaacggtcggactaccagccgtgagtcggcgggtactagttcgggcggacggacccaggacctacggacccgtcgttacgccgacgacccgaacggtctacccggtcccctcggtcccacgtccctccgtaccccaccctccgttcctacgtactccgtcactcgtacggccggtntcggcgtagggcacgtagagcncgtgacgtnctncgtcgagnngntgc

SEQ ID NO: 118503 - DNA, 605 bp, Homo sapiens
  misc_feature: GYAE6OF01ASE04.42.37.D04.1.454.CMB.1.raw
  modified_base (588)..(588): a, c, t, g, unknown or other
  misc_feature (588)..(588): n is a, c, g, or t
  modified_base (592)..(592): a, c, t, g, unknown or other
  misc_feature (592)..(592): n is a, c, g, or t
  modified_base (596)..(597): a, c, t, g, unknown or other
  misc_feature (596)..(597): n is a, c, g, or t
  modified_base (599)..(600): a, c, t, g, unknown or other
  misc_feature (599)..(600): n is a, c, g, or t
  modified_base (602)..(605): a, c, t, g, unknown or other
  misc_feature (602)..(605): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagtaatttggttgggggctttcgtttgactattagaggccacgggttaccctggtcaccgtctcctcacgcctccaccgaacgggccccacgtccggtccctttcccccgtggcccgtcccctcgcctccgaggcgccaccgtccgagcgcacacggccggcccgtcgggcctcggcccgttgggtaccgtaacgggtacccttacccgtttacccgaacctaacgttacccgtcctaacgttacggacgggtacccgggtccgttagggacccgaacggggtccgacccgtaagttaacggngacngacnngnnannnn

SEQ ID NO: 118504 - DNA, 566 bp, Homo sapiens
  misc_feature: GYAE6OF01EP6DV.42.37.D04.1.454.CMB.1.raw
  modified_base (415)..(415): a, c, t, g, unknown or other
  misc_feature (415)..(415): n is a, c, g, or t
  modified_base (559)..(559): a, c, t, g, unknown or other
  misc_feature (559)..(559): n is a, c, g, or t
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttattgactggaccagtcaccagttctacatacaactgttcagcaaagacctggacacggcccacggcgttagttactggtgcgactaacaagcactcctggacccctgcccggtttcagctcctcgtcggggcaaagctcgccctgactctcgtccggtgttcagcctgaggacgacggctgactattactgccctcctnatcgtatgatgtacgcgtggtattttcgggcggacgggacccggtctcggtaccgttccgtgggttcacggcccgaaggccgtccgcccccgtcgggtcctaccttccgttccgtcccctacccctccgtcactactacgtccncgtacgg

SEQ ID NO: 118505 - DNA, 539 bp, Homo sapiens
  misc_feature: GYAE6OF01EP013.42.37.D04.1.454.CMB.1.raw
  modified_base (528)..(539): a, c, t, g, unknown or other
  misc_feature (528)..(539): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagaatttgttgggggcttctttgactatagaggccagggtaccctggtcacgtctcctcacgcctccaccaacgggcccatccggtccttccccctggccgccctgccttccagggacgccacccgtccgacgagccacgacggccggcccctggggcctcgcccgttgggtccaaggtacctaccttcccaacactacgtccacgttgacggccgggactggacgaagggccgacagtagannnnnnnnnnnn

SEQ ID NO: 118506 - DNA, 655 bp, Homo sapiens
  misc_feature: GYAE6OF01DW7XA.42.37.D04.1.454.CMB.1.raw
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtggtcactcaggagccctcactgactgtcgtcccccggagggacagtcactctcacatgtgtctttattgactggaccagtcacctagttccttaccataccaaactggttccagacaaagacctggacgaccggcccacggtcgttagtttagtggtgacgactaacaagcactccgtcgtacccctcggtcccgtttcacggtcctccgtcggtcgggacaacgcgtcgcctgactcgtcggtcggtgtcgacgtcgtaggacggacgacggtcgtacgtaacttacgttactcgtcccttcctactagtgtatgtagtacggacgtcggtggttacggtttacggggcgggtacggggaccccggtcgtaccggtacccggttccggtcgggtccgaccgacccgaccggtccgtcccgtcccccgtcggtccctacccgttcccgtcccttccccctacccttcccgtacctacctacgttacccgtccgtcgtacggg

SEQ ID NO: 118507 - DNA, 717 bp, Homo sapiens
  misc_feature: GYAE6OF01DYNZ3.42.37.D04.1.454.CMB.1.raw
  modified_base (678)..(678): a, c, t, g, unknown or other
  misc_feature (678)..(678): n is a, c, g, or t
  modified_base (702)..(702): a, c, t, g, unknown or other
  misc_feature (702)..(702): n is a, c, g, or t
  modified_base (708)..(708): a, c, t, g, unknown or other
  misc_feature (708)..(708): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagtaagtttcagggcagagtcaccatgaccggggcacgtccacgaccacggtctacatggacttgagcagcctagagatatgacgacacggccatactaattactgtcgtagagtagtaagttttggttacggggctttacgttgtactagtagacggcctagggttaccctggtaccaccgttctaccgtcacgtccctaccgaaccgacgggtccctaagttccggtaccctttccccggtagggcccgtaccccgtggtacccctttaccggacgggtaccgtcccgtaacccgtaccgggtaacgtaaccggtcccgtaaccggaccgggtcccgggtaccccgtcgggggtacccttcggtacccgttacggggttaaccaaccgggtttaccttaacccgttcccgaacgttaacgttacccgtccgttacggtaccggaacgggtcccgggtactacggggtaccgaacgggtccggtaactacggttacggacncgtcgacgtaccgagtacgtacgngtaccncgtaagtcg

SEQ ID NO: 118508 - DNA, 709 bp, Homo sapiens
  misc_feature: GYAE6OF01EUQNC.42.37.D04.1.454.CMB.1.raw
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtggtcactcgaggacgccctcactgactgtcggtcccccgggagggacagtcactctcacatgtgtctttatgactggaccagtccacctagttctaccactaccaaacttcggtccagacgaaacgcctaggaccacccggcccacggtcgtttagttagtggtacgacgtaactaacgagacctaccgttccgtcggtaccccttcggttcccgttttcgacggtcccttccccggtcggggtaccggggactaaacggtccgtccgacccgttgtaccgttccgttcggttccgggttcgttacgacggtcggtggaacgggacggcggtacgtacgtaacttaagttaccgtcgtccctaccgtactacgttgtaacgtggtactcgtaccggtgttcggttacggtttcggggacggtacgggaccgtcgacggtcccgttacggcgtaccgacgaccgtaggcccgtcccgtccccgttacggccctcgttcccgtcccgttacccccacccgttcccgttaccaccgttactccgtcgtaccggtacggg

SEQ ID NO: 118509 - DNA, 553 bp, Homo sapiens
  misc_feature: GYAE6OF01EGKG0.42.37.D04.1.454.CMB.1.raw
  modified_base (541)..(553): a, c, t, g, unknown or other
  misc_feature (541)..(553): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagtaagttttggttgggggtctttgtttgactatagaggccagggtaccctgggtcaccgtctcctcacgcctccaccgaacgggcccacgtccggtccttcccccgtggcctccccgtgccttccgagggacgccacccgtccgagacggcacgacggcggccccgtgggcctgcctggtccaaggtaccttaccgttcccaacacgttaccgtccactggacggcggggctaggacgaaggccgactagtacgnnnnnnnnnnnnn

SEQ ID NO: 118510 - DNA, 707 bp, Homo sapiens
  misc_feature: GYAE6OF01C6QO1.42.37.D04.1.454.CMB.1.raw
  modified_base (643)..(643): a, c, t, g, unknown or other
  misc_feature (643)..(643): n is a, c, g, or t
  modified_base (692)..(692): a, c, t, g, unknown or other
  misc_feature (692)..(692): n is a, c, g, or t
  modified_base (696)..(696): a, c, t, g, unknown or other
  misc_feature (696)..(696): n is a, c, g, or t
  modified_base (698)..(707): a, c, t, g, unknown or other
  misc_feature (698)..(707): n is a, c, g, or t
tcagtgacgtatgtcacgaccggtgctcgatttagtagcatactgttgggtttgagggcccagtctgtgttgacgcagccgccctcaatgtctgcggcccaggacagaaggtcaccatctcctgctctggaagcagctccaacattggaggtaattatgtctcctggtaccagcagctacccaagaaccacgacccccaaaattctcatttatgaacaaatgaataacgccggccctcgaaggggtacttcccgtgaaccgtatttcctcgtcggcctaccaaaggtcctagggacctacgtccttcgcccctaacccgtcggacccctaagtcccgaaccccgggactcccggtaagacggtacgggaacggacgggaccggtacctttaagtttaacgtccggacggggtaacgggtacgggtacgtaaccgtaccgaccggtacgaggtacggcggggtacggtacgtttacggggcgggtaacgggaacggtaccgacggtaccggtcgaacccggttcgtaacggaccgacccggaaccggacggtcccgtaccccgtcccggtccggtacctaccgttccgttaccccgtaccccttccctacccgtaacaaccttacgttacccacgttaaccggngggtaccggtaccgggacgttacgggaccgacggacctacgacgtagcnagtncnnnnnnnnnn

SEQ ID NO: 118511 - DNA, 598 bp, Homo sapiens
  misc_feature: GYAE6OF01D7DMO.42.37.D04.1.454.CMB.1.raw
  modified_base (587)..(598): a, c, t, g, unknown or other
  misc_feature (587)..(598): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatatactgtgtgagagtaatttggttgggggtctttcgtttgacttagtagaggccgtagggtaccctggtacaccgtctcctcacgcctacaccgaacggcccaacgtcggtccttccccgtcggccgccctgccgtaccgaggacgccaaccctccggacgacggccaacgacggccgggacccgtcggggctcgcccggttagggaccgtaaacgggtacctaacccgtttacccaaccgttaagtacccgtaccgtaaccgttcggaacgggtcggggaccgtgggacgtaaacgggccgacgaagttagacnnnnnnnnnnnn

SEQ ID NO: 118512 - DNA, 582 bp, Homo sapiens
  misc_feature: GYAE6OF01C8SFX.42.37.D04.1.454.CMB.1.raw
  modified_base (433)..(433): a, c, t, g, unknown or other
  misc_feature (433)..(433): n is a, c, g, or t
  modified_base (561)..(561): a, c, t, g, unknown or other
  misc_feature (561)..(561): n is a, c, g, or t
  modified_base (570)..(582): a, c, t, g, unknown or other
  misc_feature (570)..(582): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatggaccggggacacgtccacgaccacggtctacatggacttgagcagcctgagatatgacgacacggcatatattactgtgtgagagtaatttggtggggtctttcgtttagactataggaggccgtagggtaccctggtccaccggtcctcctcacgtcctaccgaccgtaacgggccctaagtcccggtccttcccccgtggccccgcccgttcgccctccgacgggtacnccctaccgtccggaagacgcgaacgtacggccggccgtgggcctcggcccgtggtaccgaaacggtctaaccgttccaactacgttaccgccgtaacgtggacgtcgggcctggaccgtaaggccganaacgtaggnnnnnnnnnnnnn

SEQ ID NO: 118513 - DNA, 597 bp, Homo sapiens
  misc_feature: GYAE6OF01CALSE.42.37.D04.1.454.CMB.1.raw
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (588)..(589): a, c, t, g, unknown or other
  misc_feature (588)..(589): n is a, c, g, or t
  modified_base (591)..(597): a, c, t, g, unknown or other
  misc_feature (591)..(597): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagtaatttgttgggggtctttctttgactatagaggccagggtaccctggtcaccgtctcctcacgcctccaccgaacggcccacgtccggtccttcccccgtggccgccctcgccctccgaggacgcctacccgtccgaacgacgccaccgacggcccggaccccgtggggtacctcggcccgttacgggttccgaaacggtacccttaacccgttcccaaccgtaacttaacccggtaccaccgttacggacgggtccgggcgttacgggaccgaacgggtccgacgacgtacgnacgncnngnnnnnnn

SEQ ID NO: 118514 - DNA, 670 bp, Homo sapiens
  misc_feature: GYAE6OF01C9OH6.42.37.D04.1.454.CMB.1.raw
  modified_base (280)..(280): a, c, t, g, unknown or other
  misc_feature (280)..(280): n is a, c, g, or t
  modified_base (651)..(651): a, c, t, g, unknown or other
  misc_feature (651)..(651): n is a, c, g, or t
  modified_base (658)..(670): a, c, t, g, unknown or other
  misc_feature (658)..(670): n is a, c, g, or t
tcagtgacgtatgtcacgaccggtgctcgatttagtagcatactgttgggtttcctgcaagacttctggtatttttcgttcacgacctactacatgcactgggtgcgacacggcccctggacagggacttgagtggagtgggaattatcactcccttagttctggccgccaaccaactacgcacagtaagttcagggcagagtaccaccagtacgggacccggggacaccggtaccaaccgaccacgggtactacagtggacttggacgcacgcctaganatagtaggacgaccacggaccatacttattactgtgtagagtagttaaggttttggtacggggtctttcgttagtacttagtacggacggtccgtaacgggttacccgttagggtacctacccgttccgttaccctacgacccgttcccctacccgaaccgaaccggggtcccctacgttcccggtacccctttccccggcgtcccggtaccccttcggacccgttaccgaggccctaccgtacccgaccgtacgacaccgacgaccggccggcccgtacgggcctcggtccgtacggttacgaacggtacctacccgttacaccgtactcgtactcggagtcgggtccggagtaccggcgtacggcgtanacgtagnnnnnnnnnnnnn

SEQ ID NO: 118515 - DNA, 734 bp, Homo sapiens
  misc_feature: GYAE6OF01DGR32.42.37.D04.1.454.CMB.1.raw
  modified_base (143)..(143): a, c, t, g, unknown or other
  misc_feature (143)..(143): n is a, c, g, or t
  modified_base (618)..(618): a, c, t, g, unknown or other
  misc_feature (618)..(618): n is a, c, g, or t
  modified_base (717)..(717): a, c, t, g, unknown or other
  misc_feature (717)..(717): n is a, c, g, or t
  modified_base (719)..(721): a, c, t, g, unknown or other
  misc_feature (719)..(721): n is a, c, g, or t
  modified_base (723)..(724): a, c, t, g, unknown or other
  misc_feature (723)..(724): n is a, c, g, or t
  modified_base (726)..(727): a, c, t, g, unknown or other
  misc_feature (726)..(727): n is a, c, g, or t
  modified_base (729)..(729): a, c, t, g, unknown or other
  misc_feature (729)..(729): n is a, c, g, or t
  modified_base (731)..(734): a, c, t, g, unknown or other
  misc_feature (731)..(734): n is a, c, g, or t
tcagtgacgtatgtcacgaccggtgctcgatttagtagcatactgttgggtttgagggcccagtctgtgttgacgcagccgccctcaatgtctgccggcccaggacagaagtcacatctcctgctctggaagcagcctccaanagttggaggttaattatgtctcctaggtaccagcagcctacccaaagaaccaccgacccccctaaacttctactaattttagacgaactaattagaacgtaaacggcccggccccttaaggacggggtaaccttttcccgacgtaaccccgttatttccgtcggtacggtcctaccgtagttaaaacgtggacctaaccgtctcgaccccaccgtcgacctatacccgaccggactccacgtacgaggaacggaccgacggtaccgtaattacttacgacggacggaacggttcggaactaccgaggtccgtaggacggtcgggccgggtatttacggggcgggacgggtaacggaaaccgaggtccgtaccggtacccgtaccggagggtaccgaacggtaccccgaacgggtcccgtacccggtacccccgtacggttacccgtaaccgttcccgttcccggtttaccccccncccgtttaccccaacctaaccgtaacttacccgtaccggactaccggggtaaccgtccgggacgtaccgggacgaaccgggtacgacgaaccgttagcncnnncnnannanannnn

SEQ ID NO: 118516 - DNA, 787 bp, Homo sapiens
  misc_feature: GYAE6OF01ATVN6.42.37.D04.1.454.CMB.1.raw
  modified_base (745)..(745): a, c, t, g, unknown or other
  misc_feature (745)..(745): n is a, c, g, or t
tcagtgacgtatgtcacgaccggtgctcgatttagtagcatactgttgggtttgggggcgccaggggtcccttccaatatcagacaccatggcctggactcctctcttctgttcctcctctacttgctgcccagggtccaatgctcagactgtggtcactcaggagccctcactgactgtcgtaccccggaggactagtccactctacactatcgtagtcttttaatcgacctacggacctacgtccaccgttaagtttccttaaccgacttacccgtaaacgttcggttcccacgtaaccgaaacgtaccgtacggaccgacccggacccgacggtcggtttaacgtttaacgttacggtacggtaccggtaacctaaaccgaacgtacctaccgttcccgtaccggtaaccccgtcgttccccggtttacggaacggtccctaccggttcggtacgggggacctaaacggcgtacggtccctcgtacgttccgtggtccggtacgttccgacgtcgtacgacggacgtacgtacgtccgtaagtttaccgttacgttccgtcccgttaccgttactaagttcgtagttacgtaacggtcgtacgttacggtaggttaccggtttaccgggtacgggtaccgggacccgttacgaccgggttaacccgtcggtccggtacgaccggtaccgtacgggtcctccccgtacccggtcgaccgttacccggtcctcccggttacccnccccgttaccaccgtactacgtacccgtacgtcgtaaccggg

SEQ ID NO: 118517 - DNA, 528 bp, Homo sapiens
  misc_feature: GYAE6OF01EPX1P.42.37.D04.1.454.CMB.1.raw
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (520)..(528): a, c, t, g, unknown or other
  misc_feature (520)..(528): n is a, c, g, or t
tcagtgacgtatgtcacgaccggtgctcgatttagtagcatactgttgggtttcctgcaagacttctggattttcgttcacgacctactacatgcactgggtgcgacaggcccctggacaggggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagaatttggttggggggctttcgtttgactatagaggccagggtaccctggtcaccgtctcctcacgcctccaccaacgggcccactccggtccttcccctcggccgccctcgcctccaggcgccaccctcgagacgcacaggcgcccgtgggctcgcctgggtccaaggacctacttccaacactacgtcaccgttgacggcggcgtggacgaagggccgacagtggnancgnnnnnnnnn

SEQ ID NO: 118518 - DNA, 611 bp, Homo sapiens
  misc_feature: GYAE6OF01EYGCG.42.37.D04.1.454.CMB.1.raw
  modified_base (598)..(600): a, c, t, g, unknown or other
  misc_feature (598)..(600): n is a, c, g, or t
  modified_base (602)..(603): a, c, t, g, unknown or other
  misc_feature (602)..(603): n is a, c, g, or t
  modified_base (605)..(611): a, c, t, g, unknown or other
  misc_feature (605)..(611): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagagtttcagggcagagtcaccatggaccggggacacgtcccacgaccacggtctacatggacttgagcagcctgagatagtgacgaccgacggccatagtattactgtgtgagtagtaagttttggtaggggggtctttcgtttgacgtaacgtaggacggtccgacgggtacccgtcggtaccacccggttctacctcgaacgcccctaccgacccgaacgggcccctagtcccggttccttcccccgtcggccctcccgtcgcctaccgacgggaccgccctaacccgtccgaagaccgacaccgtacggcccggccccgtgggcgttcgaccgtcggtaccaacggtaccgttacctacgacgaacttaccgtaccgacgtcggacggtccgggactgggaccgacggcgactagagnnncnncnnnnnnn

SEQ ID NO: 118519 - DNA, 677 bp, Homo sapiens
  misc_feature: GYAE6OF01AFFQ1.42.37.D04.1.454.CMB.1.raw
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtcgtcccccggagggacagtcactctcacatgtgtctttatgactggaccagtcaccagttccttaccatccaaacttggttccagcaaagacctggacaccggcccacggtcgttagtttagtggtgcgtactaacgagcactcctcggtacccctcgtcccggttttcgacggtcctccccgtcgggtccggggacaaacgtcgtcgccctcgactcgtcggtccgtcgttcgacgtccgtggaggacgaggctagtacttagttactcgtccctcctactagttgtatgtagtcggtacgtcgggttaggttacggtttccggggacgggtacggggtacccggtcgttccgggtaccccggttccgggtcgggtaccgaccggtacccggaacgggtcccgtcccggtcccccgttccgggtcctacccgttcccgttcccgttccccctaccccttccctacctacctaccgttaccgtccgtacgtaccgggg

SEQ ID NO: 118520 - DNA, 825 bp, Homo sapiens
  misc_feature: GYAE6OF01ECAW8.42.37.D04.1.454.CMB.1.raw
  modified_base (166)..(166): a, c, t, g, unknown or other
  misc_feature (166)..(166): n is a, c, g, or t
  modified_base (195)..(195): a, c, t, g, unknown or other
  misc_feature (195)..(195): n is a, c, g, or t
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtgtcactcaggacnccctcactgactgtcgtccccggaggacngtcactctacactatgtgtacttttagtgactggacctagtccacctagttactaccactacctaaacgttcggttaccacgtacaaaacgtaccgtacgaaccgacccggacccgtacggtacgtttaagtttagtcggtacacgtaactaacgaacgtcctaccgtcccgtaccggtaccccgttcggttacccgttttcgacggtcccgttacccggtcgggtaccgggactaacggtcctcgaccctcgtaccttcgtcgttccggtacgttccgacggtcgtacggacggtacggtacgtacgtacgttaacgtacgtttaccgtccgtcccttaccgtacgtagtttacggttagtacgtacgttacgtaccggttaggttacgggtttaccgggtttccggggaaccggggtacccgggacccggttacggtacccgggttaccccggttccgggtaccgggtacccgtaacccgggtaccccgtaccgggttacccgtcccccgggttacccccgtaccgggttaccccttaccgggtttccccggttaccccggttcccccctacccgttaccccttaccgaacccgttaaccgttacccgtccgtaccgggttacccggg

SEQ ID NO: 118521 - DNA, 911 bp, Homo sapiens
  misc_feature: GYAE6OF01BMIK3.42.37.D04.1.454.CMB.1.raw
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtggtcactcaggacgccctcactgactgtcgtccccggaggacagtcactctcacatgtgtctttattgactggacctagtccacctacgttaccttaccactacctaaacgttcggttaccaaggaccaaaacgtccgtacggaacccgtacccggacccgtaacgggttaccgtttaaggtttacgtcggggtacgaccgtaaacgtaaccgaacggtcctaccgttcccggtaccggtacccccgttcgggttaccccggtttacgaacggttccccgtacccggttcgggggtaccggggacctaaacggtccgtaccggccccttaggacctttcggttaccgggtccggttacgttcccggacggtccggtaggaaccgggtacggtacggtacgtacgttaccttacgttaccgtaccgtcccctacgtcgtaagttacgttactaggtacgtaccggtaccgggttcgggtttaggttaccgggtttaccggggaccggggtaaccggggtaccccgttaaccgggttccgggttaaccccgggtttccgggtaccggggtaacccgttacccgggacccccgttaaaccggggtccccgtttacccccgggttaccccccggttacgggttcccccttaacccgggtttccccccgttttaaccccgggtccccccccggttccccttaaccccggtaacgttaccccttaaaccgggttccccgttaccggtacccggtaaccgggggg

SEQ ID NO: 118522 - DNA, 835 bp, Homo sapiens
  misc_feature: GYAE6OF01D652J.42.37.D04.1.454.CMB.1.raw
  modified_base (333)..(333): a, c, t, g, unknown or other
  misc_feature (333)..(333): n is a, c, g, or t
  modified_base (525)..(525): a, c, t, g, unknown or other
  misc_feature (525)..(525): n is a, c, g, or t
tcagtgacgtatgtcacgaccggtgctcgatttagtagcatactgttgggttgggggcgccaggggtcccttccaatatcagcaccatggcctggactcctctctttctgttcctcctcacttgctgcccaaggtccaatgctcagactgtggtcactcaggacgccctcactgacgtgtcgtccccggaggacagtcactctcacatcgtgtctttatgacgtgaccagtcaactacgttactaccacttaccaaacgtcggttaccagaaccgaaaacgtacctaggaaccgtacccggaccccggaggttacggttttaacgtttaacgngggtacgtaccggtaaaccttaaacgaacggtcctaacccgttcccggtaccggaacccccggtttcggtaaccccggtttttccggaacggtccccgttccccggtaccgggggtacggggaaacctaaacggtcccctaaccgggtccctaaggtacccttccggttccggtacccggttcggttacccncgggtaccggtgggaacggaaccgggtcgtcgtacgtaacttacgtaccgttcgtccctactaccgtagttcggtattacggttacacgggtacgtccgggtttacgggttacgggttttaaccgggcgggggtaaccgggttaccccgggtcgttaaccccgggtccgttcgggttaaccggacccgaaccgggtcccggtaaccggtccggtcccccgtcccggttacccgtaccggtccctttccgggttccctacccccgttcccgtcccttaccgaacgtacccgtttacgccgtacgtacgggg

SEQ ID NO: 118523 - DNA, 877 bp, Homo sapiens
  misc_feature: GYAE6OF01DJJFD.42.37.D04.1.454.CMB.1.raw
  modified_base (143)..(143): a, c, t, g, unknown or other
  misc_feature (143)..(143): n is a, c, g, or t
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (382)..(382): a, c, t, g, unknown or other
  misc_feature (382)..(382): n is a, c, g, or t
tcagtgacgtatgtcacgaccggtgctcgatttagtagcatactgttgggtttggggggcgccaggggtcccttccaatatcagcaccatggcctggactcctctctttctgttcctctcacttgctgccaggtccaatgctnagctgtggtcactcaggacncccncactgactgtccgtccccggaggcagtcactcnccantgtctctttaatcgtcgtacggacctagtccaccgtatttccttaacgactacctaacgtcggttacacgacaacgacgtacggaccacccggtcccgacgttacgttgttacgtggtcgaccgaacttaaacgacgtacctccgtacccgtccgtacccgtcggttcccggtttacncggtcccttaccccggtcggtacgggacctaacgtccgtccgtacgtacgcgttccgttcggtccgttcgttccgtacgtaccggttaggaccgggtagtaccgggtcgtaaccgtacgttaccgttacggtcccgtacccttaccgtaacgttcgttacggtacgtttacgtacggtacggtaccgggtttccgggttacggtttaccgggtttaccggggcccggggttaaaccgggtaaccccggggttccccgggtaacggttaccccgggtttcccgggtaacccggggttaccgtaacccggggtacccggtaaaccccgggttcccgtaacccccgggtttcccccggttaccccggtttaccccgtaacccggttttcccccgggtttaacccccggtttaccccccgttccccccgggttacccttaccccggtaaaccggtttacccgtttaaaccccgtcccgtaaaccgggttccccgggggg

SEQ ID NO: 118524 - DNA, 651 bp, Homo sapiens
  misc_feature: GYAE6OF01BSDE8.42.37.D04.1.454.CMB.1.raw
  modified_base (144)..(144): a, c, t, g, unknown or other
  misc_feature (144)..(144): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (637)..(637): a, c, t, g, unknown or other
  misc_feature (637)..(637): n is a, c, g, or t
  modified_base (644)..(645): a, c, t, g, unknown or other
  misc_feature (644)..(645): n is a, c, g, or t
  modified_base (647)..(648): a, c, t, g, unknown or other
  misc_feature (647)..(648): n is a, c, g, or t
  modified_base (650)..(651): a, c, t, g, unknown or other
  misc_feature (650)..(651): n is a, c, g, or t
tcagtgacgtatgtcacgaccggtgctcgatttagtagcatactgttgggtttcctgcaagacttctggattttcgttcacgacctactacatgcactgggtgcgacaggccctggacagggacttgagtggagtgggaattancatccctagttctggccgcaaccaactacgcaacagtaagttcagggacagaacgtcaaccagtacggaaccggggacacggtccaaccgaccacggtctacgattggaactttgagcacnccgtagganaagtctacggaaccgaacncgggaccaataattaattaagtgtaggtaggaagtaggtaaagttttggggtttaggggcttttccggttagaaccgttaagtaggtacgcgtaacgggtaccctgtaaccacggtctctcgactccgacaccaaggaccctgtacggtcctcccggtacgcctactcgctacggaggtcaccgactcgacacgtaccaacgtaccgaccggtcccggtaggccgttcggacgtcgggtaaccgaacggttaactaccttacccgaacgtacttaaccgacgttagacggtacggtacccgggacgtcgggaaccaaacgggggactaaccgtaggtaccagcnagcaagnnanngnn

SEQ ID NO: 118525 - DNA, 694 bp, Homo sapiens
  misc_feature: GYAE6OF01AL5CS.42.37.D04.1.454.CMB.1.raw
  modified_base (131)..(131): a, c, t, g, unknown or other
  misc_feature (131)..(131): n is a, c, g, or t
  modified_base (604)..(604): a, c, t, g, unknown or other
  misc_feature (604)..(604): n is a, c, g, or t
tcagtgacgtatgtcacgaccggtgctcgatttagtagcatactgttgggtttgggggcggccgaggggtcccttccaatatcagcaccatggcctggactcctctctttctgttcctcctctacttgctncccagggtccatgctcagactgtggtcactccgaggagccccttcactcgtactggttcggtccccccgggagggaccaggttccacctcgtccacattgtgctttttagtcgtactggaccagtccacgtacttacttacacgtacctaaactcggttccaagactaaacgcctaggaccaccggtcccaggtccgttagttatggtcgtacgtactaacacgccacctcctacggaccccttcggtcccgtttacgccgccgtccgtcgtaccgggggcaaacgcgtacgcccgtaggtactccgttcggttccgtggtacctaccgcgtacgacgggtacggacgtacgtcggtaattacgttacctcgtaccctccgtctacgtgtacttaggtctaccgacgttcggtggttcgtttacgggtaccgggtacggacccggggttctcggtaccgttcgtcggttaccnggccctaacggcgtccgtccccgttaggcccttaccgtcctccgttaccccgttcccgccgtaccacttacccgtcgtacctcgttcggg

SEQ ID NO: 118526 - DNA, 952 bp, Homo sapiens
  misc_feature: GYAE6OF01AGAYS.42.37.D04.1.454.CMB.1.raw
  modified_base (389)..(389): a, c, t, g, unknown or other
  misc_feature (389)..(389): n is a, c, g, or t
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaaggacgccctacactgactcgtccggtcccccgggaggactagtccacttctacactatgtacgttctttagtcgacgtacggacctacgtcccaaccgtagtttaccctaaccaacttaacccgtaaacgttccggttacccaagtacctaaacggcccgtacggaacccgcccggtacccgtaggttacgtttacgttagtacggttcgaaccgtaacgtaaaccncgtacctaccgttcccgtaccggtaccccgtttcggttaccccggtttacggaccggttcccgtaccccgggttacggggaccgggtaaccaaccggtccgtaccgtacccgttagtacccgtttcggtcccgggttaaccggttccgttaaccggtaccgggtaccgtacggggaacggttaccgggttaccggtcgttaaccgttaccgtttaacgttaccgtcccggtacccctttaccgtagttaaccggtttacgtacgtttacggtaaccgtaccggggtttaccggtaccgggttttaaacgggtttccggggtaccccggggaaccggggtacccgggttaccccggtcgggtttaacccccggtaccgggtttcccggtaaccggggtacccctaaccgggttaccccggaccggttaccccgttaccccccgggtccgtttaacccggtaacccgttccccgggtttacccgttccccccggtttaccccgttaaccctttccgtaaaccgttaccccgtttagaacccccgttgggtaacccgtaccggggg

SEQ ID NO: 118527 - DNA, 758 bp, Homo sapiens
  misc_feature: GYAE6OF01ELEKG.42.37.D04.1.454.CMB.1.raw
  modified_base (171)..(171): a, c, t, g, unknown or other
  misc_feature (171)..(171): n is a, c, g, or t
  modified_base (367)..(367): a, c, t, g, unknown or other
  misc_feature (367)..(367): n is a, c, g, or t
  modified_base (420)..(420): a, c, t, g, unknown or other
  misc_feature (420)..(420): n is a, c, g, or t
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtggtcatcaggacgccctnactgactgtcgtcccccggaggacagtcactctcacagtctagtcttttagttgactaggaccctagtaccaccgtagttctaaccagtacccaaaaacgttcggttacccaaggaccaaaaggacccgtacggaacctacccgggaccccaacgggtacgtttacgtttaaggtcggttacgacgtaacctaaanacgtaccacctccgtaccggacccccttggttacccggtttacgacggtcccnccccggttaccggtaccggggacgtaaaccgcgtcgacccccgtagacctcggtaccggtcgttacgttacgaacgtccgaggtaacggacgtacggtctacgtaactacgtaccgtcctacccctactacgtactagtacgtagtacgtacggacgtcggttacggttacggtttacgggaccgggtaacggggtaaccccggtgttaccgtaccgtccggtaggccgacccggaccgtacggtcccgtaccgtcccccgtccggttacctacttccccgttccttacccccgtacccgttctaacccgactaacgtccgttaccgaacgtaccggg

SEQ ID NO: 118528 - DNA, 855 bp, Homo sapiens
  misc_feature: GYAE6OF01EHKEX.42.37.D04.1.454.CMB.1.raw
  modified_base (108)..(108): a, c, t, g, unknown or other
  misc_feature (108)..(108): n is a, c, g, or t
  modified_base (146)..(146): a, c, t, g, unknown or other
  misc_feature (146)..(146): n is a, c, g, or t
  modified_base (184)..(184): a, c, t, g, unknown or other
  misc_feature (184)..(184): n is a, c, g, or t
tcagtgacgtatgtcacgaccggtgctcgatttagtagcatactgttgggttgggggcgccagggtccttccaatatcagcaccatggcctggactcctcttctttcngttcctccttcgacttgctcgcccgagggttccaagtncgtcacgtacgtgtagtacaccgttgacggacgccctnacgtcgactgccggtacccggaggtactagtcacgttcctcacgtacgttgttacggtactttttaacgcgtacgttacggacctacgttaccgtaaccgttacgtttccttaaccgtaaacttacccgtaaacgttcggttaaccaaggaccaaacggtcgtaacggaccgaacgacccgtacggttacggtttattacggtcgtagtaaccgaaacgtacgaacgcgtaccgtacccgtacgtacccggttgttaccggtttaccaggttccctaccggtttacgggacggaaaccggtactccggtacgtccgtagtaccttccgggttaacgtcggttacgacggtacctaacggtcggggtaaccggagtacgttacgaaccgtattacgtacctcttacccggcacgttagtaccgtagtacgtacggtccgtaacggttcgtacggggttaacggttcccgggaacggttaccccggggtaacgtccgtaacccggtaccggttagggtaccggttaaccgaacgggtccctaaacccggtcgttcccccgggtacctttaacccggggccctttaccgttaaccgtccccgtttaccccggtaaaccccgttaacccgtaccgtaaacccgtaacgggttccctaaccggtcggttaaccggg

SEQ ID NO: 118529 - DNA, 568 bp, Homo sapiens
  misc_feature: GYAE6OF02GTRHY.42.37.D04.1.454.CMB.1.raw
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttattgactggaccagtcaccagttcttaccatccaaactggttccagcaaagacctggacacggccccacggcgttagttatggtgcgactaacaagcactcctggacccctgcccggttttcaggctccctcgtcggggcaaagctgccctgactctgtccggtgttcagcctgaggacgaggctgactattactgcctctcactgtatgatgacgcgtggtattttccgggcgggtacgggacccggtcgtcgacccggttccgtggggtccacggcccgaagggcctcggcccccttcggtccaccttccgtcgttccccgccctcctccacctactaccgtccacgtcgg

SEQ ID NO: 118530 - DNA, 547 bp, Homo sapiens
  misc_feature: GYAE6OF02GOWNS.42.37.D04.1.454.CMB.1.raw
  modified_base (522)..(522): a, c, t, g, unknown or other
  misc_feature (522)..(522): n is a, c, g, or t
  modified_base (533)..(533): a, c, t, g, unknown or other
  misc_feature (533)..(533): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
tcagtgacgtatgtcacgaccggtgctcgatttagtagcatactgttggggtttcctgcaagaccttctggattttcgttcacgacctactacatgccactgggtgccgacaggccccctggacaggggacttgagtggatgggaattatcatccctagttctggccgcaccaactacgccacagaagtttcagggcagagtcaccatggaccggggacacggtccaacgaccacgggtctacatggacttgagcagcctgagatatgacgtacacggccataatattactgtgtgagagaagtttcgttggggggcttcgtttgactataggaggccagggtaccctggtcaccgtctcctcagcctccaacaagggccatcggtcttccccgtggccgcccgtgcctccaggacgccgacctccgacgagccaccacgcggtccctagggcctagcccgtggtcaaggctacttccacataccgtcactgagtcgggctggcaaggcgacgacgtaggcngagtcgatcgngtcgagctccncnc

SEQ ID NO: 118531 - DNA, 480 bp, Homo sapiens
  misc_feature: GYAE6OF02H3R1C.42.37.D04.1.454.CMB.1.raw
  modified_base (436)..(436): a, c, t, g, unknown or other
  misc_feature (436)..(436): n is a, c, g, or t
  modified_base (466)..(466): a, c, t, g, unknown or other
  misc_feature (466)..(466): n is a, c, g, or t
  modified_base (472)..(480): a, c, t, g, unknown or other
  misc_feature (472)..(480): n is a, c, g, or t
tcagtgacgtatgtcacgaccggtgctcgatttagtagcatactgttgggtttgagggcccagtctgtgttgacgcagccgccctcaatgtctgcggccccaggacagaaggtcaccatctcctgctctggaagcagctccaacattggaggtaattatgtctcctggtaccagcagctcccaagaacagcccccaaaacttctcatttatgacaatgataagcggccctcagggattcctgaccgattctctggctccaagtctggcacgtctgccacctgccatcaccggactccagactggagacgaggccgattattactgcggaacgtgggataccagcctgagtgcggggctagttcggcggagggaccaagctgaccgtctaggtcagcccaaggctcgcccctcggtcactctcgttcccaccctccncacatactcactgagcgggctggcaaggcncatagnnnnnnnnn

SEQ ID NO: 118532 - DNA, 578 bp, Homo sapiens
  misc_feature: GYAE6OF02IL4LO.42.37.D04.1.454.CMB.1.raw
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttattgactggaccagtcaccagttcttaccatccaaactggttccagcaaagacctggacacggccccacggcgttagtttatggtgcgactaacaagcactcctcggacccctgcccggttttcaggtcctccctcggtcggggcaaagctgccctgactctgtccggtgttcagctgaggcgaggctgactattactgcctcctcatgtatgatgacgtcgtggtagtttcgggcgggacgggacccggtcgtcggacccgtccgtgggtccgacggacccgaaggcctccgcccccgtcgggtcctaccgtccgttccgttccccgccccttccctccacctacgtaccgtccacgtcgg

SEQ ID NO: 118533 - DNA, 487 bp, Homo sapiens
  misc_feature: GYAE6OF02HA0QA.42.37.D04.1.454.CMB.1.raw
  modified_base (473)..(478): a, c, t, g, unknown or other
  misc_feature (473)..(478): n is a, c, g, or t
  modified_base (480)..(487): a, c, t, g, unknown or other
  misc_feature (480)..(487): n is a, c, g, or t
tcagtgacgtatgtcacgaccggtgctcgatttagtagcatactgttgggtttgagggcccagtctgtgttgacgcagccgccctcaatgtctgcggccccaggacagaaggtcaccatctcctgctctggaagcagctccaacattggaggtaattatgtctcctggtaccagcagctcccaagaacagcccccaaaacttctcatttatgacaatgataagcggccctcagggattcctgaccgattctctggctccaagtctggcacgtctgccacctggccatcaccggactccagactggagacgaggccgattattactgcggaacgtgggataccagcctgagtgcgggactatcggcggagggaccaagctgaccgtctaggtcagcccaaggctcgcccctcggtcactctcgttcccgccctcctcacactcgtcactgacgcgggctggcaaggcgcatagnnnnnntnnnnnnnn

SEQ ID NO: 118534 - DNA, 814 bp, Homo sapiens
  misc_feature: GYAE6OF02J0ARO.42.37.D04.1.454.CMB.1.raw
tcagtgacgtatgtcacgaccggtgctcgatttagtagcatactgttgggtttggggggtcggccgaggggtcccgttccgaatatcagcaccatggcctggactcctctctttctgttcctcctcacttgctgcccagggtccaatgctcagactgtggtcactcaggagccctcactgactgtgtcccccggagggaccagtcactctcacatgtgcttttatgactggaccagtcaccagttcttacatccaaacttggttccagcaaacgctggacaaccggccccacggtcttaggtttatggtcgacgacgtaacaacgcaactcctcggaccccttgcccggttttacacggtcttacccggtcgtacgggggtccaaagtccgtgccctgtacctcgttcgtcccggttgttccacggccgttaggacggtaccgtaggccgttcgaacgtttagttaacctcggtacctccgttcctaatcggttactacgtacgtacggttaacggtccgggtttacgggtaacgtttttacccgggggtccggggtaaacccgggggttacccccgggttaacccgggttccggttaaccccggggtttaccccggttcccggggggtttaacccgaaaccccgggttcccccgggtaaacggggtaccccggtttcccgggtacccccccgtttaccggggtccccgttaacccgtttcccgtttaccccggtttccccctaaccccccggtttccccgtaccccgtaaccgttaacccgtttacccgggttacctaccccggtttaacggg

SEQ ID NO: 118535 - DNA, 547 bp, Homo sapiens
  misc_feature: GYAE6OF02GVXPE.42.37.D04.1.454.CMB.1.raw
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttattgactggaccagtcaccagttcttaccatccaaactggttccagcaaagacctggacacggccccacggcgttagtttatggtgcgactaacaagcactcctggacccctgcccggtttttcaggctccctcgtcggggcaaagctgccctgactctgtccgtgttcagcctgaggacgaggctgactattactgcctcctcatgtatgatgacgcgtggattttcgggcggtagggacccggctcgaccgtccgtgggtccacggcccaagggcctcgccccctcggtccactcctcgttcccaccctcctcaccactacgtcactcgg

SEQ ID NO: 118536 - DNA, 560 bp, Homo sapiens
  misc_feature: GYAE6OF02FXXVY.42.37.D04.1.454.CMB.1.raw
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttattgactggaccagtcaccagttcttaccatccaaactggttccagcaaagacctggacacggccccacggcgttagttatggtgcgactaacaagcactcctcggacccctgtcccgtttcaggctcctcgtcggggcaagctgccctgactctcgtccggtgttcacgcctgacggacgaggctgactattactcgcctcctcatgtatgatgacgcgttggtagttttcgggcgggtacgggacccggcgtcgccgtccgtcgggtcacgcccaaggcctcgccccgtcggtccacctccgtccgttcccgcccttccctactaccactaccgtcacgtcgg

SEQ ID NO: 118537 - DNA, 493 bp, Homo sapiens
  misc_feature: GYAE6OF02FIWPB.42.37.D04.1.454.CMB.1.raw
  modified_base (483)..(493): a, c, t, g, unknown or other
  misc_feature (483)..(493): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagaatttgttgggggcttctttgactatagaggccagggtaccctggtcaccgtctcctcagcctccaccaagggcccatcggtcttccccctggccgccctgcctccaggacgcacctccgagagcacagcggccctgggcctgcctggtccaaggctacttccacatacgtcactgagcggctggcaggcgcatgnnnnnnnnnnn

SEQ ID NO: 118538 - DNA, 591 bp, Homo sapiens
  misc_feature: GYAE6OF02I3S72.42.37.D04.1.454.CMB.1.raw
  modified_base (403)..(403): a, c, t, g, unknown or other
  misc_feature (403)..(403): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
tcagtgacgtatgtcacgaccggtgctcgatttagtagcatactgttgggtttgggggcgccaggggtcccttccaatatcagcaccatggcctggactcctatctttctgttcctcctcacttgctgcccagggtccaatgctcagactgtggtcactcaggagccctcactgactgtcgtcccccggagggacagtcactctcacatgtgctttatgactggaccagtcactagttcttaaccatccaaacgtgttccagacaaagaccgtgacaccggacccccacggtcgtttagtttatggtgacgaactaaacacgacactccgtcggaccccttgtcccggtttcacggtcctacccgtcggtcggggacaaagtctcgccctgactctgtcggtntcgagccgtagacggacgaggctagtactattaccngcccttccnctatgtactgatgtacgcgttaggtgtttacggcgggacggtaccggcgtcgcgtcgacggtcacgccgacgctcccgccgtcgtctaccttcgtcccgtaccccgtcctaccgtacctaacgtacgtaccgtctaacgtcgg

SEQ ID NO: 118539 - DNA, 576 bp, Homo sapiens
  misc_feature: GYAE6OF02HIVR3.42.37.D04.1.454.CMB.1.raw
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttattgactggaccagtcaccagttcttaccatccaaactggttccagcaaagacctggacacggccccacggcgttagtttatggtgcgactaacaagcactcctggacccctgcccggttttcaggcctccctcgtcggggcaaagctgccctgactctgtccgtgttcagcctgaggcgaggctgactattacgtgcctcctcatgtatgatgacgcgtgtagttttcgggcggacgggacccggcgtcgaccgtccgtgggtccacggcccgaaggccgtccggtcccccgttcgggtcccaccgttccgtccgttcccccgccccttccctaccgacctacgtaccgtccactcggg

SEQ ID NO: 118540 - DNA, 577 bp, Homo sapiens
  misc_feature: GYAE6OF02HYYTO.42.37.D04.1.454.CMB.1.raw
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttatgactggaccagtcaccagttcttaccatccaaactggttccagcaaagacctggacacggccccacggcgttagtttatggtgcgactaacaagcactcctggacccctgcccgttttcagctccctcgtcggggcaaagctgccctgactctgtccggtgtcagcctgaggacgaggctgactattactgcctcctcatgtatgatgacgcgttggattttcgggcgggtacgggacccggcgtcggtacccggtccgtcgggtcgacggcccgaaggcctcgcccccgtcggtcctaccgttccgttccgttcccccaccccgttcctaccgacctacgttaccgttccacctacggg

SEQ ID NO: 118541 - DNA, 740 bp, Homo sapiens
  misc_feature: GYAE6OF02JLLXE.42.37.D04.1.454.CMB.1.raw
tcagtgacgtatgtcacgaccggtgctcgatttagtagcatactgttgggtttggggggcggccaggggtcccgttccaatatcagcaccatggcctggactcctctctttctgttcctcctcacttgctgcccagggtccaatgctcagactgtggtcactcaggagccctcactgactgtgtccccggagggacagtcactctcacatgtgctttatgactggaccagtcaccagttcttaccataccaaactgttccagcaagacctggacacggaccccacggcgttagttatggtgcgtactaacaagccaactcctcggacccgtcgtacccggttttcgacggtctccccgtcggtcgggggaccaaacggtctacggtccctacggtacctaccgtcggtcccgggttgtttacccgacgtcccgtacggacgggtaaccgtacgggccttacggaccttagttaacctcggtaccctccgtacagttcgtagttcgacgttacgaccggtcgggtagttacggtttttccggggaccgggtacggggtaacccgggtcgtaccgggtcccggttacccgggttacgggtaccggtaccggtacccggaacgggtccgtcccgggttacccccgtcccgggttaacccttaccgttcccggtcccgtttacccccgtccccgttccccgtaccgttccctaaccggttacccgttacccgacgttacccggg

SEQ ID NO: 118542 - DNA, 670 bp, Homo sapiens
  misc_feature: GYAE6OF02HA23G.42.37.D04.1.454.CMB.1.raw
  modified_base (414)..(414): a, c, t, g, unknown or other
  misc_feature (414)..(414): n is a, c, g, or t
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtcgtcccccgggagggacagtcactctcacatgtgctttattgactggaccagtcacctagttcttaccataccaaactgttccagacaaagacctggacacggaccccgaggtcgttagtttatggtgcgactaacaagcactccgcggacccctgtccccggttttcacggtcctcccgtcggtccgggggcaaaggcctcgccctgactcgtcgtccggttgtcacgctaggnggacgaggctgacttacttacctcgtcccttcctctattagtagtagtactcggaccgtcggttggttacgttttcggggacgggtaccggggacccggtcggtaccggtcccggttcgtcgggtaccgtaccggacccgtacggtcccgtacccggtccccgttccgggtccgttacccgttccggttacccgtttcccccggtccccttaccctcccgtaacctacccggttacccgtccgtaaccgtccgggg

SEQ ID NO: 118543 - DNA, 671 bp, Homo sapiens
  misc_feature: GYAE6OF02JUR70.42.37.D04.1.454.CMB.1.raw
  modified_base (334)..(334): a, c, t, g, unknown or other
  misc_feature (334)..(334): n is a, c, g, or t
  modified_base (481)..(481): a, c, t, g, unknown or other
  misc_feature (481)..(481): n is a, c, g, or t
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtggtcactcaggagccctcactgactgtcggtccccggagggacagtcactctacacatgtcgtctttatgactcggactagtcaccagttcttaccatacctaaactggtaccagacaaacgcctagaccaccggccccaggtacgttagtttagtggtcgacgaactaacacgactaccnccgtcggacccctcggtcccgtttcacggtcctcccggtcggtacggggacaacggtccgtcgtcccgtgtaccgtcgtcggtccgttgttaccgcgtccgaggacggacggacggtctacgacttacttacgtcgtccctaccgtntacgttcgtagtcgtagtcggtacggtcgtcggttacgtttcgggaccgggtacggtaccggtcgtcggtaccgtcgttccggaccgacgccggtaacgtcccgtaccgtccccgtcgggttcctaccgttccgttccctaccccgttaccgtacccttaccgtacctaccgtacgtccgtacggtccgg

SEQ ID NO: 118544 - DNA, 497 bp, Homo sapiens
  misc_feature: GYAE6OF02GO4UH.42.37.D04.1.454.CMB.1.raw
  modified_base (485)..(497): a, c, t, g, unknown or other
  misc_feature (485)..(497): n is a, c, g, or t
tcagtgacgtatgtcacgaccggtgctcgatttagtagcatactgttgggtttcctgcaagacttctggattttcgttcacgacctactacatgcactgggtgcgacaggccccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagaatttgttgggggctttctttgactatagaggccagggtaccctggtcaccgtctcctcagccctcaccaaggcccatcgtccttcccctgcgccctgctccaggacgccacctccgagacgcacacgcggccctgggctgcctggtcaacgggctactccacactacgtcacgtgagcggctgcaaggcacagtgnnnnnnnnnnnnn

SEQ ID NO: 118545 - DNA, 898 bp, Homo sapiens
  misc_feature: GYAE6OF02I1FMM.42.37.D04.1.454.CMB.1.raw
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactggtcgtcactcgaggacgccctacactgactcggttccggtacccccggggaggactcgtcacttctacactacgtgttcgttcttttagtcgacgttacggaaccacgtaccaccgttacgtttaccttaacctaacctaccgtaaacgttcggttaccagaacctaaacgccgtacggaaccgaccccggtacccccgacgggttacgttttaacggtttacggttcggtcggaaccgtaaccgttaaaccgagtcctaccgtcccggtaccggtaccccctcgggtttaccccggttttacgaccggttcccgttaccggttccggggtaccgggaacctaacgtccgtccgtcccgtacggtccttcgtcggttccggttagtacaccgttccgttgggaaccggtacggtacggtcgtaacgtacgttacgttaccgtcgtaccccttcctacgtagttacggttacgtacgttacgtacggtacggggtttccggttagggttttacccgggttttaccgggggaacccggggttaacccggggtacccgggttaccggttaccgggttaccccgggtttccgggttaccgggttaacccgaccgggttaaccccggtaaggtcccccggtttaccccggtcccccgggttacccggtcctttacccggtttacccgttcccggtttcccccgtacccttcccgtaccttacccgtacgttacccgtacgtcggtaaccggg

SEQ ID NO: 118546 - DNA, 587 bp, Homo sapiens
  misc_feature: GYAE6OF02GLRGG.42.37.D04.1.454.CMB.1.raw
  modified_base (567)..(567): a, c, t, g, unknown or other
  misc_feature (567)..(567): n is a, c, g, or t
  modified_base (570)..(570): a, c, t, g, unknown or other
  misc_feature (570)..(570): n is a, c, g, or t
  modified_base (575)..(575): a, c, t, g, unknown or other
  misc_feature (575)..(575): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (584)..(586): a, c, t, g, unknown or other
  misc_feature (584)..(586): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccaatatattactgtgtgagagtaatttggttggggggcttctttgactagtagaggcacgggtaccctggtctaccgtctcctcacgcctccaccgaacggccctacgtccggttccttcccccgtggccgcccctgccctccgaggacgccaccctccgagacggcaccgacggccgggcccgtcggggcttcggcccttcgggtacgaaacgggtacctaccgttacccaacacttacccgtcgaccgtggaacgggccgggcgttgggaccgaacgggtccgaccggtaagtacggngancgagnacgngnncnnnc

SEQ ID NO: 118547 - DNA, 572 bp, Homo sapiens
  misc_feature: GYAE6OF02JEFN8.42.37.D04.1.454.CMB.1.raw
  modified_base (553)..(553): a, c, t, g, unknown or other
  misc_feature (553)..(553): n is a, c, g, or t
  modified_base (559)..(559): a, c, t, g, unknown or other
  misc_feature (559)..(559): n is a, c, g, or t
  modified_base (566)..(569): a, c, t, g, unknown or other
  misc_feature (566)..(569): n is a, c, g, or t
  modified_base (571)..(572): a, c, t, g, unknown or other
  misc_feature (571)..(572): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccatatattactgtgtgagagtaatttggttggggcttcttgactatagaggccagggtacctgtcacgtctctcagccctcaccacgggccagtcggtcctcccccgtggcctcccgtcgctccgagggacgcctacccgtccggtaacgacgccgtacgacggccgggacccgtcgggcttcggcccgttgggtccaaacgggtcctaccgttacccactacgtaccgtccacgttcgacggccgggtcttacgggaccgaacggtcgggacctaggtaccgtanctacgncgcgtcnnnncnn

SEQ ID NO: 118548 - DNA, 627 bp, Homo sapiens
  misc_feature: GYAE6OF02IOLPM.42.37.D04.1.454.CMB.1.raw
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttatgactggaccagtcaccagttcttaccataccaaactggttccagcaaagacctggaccacggcccccacggcgttagtttagtggtgcgactaacgaagcactcctcggacccctgtcccggttttcaggtcctcccgtcggtccggggacaacgctcgtccctgtacctcgtcggttccggtgttccgagtcccgtggacgggacgaggtccgtagtaacttaattaccgtcgtcccttcctctatgtatagtagtagacgtcgttaggtacggtttcgggcgggacggggtcccgcgtcggtacccggtcgtcgggtccgacgaccgtacggcctaccgccccgtcggtcctacccgttccgttccgttacccctacccttccctccacctacgtaccgtcacgtcgg

SEQ ID NO: 118549 - DNA, 746 bp, Homo sapiens
  misc_feature: GYAE6OF02JXSWI.42.37.D04.1.454.CMB.1.raw
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtggtcactcaggacgccctcactgactgtcgtcccccgggagggacagtcactctcacatgtgctttatgacgtcggaccagtaccacacgtttctaccactaccaaacgttcggttaccagactaaacggacctaggaccaccggaccccgacggtcgtttaaggtttagtggtcggacgaacctaacgaacgcctaccgtcctacggacccccgtcggtcccggtttacacggccttccgtcgggtaccggggacaacgtccgtcgccgtacgtacctacgtcggttccggtactacgacgcgttacgagggtacgaggccgttacggtaactttacgttaaccctcggtccccttaccgtactaggtttacgtacgtggtacgtacggacgggttacggtaggtttacgggttttaccgggacgggggtaccggggtacccggtcgtaacgggtccccggttccggttaccggggttccaccggttacccggacggtcccgtaccgggtccccgtaccggtccgtaccttcccgtccgtttaccccgcccgttacctcctaccggtaccttacggtcctccggtaaccggg

SEQ ID NO: 118550 - DNA, 908 bp, Homo sapiens
  misc_feature: GYAE6OF02JTBSV.42.37.D04.1.454.CMB.1.raw
  modified_base (230)..(230): a, c, t, g, unknown or other
  misc_feature (230)..(230): n is a, c, g, or t
  modified_base (317)..(317): a, c, t, g, unknown or other
  misc_feature (317)..(317): n is a, c, g, or t
  modified_base (479)..(479): a, c, t, g, unknown or other
  misc_feature (479)..(479): n is a, c, g, or t
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactcgtgtcccccggagggacagtcactctcacatgtgtctttatgactcggaccngtacacctagttcctaccactaccaaacgttggttccagaccaaagcctaggaccaccggacccctacgggtccgtttagtttacgnggtcgaccggtaactaaacgaacgtcctaaccgtccgtaccggtacccccgtcggttccccggttttacgaaccgggtcccttcccccggtacggggtaccgggggacctaaacggtcccgtacgtaccccgttcgtaaccgttcgttcgggtcccgggttntttaacccgcggtacccgtggaacggggtaccgacggggtaccgtacggttaaccttaacggttaccgttaccgtcccgttacccttaggacgtttacgttaacgtggtaacggttacgggacggttaccgggtttcggtttaacggggttttccccgggaaccgggggttaccccgggggtacccgggttacccggttacgggtaacccccggggtttaccggttccgggggtaacccgtacccgggtaaccccgggtaaccgggttccccgttaccccccggggttcccccggtttacccggggttacccgtttaaccccgtttcccggtttaccccccgggttccccccgttccccgttacccccttaacccgttaacccggttaaccggtttaccccccgtccggtttaaccggtaccccggggg

SEQ ID NO: 118551 - DNA, 767 bp, Homo sapiens
  misc_feature: GYAE6OF02J1TFB.42.37.D04.1.454.CMB.1.raw
tcagtgacgtatgtcacgaccggtgctcgatttagtagcatactgttgggtttgggggcgccaggggtcccttccaatatcagcaccatggcctggactcctctctttctgttcctcctcacttgctgcccagggtccaatgctcagactgtggtcactcaggagccctcactgactgtcgtcccccggagggacagtcactctcacatgtgtctttattgactcggaccagtctacctagttccttaccgactacctaaacgtcggttaccagtacaacgtaccgtggaacgacccggcccctaacgggtcgtttaacgtttagtcggtacgtacggtaacctaaacgaacggcctaaccgttcccgtaccggtaacccctcgggttacccggttttcgaacgggtcccttaccggtccgggtcgggtaccgaaacgtccgtccggtacccgtcgtaccgtccggttaccggtcggttcgttaccacggtcccgtaggaaccgggtacggtacggcgtacgtacttacgttacgtccgtccgttacctcgtagttacgtagttagacggttacgtaacggtcgttcgggttttaacggtccggggtacggggtaccggggttcccgtacggttacggttaccccggtacggttcgggtaaccggtaccgtaccggacgtccgtccccggtcccgtaacgtcccctcgtacccggttcccgtccccggtcctccgtacctccgtactaaccggttcacggttccggg

SEQ ID NO: 118552 - DNA, 797 bp, Homo sapiens
  misc_feature: GYAE6OF02IGG4N.42.37.D04.1.454.CMB.1.raw
  modified_base (169)..(169): a, c, t, g, unknown or other
  misc_feature (169)..(169): n is a, c, g, or t
  modified_base (174)..(174): a, c, t, g, unknown or other
  misc_feature (174)..(174): n is a, c, g, or t
  modified_base (212)..(212): a, c, t, g, unknown or other
  misc_feature (212)..(212): n is a, c, g, or t
  modified_base (331)..(331): a, c, t, g, unknown or other
  misc_feature (331)..(331): n is a, c, g, or t
tcagtgacgtatgtcacgaccggtgctcgatttagtagcatactgttgggtttggggggcgccaggggtcccttccaatatcagcaccatggcctggactcctctctttctgttcctcctcacttgctcgcccagggtccaatgctcagactggtggtcactcgaggcnccctnactgactgtccggtccccgggagggacagtcaccgtcncacattgtgtctttatgacgtaggaccagtccactagttcctaacacgtaccaaacgttcgtaccagaacaaacgtaccgaggaccgaccggaccccgtagggtaccgttagtttacgngggtacgacgtaaacgtaaacacgacctaaccgtccgtaaccggtccccttcggttaacccggtttctaaccggtccttccccggtacgggggtaccggggtaaacaaacggtcccgtacgtaccccgtagttaaccgtaccggttcgggttcccggttcggttaacgaccgtaccgggttaggaacgggtaacgggtacggtcgtaacggtaactttacgtaactacggttccctacgtccgttaagttagtacggttagaacggtcggtacggtaccggtttagggttaaccggttttcggggaacggggtacccggggtaaccgcgggttaccgaccggttccgtcgggtaaccaccggtacccgtacgccgtcccgtaccccgttaccgggtacctacggttccgttcccgttacccgtaccctacccgttagaaccctaacgttcccgtacgacggtacgg

SEQ ID NO: 118553 - DNA, 716 bp, Homo sapiens
  misc_feature: GYAE6OF02FV2II.42.37.D04.1.454.CMB.1.raw
  modified_base (394)..(394): a, c, t, g, unknown or other
  misc_feature (394)..(394): n is a, c, g, or t
  modified_base (421)..(421): a, c, t, g, unknown or other
  misc_feature (421)..(421): n is a, c, g, or t
  modified_base (465)..(465): a, c, t, g, unknown or other
  misc_feature (465)..(465): n is a, c, g, or t
  modified_base (478)..(478): a, c, t, g, unknown or other
  misc_feature (478)..(478): n is a, c, g, or t
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtggtcactcaggagccctcactgactgtcgtcccccggagggacagtcactctcacatgtgtctttattgactggacctagtcacctagttcttaccataccaaactggttccagacaaacgcctaggaccaccggaccccacggtcgtttagttatggtgacgactaacgagacctactccgtcggacccctcggtcccgttttcgacggtcctcccgtcggtccggggaccaaaggtccncgtccctgacctcgtacggtccggttntcgacgtccgtagacgggacggacggtctacggacttacttacncggtccctctacngttacgtagtcgacgttcgggtacgtcggttacgggttacggttttccggggaccggggtaccggggtacccgtcggttacccgggtacccggttaccgggttcgggtaccaccgggtacccgtaaccgggtccgtaccccggtcccccgtacggttccctaccgttccccgtcccggtttacccccgtccccgttaccgtccgtaacccgtacgttacccgtaccgtacgtaccggg

SEQ ID NO: 118554 - DNA, 934 bp, Homo sapiens
  misc_feature: GYAE6OF02GM672.42.37.D04.1.454.CMB.1.raw
tcagtgacgtatgtcacgaccggtgctcgatttagtagcatactgttgggtttggggggcgccaggggtcccttccaatatcagcaccatggcctggactcctctctttctgttcctcctcacttgctgcccagggtccaatgctcagactgtggtcactcaggagccctcactgactgtcgtcccccggagggacagtcactctcacatgtgtctttatgactggaccagtccacctagttccttaccatacccaaaacgttcggttccaagacctaaaagaccgttagggaacctaaccgggaccccccgtaacggggtccgtttaaggttttacgtcggggttacgaccggtaaccgttaaacgaaacgtccctaacccgttccccgtacggggtaacccccccttcgggttacccccgggttttttaccgaaccggggttcccctttcccccccggttaccggggggttacccgggggggtaaaccctaaaaaccgggtcccgttacccgggaccccccgtttagggaacccgttttacccggttccggggtttaaccccgggtttcggtttacccgaacggggtaccccggtttaggggaaccgggtaaccgggtacggggtacccgttaacggtaaccgtttaaacgtttacccggttacccggtacccccgtttacccgttaccgtaacgttaacgttaacgttacggtaacgttacggtaaccgggttcggtttacgggttaaccggtttttccgggggaccggggtaaccgggtaacccggtcgtacccggtacccggttccggttccgggtaccgaccggtacccggaacggtcccgtacccggccccgttcggtaccttaccgttccgttcccgttacccctacccgtcctaccgtaccgtacgtaccgtcctacgtaccggg

SEQ ID NO: 118555 - DNA, 841 bp, Homo sapiens
  misc_feature: GYAE6OF02HTAIT.42.37.D04.1.454.CMB.1.raw
  modified_base (627)..(627): a, c, t, g, unknown or other
  misc_feature (627)..(627): n is a, c, g, or t
tcagtgacgtatgtcacgaccggtgctcgatttagtagcatactgttgggtttgggggcgccaggggtcccttccaatatcagcaccatggcctggactcctctctttctgttcctctcacttgctgccagggtccaatgctcagactgtgtcactcaggacgccctcactgacgtcgtccgtacccccgggagggaccaggtcacctctacactagtgtcgtatttatgtactcggacacgtcacctagtttccttaaccactaacctaaacgttcggttaccaagaccgtaaaacgtcccgtaacggacccgacccgggacccccgttaacgggttacggttttagtttaacggttgggaccgtaacggtaaaccgttaaaccgaacggtcctaacccgttccccggtaccggtacccccggtttacgggtttccccggttttacgaccgggtcccgttcccggttaccgggggtaccggggtaacaaccggtccgttaccggtccccgttagtaccttccggttacggttcccggttgtttacccgacggtccggtacgggaacgggccggtaggtaccgttagtaacctttaacgttaacgtcccgtttactccgttaacgtnttaggttaccgtggttaacggtacggtaccgggtttcgggttggtttaccggttcggggtaaccggggtaccgggttacccggtacgtcgggttaccggttccggacgggtcgtaaccgcccggtacgtccccgttaccggtcccgtacgtcccgtacgttcccgtccgttccccgctaccgttctacgtacccgttactaccggtacgtcggg

SEQ ID NO: 118556 - DNA, 575 bp, Homo sapiens
  misc_feature: GYAE6OF02GIO35.42.37.D04.1.454.CMB.1.raw
  modified_base (360)..(360): a, c, t, g, unknown or other
  misc_feature (360)..(360): n is a, c, g, or t
  modified_base (543)..(543): a, c, t, g, unknown or other
  misc_feature (543)..(543): n is a, c, g, or t
  modified_base (555)..(555): a, c, t, g, unknown or other
  misc_feature (555)..(555): n is a, c, g, or t
  modified_base (563)..(563): a, c, t, g, unknown or other
  misc_feature (563)..(563): n is a, c, g, or t
  modified_base (565)..(575): a, c, t, g, unknown or other
  misc_feature (565)..(575): n is a, c, g, or t
tcagtgacgtatgtcacgaccggtgctcgatttagtagcatactgttgggtttcctgcaagacttctggattttcgttcacgacctactacatgcactgggtgcgacaggcccctggacaggggacttgagtggatgggaattatcatccctagttctggccgcaccaactacgcacagaagtttcagggcagagtcaccatggaccggggacacgtccacgaccacggtctacatggacttgagcacgcctgagatatgacgacacggccatatattactgtgtgagagtatttagggttgggggtctttcgtttgtactataggaggcgacgggtaccctggtcctaccgtctcctcncgccctaccaccgaacgggccctacgtccggttcccttcccccgtcgggccctcccgtcgtccctaccgacggccgaccgaccctccggaacgacgccacgacggcccgggcccgtcgggccgtcgccgtaggtcaacggtcctaccgtccactacttccgtcacgtcggacggccggtacgngggacacgggcncggatcgncnnnnnnnnnnn

SEQ ID NO: 118557 - DNA, 753 bp, Homo sapiens
  misc_feature: GYAE6OF02JNI0Z.42.37.D04.1.454.CMB.1.raw
tcagtgacgtatgtcacgaccggtgctcgatttagtagcatactgttgggtttgggggggtcggccgagggggtcccgttccaatatcagcaccatggcctggactcctctctttctgttcctcctcacttgctgcccagggtccaatgctcagactgtggtcactcaggagccctcactgactgtcgtcccccggagggacagtcactctcacatgttactttattgactggaccagtcacctagttcctaccatacctaaacgttggttaccctagactaaaacgaccgtacgggaaccaccggacccccacgggtaccgttaacggttttacgtacggggttacgtaccggtaacgtaaaccaagtacctaacctcccgtaccggacccccttcgggtccccgtttttaccggaaccggtccttacccccggttccggtaccggggtaaacctaaacggccgttaccggcccttagacccttcgttcggtcccggtggttccacgttaccgtcggacggtaacggacgtccgtacggtacttacgttactcggtccctaccgtctacgtgtacgtcgacgtcgacgtcggtacggttacgtttccgggaccgggacggtacccgggtcttacgggtacccgtcggtacggtaccgtacggccgtaacgccgtccgtccccgtcgtccgtaccgtccttccggtcccctacccgtctacccgccgtacctaccggttccaccgtgtaccgg

SEQ ID NO: 118558 - DNA, 566 bp, Homo sapiens
  misc_feature: GYAE6OF02HZ9RL.42.37.D04.1.454.CMB.1.raw
  modified_base (399)..(399): a, c, t, g, unknown or other
  misc_feature (399)..(399): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
  modified_base (556)..(566): a, c, t, g, unknown or other
  misc_feature (556)..(566): n is a, c, g, or t
tcagtgacgtatgtcacgaccggtgctcgatttagtagcatactgttgggtttcctgcaagacttctggattttcgttcacgacctactacatgcactgggtgcgacaggcccctggacagggacttgagtggatgggaattatcatccctagttctggccgcaccaactacgcacagaagtttcagggcagagtcaccatgaccggggacacgtccacgaccacggtctacatggacttgagcagcctgagatatgacgacacggccattactattactgtgtgagtagaagttttggttgggggtctttcgtttgacttatagaggccgacgggttaccctggtaccaccgtctcctcagccctccaccacgggcccagtccggtaccttcccccgnggcccgtccctacgcctccgaggtacnccctaccnccggacgcgacacgcgcggcccgtggcctcgccgtcggacaaggtacctaccttaccacctaagtaccgtctaacgtggacggccgggtactcgggacgtaacgggcgtacgagtacggcgnnnnnnnnnnn

SEQ ID NO: 118559 - DNA, 214 bp, Homo sapiens
  misc_feature: GYAE6OF01D5E82.26.86.H09.1.454.CMB.1.raw
  modified_base (214)..(214): a, c, t, g, unknown or other
  misc_feature (214)..(214): n is a, c, g, or t
tcagagactatactcacgaccggtgctcgatttagtgctatagacttgggtttggggagctgctcagttaggacccagacggaaccatggaagccccagcgcagcttctcttcctcctgctactctggctcccaggaactgtggctgcaccatctgtcttcatcttcccgccatctgaagtatagtctctgagcgggctggcaaggcgcatagn

SEQ ID NO: 118560 - DNA, 217 bp, Homo sapiens
  misc_feature: GYAE6OF01EEVKZ.26.86.H09.1.454.CMB.1.raw
  modified_base (215)..(217): a, c, t, g, unknown or other
  misc_feature (215)..(217): n is a, c, g, or t
tcagagactatactcacgaccggtgctcgatttagtgctatagacttgggtttgggggagctgctcagttaggacccagacggaaccatggaagccccagcgcagcttctcttcctcctgctactctggctcccaggaactgtggctgcaccatctgtcttcatcttcccgccatctgaagtatagtctctgagcgggctggcaaggcgcatagnnn

SEQ ID NO: 118561 - DNA, 460 bp, Homo sapiens
  misc_feature: GYAE6OF01A23YC.26.86.H09.1.454.CMB.1.raw
  modified_base (455)..(460): a, c, t, g, unknown or other
  misc_feature (455)..(460): n is a, c, g, or t
tcagagactatactcacgaccggtgctcgatttagtgctatagacttgggtccgccagccccccgggaagggactggagtggattggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctggggcaaagggaccacggtcaccgtctcctcagcctccaccaagggccccatcggtcttccccctggccaccctcctccaagacgcacctctgggggcacagcggccctgggctgcctggtcaaggactacttccagtatagtctctgagcgggctggcaaggcgcatagnnnnnn

SEQ ID NO: 118562 - DNA, 217 bp, Homo sapiens; identical to SEQ ID NO: 118560
  misc_feature: GYAE6OF01AYH7P.26.86.H09.1.454.CMB.1.raw
  modified_base (215)..(217): a, c, t, g, unknown or other
  misc_feature (215)..(217): n is a, c, g, or t

SEQ ID NO: 118563 - DNA, 458 bp, Homo sapiens
  misc_feature: GYAE6OF01BWD7Z.26.86.H09.1.454.CMB.1.raw
  modified_base (452)..(458): a, c, t, g, unknown or other
  misc_feature (452)..(458): n is a, c, g, or t
tcagagactatactcacgaccggtgctcgatttagtgctatagacttgtgtccgccagccccccgggaagggactggagtggattggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccagtatagtctctgagcgggctggcaaggcgcatagnnnnnnn

SEQ ID NO: 118564 - DNA, 451 bp, Homo sapiens
  misc_feature: GYAE6OF01DQBCE.26.86.H09.1.454.CMB.1.raw
  modified_base (448)..(451): a, c, t, g, unknown or other
  misc_feature (448)..(451): n is a, c, g, or t
tcagagactatactcacgaccggtgctcgatttagtgctatagacttgggtccgccagccccccgggaagggactggagtggattggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctggggcaaagggccaacggtcaccgtctcctcagcctccaccaagggcccatcggtcttccccctggcaccctcctccaagagcacctctggggcacagcgccctgggctgcctggtcaaggctactccagtatagtctctgagcgggctggcaaggcgcatagnnnn

SEQ ID NO: 118565 - DNA, 459 bp, Homo sapiens
  misc_feature: GYAE6OF01E3ARF.26.86.H09.1.454.CMB.1.raw
  modified_base (454)..(459): a, c, t, g, unknown or other
  misc_feature (454)..(459): n is a, c, g, or t
tcagagactatactcacgaccggtgctcgatttagtgctatagacttgggtccgccagccccccgggaagggactggagtggattggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccagtatagtctctgagcgggctgggcaagggcgcatagnnnnnn

SEQ ID NO: 118566 - DNA, 457 bp, Homo sapiens
  misc_feature: GYAE6OF01DG9CE.26.86.H09.1.454.CMB.1.raw
  modified_base (364)..(364): a, c, t, g, unknown or other
  misc_feature (364)..(364): n is a, c, g, or t
  modified_base (450)..(457): a, c, t, g, unknown or other
  misc_feature (450)..(457): n is a, c, g, or t
tcagagactatactcacgaccggtgctcgatttagtgctatagacttgggtccgccagccccccgggaagggactggagtggattggggaagtctttcatactgggacccccgactacaacccgtccctcgagggtcgagtcgtcatatcgttagacaagtccaagaaccagttctccatgaggctgacttccgtgaccgccgcggacacggccgtctattactgtgcgagggtggtcggggacttcgaagatatggactatttgtattactacatggacgtctgggcaagggaccacggtcaccgtctcctcagcctccaccaagggcccatcggtcttccccctggcaccctcctccaagancacctctgggggcacagcggccctgggctgcctggtcaaggactacttcagtatagtctctgagcgggctggcaaggcgacatagnnnnnnnn

SEQ ID NO: 118567 - DNA, 458 bp, Homo sapiens
  misc_feature: GYAE6OF01EFENL.26.86.H09.1.454.CMB.1.raw
  modified_base (454)..(458): a, c, t, g, unknown or other
  misc_feature (454)..(458): n is a, c, g, or t
tcagagactatactcacgaccggtgctcgatttagtgctatagacttgggtccgccagccccccgggaagggactggagtggattggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctggggcaaagggaccacggtcaccgtctcctcagcctccaccaagggccccatcggtcttccccctggccaccctcctccaagagcacctctgggggcacagcggccctgggctgcctggtcaaggactacttccagtatagtctctgagcgggctggcaaggcgcatagnnnnn

SEQ ID NO: 118568 - DNA, 225 bp, Homo sapiens
  misc_feature: GYAE6OF01AHF0F.26.86.H09.1.454.CMB.1.raw
  modified_base (217)..(225): a, c, t, g, unknown or other
  misc_feature (217)..(225): n is a, c, g, or t
tcagagactatactcacgaccggtgctcgatttagtgctatagacttgggtttggggggagctgctcagttaggacccagacggaaccatggaagccccagcgcagcttctcttcctcctgctactctggctcccaggaactgtggctgcaccatctgtcttcatcttcccgccatctgaagtatagtctctgaggcgggctggcaaggcgcatagnnnnnnnnn

SEQ ID NO: 118569 - DNA, 428 bp, Homo sapiens
  misc_feature: GYAE6OF01C6ZKP.26.86.H09.1.454.CMB.1.raw
  modified_base (414)..(414): a, c, t, g, unknown or other
  misc_feature (414)..(414): n is a, c, g, or t
  modified_base (420)..(428): a, c, t, g, unknown or other
  misc_feature (420)..(428): n is a, c, g, or t
tcagagactatactcacgaccggtgctcgatttagtgctatagacttgggtttggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctggggcaaagggaccacggtcaccgtctcctcagcctccaccaagggcccatcggtcttccccctggcaccctcctccaagagccacctcgtgggggcacgagcggcctgggctgcctggtcaaggactacttcagtatagtctctgagcggctggcaaggcncatagnnnnnnnnn

SEQ ID NO: 118570 - DNA, 465 bp, Homo sapiens
  misc_feature: GYAE6OF01E09Y3.26.86.H09.1.454.CMB.1.raw
  modified_base (368)..(368): a, c, t, g, unknown or other
  misc_feature (368)..(368): n is a, c, g, or t
  modified_base (454)..(465): a, c, t, g, unknown or other
  misc_feature (454)..(465): n is a, c, g, or t
tcagagactatactcacgaccggtgctcgatttagtgctatagacttgggtccgccagccccccgggaagggactggagtggattggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctgggggcaaagggaccacggtcaccgtctcctcagcctccaccaagggcccatcggtcttccccctggccaccctcctccaagancacctctggggcacagcggccctgggctcgcctgtcaaggactacttccagtatagtctctgagcgggctggcaaggcgcagtagnnnnnnnnnnnn

SEQ ID NO: 118571 - DNA, 499 bp, Homo sapiens
  misc_feature: GYAE6OF01ATC1K.26.86.H09.1.454.CMB.1.raw
  modified_base (95)..(95): a, c, t, g, unknown or other
  misc_feature (95)..(95): n is a, c, g, or t
  modified_base (488)..(499): a, c, t, g, unknown or other
  misc_feature (488)..(499): n is a, c, g, or t
tcagagactatactcacgaccggtgctcgatttagtgctatagacttgggtccgccagccccccgggaagggactggagtggattgggggaagtntttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtcgtggggcaaagggaccacggtcaccggtctcctcagcctccaccaagggcccatcggtccttcccccgtggccacccctcctccaacgacgccaccgttcgtgggggccacgacggccggcccctggggcctcgcccgttggtaccaaggactaccttccagttactagtctcgtgagcgggctgggcaacgggccacagtagnnnnnnnnnnnn

SEQ ID NO: 118572 - DNA, 224 bp, Homo sapiens
  misc_feature: GYAE6OF01E1LWP.26.86.H09.1.454.CMB.1.raw
  modified_base (221)..(224): a, c, t, g, unknown or other
  misc_feature (221)..(224): n is a, c, g, or t
tcagagactatactcacgaccggtgctcgatttagtgctatagacttgggtttggggggaagaggaagactgacggtcctcccaggagttcaggtgctgggcaccgtgggcagtgggggaggtgtgtcacaagatttgggctctgggcacagcggccctgggctgcctggtcaaggactacttccagtatagtctctgagcgggctggcaaggcgcatagnnnn

SEQ ID NO: 118573 - DNA, 518 bp, Homo sapiens
  misc_feature: GYAE6OF01CAXBT.26.86.H09.1.454.CMB.1.raw
  modified_base (231)..(231): a, c, t, g, unknown or other
  misc_feature (231)..(231): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
  modified_base (477)..(477): a, c, t, g, unknown or other
  misc_feature (477)..(477): n is a, c, g, or t
  modified_base (481)..(485): a, c, t, g, unknown or other
  misc_feature (481)..(485): n is a, c, g, or t
  modified_base (487)..(518): a, c, t, g, unknown or other
  misc_feature (487)..(518): n is a, c, g, or t
tcagagactatactcacgaccggtgctcgatttagtgctatagacttgggtccgccagcccccccgggaagggactggagtggattggggaagtctttcatactgggaccccccgactacaacccgtccctcgagggtcagtcgtcatatcgttagacaagtccaagaaccagttctccctgaggctgacttccgtgaccgccgcggacacggccgtctattactgtgcgngggtggtcggggacttcgaagatagtggactatttgtattactacatggactcgtgggggacaaaagggacccacggtcaaccgtctcctcagcctccaccaagggccccagtcggtccttccccctggactaccctcctccaagtcgcaaccctgtcgggggcacgagcggcctgggactcgctgtacaaggactacttccagtanacgtctcgngtagcgggctcggcaagggcgacgattagnagcnnnnncnnnnnnnnnnnnnnnnnnnnnnnnnnnnnnnn

SEQ ID NO: 118574 - DNA, 216 bp, Homo sapiens
  misc_feature: GYAE6OF02FZHTA.26.86.H09.1.454.CMB.1.raw
  modified_base (215)..(216): a, c, t, g, unknown or other
  misc_feature (215)..(216): n is a, c, g, or t
tcagagactatactcacgaccggtgctcgatttagtgctatagacttgggtttgggggagctgctcagttaggacccagacggaaccatggaagccccagcgcagcttctcttcctcctgctactctggctcccaggaactgtggctgcaccatctgtcttcatcttcccgccatctgaagtatagtctctgagcgggctggcaaggcgcatagnn

SEQ ID NO: 118575 - DNA, 566 bp, Homo sapiens
  misc_feature: GYAE6OF02F59CB.26.86.H09.1.454.CMB.1.raw
  modified_base (488)..(488): a, c, t, g, unknown or other
  misc_feature (488)..(488): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (511)..(511): a, c, t, g, unknown or other
  misc_feature (511)..(511): n is a, c, g, or t
  modified_base (513)..(514): a, c, t, g, unknown or other
  misc_feature (513)..(514): n is a, c, g, or t
  modified_base (520)..(525): a, c, t, g, unknown or other
  misc_feature (520)..(525): n is a, c, g, or t
  modified_base (527)..(527): a, c, t, g, unknown or other
  misc_feature (527)..(527): n is a, c, g, or t
  modified_base (540)..(541): a, c, t, g, unknown or other
  misc_feature (540)..(541): n is a, c, g, or t
  modified_base (548)..(548): a, c, t, g, unknown or other
  misc_feature (548)..(548): n is a, c, g, or t
  modified_base (557)..(557): a, c, t, g, unknown or other
  misc_feature (557)..(557): n is a, c, g, or t
  modified_base (563)..(563): a, c, t, g, unknown or other
  misc_feature (563)..(563): n is a, c, g, or t
tcagagactatactcacgaccggtgctcgatttagtgctatagacttggggtccgccagcccccgggaacgggactggagtggattggggaagtcctttcatactgggaccccccgactacaacccgtccctccgacgggtccgacgtcgtcgatatccgttaggacaagtcccaagtaacctaggttctccctgaggctgacttccggtgacccgccgcggacacgggccgtctattactgtgcgagggtggtcggggacgttcgaagatatggactatttggattactacatggacgtctggggcaagggaccacggtcaccggtctcctcagcctccaccaagggcccaatcgggtcgttcccccctggccacccgtccctccgaacgaggcacctctgggggcacgagcggacctgggcctaggcctgggtcaaggactacgttccagtactagtctacgtgacgcgggctgggtccaagggcncgagtacggncngcangcacgcncnngatacnnnnnngngcgcgtctctgtnncgcgcgngcgcggcgngcgtgngcg

SEQ ID NO: 118576 - DNA, 462 bp, Homo sapiens
  misc_feature: GYAE6OF02G7IUY.26.86.H09.1.454.CMB.1.raw
  modified_base (452)..(462): a, c, t, g, unknown or other
  misc_feature (452)..(462): n is a, c, g, or t
tcagagactatactcacgaccggtgctcgatttagtgctatagacttgggtccgccagccccccgggaagggactggagtggattggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctgggggcaaagggaccacggtcaccgtctcctcagcctccaccaagggcccatcggtcttccccctggcaccctcctccaagagcacctctgggggcacagcggccctgggctgcctggtcaaggctacttccagtatagtctctgagcgggctggcaaggcgcatagnnnnnnnnnnn

SEQ ID NO: 118577 - DNA, 219 bp, Homo sapiens
  misc_feature: GYAE6OF02HKM08.26.86.H09.1.454.CMB.1.raw
  modified_base (216)..(219): a, c, t, g, unknown or other
  misc_feature (216)..(219): n is a, c, g, or t
tcagagactatactcacgaccggtgctcgatttagtgctatagacttgggtttggggggagctgctcagttaggacccagacggaaccatggaagccccagcgcagcttctcttcctcctgctactctggctcccaggaactgtggctgcaccatctgtcttcatcttcccgccatctgaagtatagtctctgagcgggctggcaaggcgcatagnnnn

SEQ ID NO: 118578 - DNA, 488 bp, Homo sapiens
  misc_feature: GYAE6OF02HVF10.26.86.H09.1.454.CMB.1.raw
  modified_base (471)..(472): a, c, t, g, unknown or other
  misc_feature (471)..(472): n is a, c, g, or t
  modified_base (474)..(488): a, c, t, g, unknown or other
  misc_feature (474)..(488): n is a, c, g, or t
tcagagactatactcacgaccggtgctcgatttagtgctatagacttgggtccgccagccccccgggaagggactggagtggattgggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctgggggcaaagggaccacgggtcaccgtctcctcacgcctccaccaagggccccatccggtccttccccctgggccacccctcctccaacgacgccacctcgtgggggcacgagccggccctgggctgcctggtcaaggactactccagtactacgtctctgagcgggctgggcaacggcgcatagnngnnnnnnnnnnnnnnn

SEQ ID NO: 118579 - DNA, 557 bp, Homo sapiens
  misc_feature: GYAE6OF02F0SK1.26.86.H09.1.454.CMB.1.raw
  modified_base (307)..(307): a, c, t, g, unknown or other
  misc_feature (307)..(307): n is a, c, g, or t
  modified_base (526)..(557): a, c, t, g, unknown or other
  misc_feature (526)..(557): n is a, c, g, or t
tcagagactatactcacgaccggtgctcgatttagtgctatagacttgggtccgccagccccccgggaagggactggagtggattggggaagtctttcatactgggacccccgactacaaccccgtccctcgagggtcgagtcgtcatatcgttagacaagtccaagaaccagttctccctgaggctgacttccgtgacccgccgcggacacggccgtctattactgtgcgagggtggtcggggacttcgaagatatggactatttgtattactacatggacgtctggggacaaagggaccacggtnaccgtctcctcagccctccaccaacgggcccatcggtccttcccccgtggtccacccctccctcccaagacgccaaccctccgtcggggggtccacgacgccgggaccccgtcggggtccgtgtcccgtcgggtccgaaacggtaccttaccttccgaacgttataagttcctacgttggtacggccggggtcgtcggacgagggccgacacgtaggannnnnnnnnnnnnnnnnnnnnnnnnnnnnnnn

SEQ ID NO: 118580 - DNA, 240 bp, Homo sapiens
  misc_feature: GYAE6OF02IGLLN.26.86.H09.1.454.CMB.1.raw
  modified_base (174)..(174): a, c, t, g, unknown or other
  misc_feature (174)..(174): n is a, c, g, or t
  modified_base (185)..(185): a, c, t, g, unknown or other
  misc_feature (185)..(185): n is a, c, g, or t
  modified_base (223)..(240): a, c, t, g, unknown or other
  misc_feature (223)..(240): n is a, c, g, or t
tcagagactatactcacgaccggtgctcgatttagtgctatagacttggggtttggggggagctgctcagttaggacccagacggaaccatggaacgccccagcgcagcttctcttcctcctgctactctggctccaggaactgtggctgcaccatctgtcttcatccttcccncatctgaagtntagtctctggaggcgggctgggacaaggcgatagtagnnnnnnnnnnnnnnnnnn

SEQ ID NO: 118581 - DNA, 216 bp, Homo sapiens
  misc_feature: GYAE6OF01AHD20.1.2.A02.1.454.CMB.1.raw
  modified_base (216)..(216): a, c, t, g, unknown or other
  misc_feature (216)..(216): n is a, c, g, or t
tcagacgagtgcgtcacgaccggtgctcgatttagactcatctactcggcgggggagtaagggttttgttcagcaagacaatggagagctctcactgtggtggacgttcggccaagggaccaaggtggaaatcaaacgaactgtggctgcaccatctgtcttcatcttcccgccatctgaacgcactcgtctgagcgggctggcaaggcgcatagn

SEQ ID NO: 118582 - DNA, 527 bp, Homo sapiens
  misc_feature: GYAE6OF01CRETY.1.2.A02.1.454.CMB.1.raw
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
  modified_base (455)..(455): a, c, t, g, unknown or other
  misc_feature (455)..(455): n is a, c, g, or t
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (502)..(502): a, c, t, g, unknown or other
  misc_feature (502)..(502): n is a, c, g, or t
  modified_base (511)..(511): a, c, t, g, unknown or other
  misc_feature (511)..(511): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
tcagacgagtgcgtcacgaccggtgctcgatttagactcatctacgagggaaagggccaccctctcctgcagggccagtcagagtgttagcaacaactacttagcctggtaccagcagaacctggccaggctccaggttcctcatctatgctgggtcccacgagggccactggcatcccagacaggttcagtggcagtgggtctgggacagacttcactctcatcattagcagactggagcctgaagtatttcgctagttagttattactgtcagcagtanggaattcacttntgtcgttacgccaaggaccaaggtanaatgaaacgtactagtgctagcacagtctgtcttacattccgttccgctagtcctagaccgttcgtcctacgtacgtcggtacgtccgggtacttacggaccgaaacgggccgtaccgtacgttaacggctacgcncgagagcgtatactctatactactactacanatanangngtgtcgtnacgcgacgngacgcananangngng

SEQ ID NO: 118583 - DNA, 215 bp, Homo sapiens
  misc_feature: GYAE6OF01ALIBR.1.2.A02.1.454.CMB.1.raw
  modified_base (214)..(215): a, c, t, g, unknown or other
  misc_feature (214)..(215): n is a, c, g, or t
tcagacgagtgcgtcacgaccggtgctcgatttagactcatctactcgcgggggagaagggttttgttcagcaagacaatggagagctctcactgtggtggacgttcggccaagggaccaaggtggaaatcaaacgaactgtggctgcaccatctgtcttcatcttcccgccatctgaacgcactcgtctgagcgggctggcaaggcgcatagnn

SEQ ID NO: 118584 - DNA, 488 bp, Homo sapiens
  misc_feature: GYAE6OF01D7JW0.1.2.A02.1.454.CMB.1.raw
  modified_base (248)..(248): a, c, t, g, unknown or other
  misc_feature (248)..(248): n is a, c, g, or t
  modified_base (373)..(373): a, c, t, g, unknown or other
  misc_feature (373)..(373): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (454)..(455): a, c, t, g, unknown or other
  misc_feature (454)..(455): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (467)..(468): a, c, t, g, unknown or other
  misc_feature (467)..(468): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
tcagacgagtgcgtcacgaccggtgctcgatttagactcatctacaggggtaaaggggccaccctctcctgcagggccagtcaggagtgttagcaacaactacttagcctggtaccagccagaaacctggccaggctcccaggctcctcatctatggtgcatccagcagggccactggcatcccagacaggttcagtggcaggtgggtctgggacagacttcgactctcaccatcgaccagactggancctgaagaattttgcagtgtattactgtcaagcagtatggtagctcacctccatcgtactacttttggccagggaccaaggtgaaatcaaacgactgtcgctagcaccatctcgtctcatctccnctactctacgtactcgtctcgtactgaggtcggtctggacaggccgactaagttagcagtntcgtgcgtagcncgnacncnncncncgcgcacnncncncnctcncacncngngn

SEQ ID NO: 118585 - DNA, 740 bp, Homo sapiens
  misc_feature: GYAE6OF01CT86O.1.2.A02.1.454.CMB.1.raw
  modified_base (262)..(262): a, c, t, g, unknown or other
  misc_feature (262)..(262): n is a, c, g, or t
tcagacgagtgcgtcacgaccggtgctcgatttagactcatctacaggggtaaaggggcccaaaccctctccctcgcgagggcctacgtcagagtgttagccaacaactacttagcctggtaccagcagaaacctggtccaggctcccaggctcctcatctatcggtgccatcccagccagggccactggcatcccagacaggttcagtggcgagtgggtctggggacagtacttcacgtctcaccatctaccagactggancctagagattttgcagtcgtatactgtcagcagtatggtagtcgtcgaccttcccaatacggtaactacgttttggaccgtaaggggtaccgaagggttacgggaaaattaccgaaaacggtaacgttaggtacggtaccttacggacctaacccgaatttccgtcgttacctttaccgtaacggttcccttaccccggcctaacttccgttacggtaaccctttacggtacccgttaccgttaccgtaagggtaaaccggtccggggtaccgttaaccggggaacccggaaacgggtaccccggtagttaaaacggtttacggtacggtagtaaccggtacggtacggtacggtacgtacgttagttacgtacgtactacgttacgttacgttacgttacgttacgtacggttacggtacggtaacggtaacggtaccgtaaccgtaccgtaccgtaccgtacccgtaccggtaccg

SEQ ID NO: 118586 - DNA, 497 bp, Homo sapiens
  misc_feature: GYAE6OF01AL1BO.1.2.A02.1.454.CMB.1.raw
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (476)..(481): a, c, t, g, unknown or other
  misc_feature (476)..(481): n is a, c, g, or t
  modified_base (483)..(495): a, c, t, g, unknown or other
  misc_feature (483)..(495): n is a, c, g, or t
  modified_base (497)..(497): a, c, t, g, unknown or other
  misc_feature (497)..(497): n is a, c, g, or t
tcagacgagtgcgtcacgaccggtgctcgatttagactcatctacgtaggggaaagggccaccctctcctgcagggccagtcagagtgttagcaacaactacttagcctggtaccagcagaaacctggccaggctcccaggctcctccatcctagtcggtgcagtccagcagggccactggcatcccagacaggttcagtcggcagtgggtctgggacagacttcactctcaccatcaccagactggacgcctgaagattttgcagtgtattacgtgtcagtcgagtagtggtagtctcacctcccatgtactacgttttggcctaggggtaccaagggttcggaaaactcgaaaccgaacgtggtacggctggaccacattcgtgtcttctatccttccccgctactctcgacctcgtcctctactgacgtcgggctcggcaacggcnctagtnctncncgngatcgntcgtntnnnnnngnnnnnnnnnnnnngn

SEQ ID NO: 118587 - DNA, 497 bp, Homo sapiens
  misc_feature: GYAE6OF01CR1I8.1.2.A02.1.454.CMB.1.raw
  modified_base (251)..(251): a, c, t, g, unknown or other
  misc_feature (251)..(251): n is a, c, g, or t
  modified_base (473)..(497): a, c, t, g, unknown or other
  misc_feature (473)..(497): n is a, c, g, or t
tcagacgagtgcgtcacgaccggtgctcgatttagactcatctacagggaaatggccaccctctcctgcagggccagtcagagtgttagcaacaactacttagcctggtaccagcagaaacctggccaggctcccaggctcctcatctatggtgcatccagcaggccactggcatcccagacaggttcagtggcagtgggtctgggacagtacttcactctcaccatcaccagactggacgcctgaaagtnttttgactagtgtaattactgtcagctagtagtaggtagcctccaccctccgtatgtactacgtttacggacgtacgggacgaaggtacgaaatacgaaacgaacgtggtacggctgaccgactacttcgtgttcttactactcccttcccgacctatcctacgtacctcgttctccgtaacgtggacggcggcgttcggaacgacggtaccacgtatacgnnnnnnnnnnnnnnnnnnnnnnnnn

SEQ ID NO: 118588 - DNA, 222 bp, Homo sapiens
  misc_feature: GYAE6OF02ILGO1.1.2.A02.1.454.CMB.1.raw
  modified_base (215)..(222): a, c, t, g, unknown or other
  misc_feature (215)..(222): n is a, c, g, or t
tcagacgagtgcgtcacgaccggtgctcgatttagactcatctactcgcgggggagaagggtttttgttcagcaagacaatggagagctctcactgtggtggacgttcggccaagggaccaaggtggaaatcaaacgaactgtggctgcaccatctgtcttcatcttcccgccatctgaacgcactcgtctgagcgggctggcaaggcgcatagnnnnnnnn

SEQ ID NO: 118589 - DNA, 639 bp, Homo sapiens
  misc_feature: GYAE6OF02H0G01.1.2.A02.1.454.CMB.1.raw
  modified_base (563)..(563): a, c, t, g, unknown or other
  misc_feature (563)..(563): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
tcagacgagtgcgtcacgaccggtgctcgatttagactcatctacgagggaaagggccaccctctcctgcagggccagtcagagtgttagcaacaatacttagcctggtaccagcagaaacctggccaggctccaggctcctcatctatggtgcatccagcgacgggccacgtggcactcccagacaggttcaggtggcaggtgggtctgggacagtacttcacgtctacaccactccacagactggagcctagaagtatttagacgagttagtattacgtgtcgagcgtagtagtcggtacgcgtccacctcctagtgtacgtacgttttcggaccgaggggtaccaagggtaggtaaactacgaaaacgacgtacgtacggtcgtacgacctactactacgtacgttacttctaccgtttcctttccccggacctaacgttacccgtaccggtaccgttaccgtttaccgttacgttaacccgtaggtacgggtcccggggttacggtacggggtaccggaagggtacccggtacgaaacgttgacgacgtacggacacgngtaccgattgtagtacgtgtggtactagggacttgacgttcgaagtcgtaccgngngacgcgacgtacgcgtctcg

SEQ ID NO: 118590 - DNA, 141 bp, Homo sapiens
  misc_feature: GYAE6OF01BHTAX.1.30.C08.1.454.CMB.1.raw
  modified_base (141)..(141): a, c, t, g, unknown or other
  misc_feature (141)..(141): n is a, c, g, or t
tcagacgagtgcgtcacgaccggtgctcgatttagtctgacgtcatcgcggggaaatcaaacgaactgtggctgcaccatctgtcttcatcttcccgccatctgaacgcactcgtctgagcgggctggcaaggcgcatagn

SEQ ID NO: 118591 - DNA, 155 bp, Homo sapiens
  misc_feature: GYAE6OF01CIV8R.1.30.C08.1.454.CMB.1.raw
  modified_base (152)..(155): a, c, t, g, unknown or other
  misc_feature (152)..(155): n is a, c, g, or t
tcagacgagtgcgtcacgaccggtgctcgatttagtctgacgtcaaagggaagggaccaaggtggaatcaaacgaactgtggctgcaccatctgtcttcatcttcccgccatctgaacgcactcgtctgagcgggctggcaaggcgcatagnnnn

SEQ ID NO: 118592 - DNA, 140 bp, Homo sapiens
  misc_feature: GYAE6OF01AR46Q.1.30.C08.1.454.CMB.1.raw
tcagacgagtgcgtcacgaccggtgctcgatttagtctgacgtcatcgcgggggaaatcaaacgaactgtggctgcaccatctgtcttcatcttcccacctcctcacgcactcgtctgagcgggctggcaaggcgcatag

SEQ ID NO: 118593 - DNA, 256 bp, Homo sapiens
  misc_feature: GYAE6OF01ENOHP.1.30.C08.1.454.CMB.1.raw
  modified_base (255)..(256): a, c, t, g, unknown or other
  misc_feature (255)..(256): n is a, c, g, or t
tcagacgagtgcgtcacgaccggtgctcgatttagtctgacgtcatcgcgggaagatgaagacagatttcactctcaccatcagcagcctgcagcctgaagattttgcaacgtattactgtcaacagtttaataattaccctactttcggcccttggaccaaagtggatatcaagcgaactgtggctgcaccatctgtcttcatcttcccgccatctgaacgcactcgtctgagcgggctggcaaggcgcatagnn

SEQ ID NO: 118594 - DNA, 154 bp, Homo sapiens
  misc_feature: GYAE6OF01A40CN.1.30.C08.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtctgacgtcaaagggaaagggaccaaggtggagatcaaacgaactgtggctgcaccatctgtcttcatcttcccgccatctgaacgcactcgtctgagcgggctggcaaggcgcatagn

SEQ ID NO: 118595 - DNA, 140 bp, Homo sapiens
  misc_feature: GYAE6OF01C6AAJ.1.30.C08.1.454.CMB.1.raw
tcagacgagtgcgtcacgaccggtgctcgatttagtctgacgtcatcgcggggaaatcaaacgaactgtggctgcaccatctgtcttcatcttcccaccctcctcacgcactcgtctgagcgggctggcaaggcgcatag

SEQ ID NO: 118596 - DNA, 254 bp, Homo sapiens
  misc_feature: GYAE6OF01EDQGJ.1.30.C08.1.454.CMB.1.raw
  modified_base (253)..(254): a, c, t, g, unknown or other
  misc_feature (253)..(254): n is a, c, g, or t
tcagacgagtgcgtcacgaccggtgctcgatttagtctgacgtcatcgcgggaagatgaagacagatttcactctcaccatcagcagcctgcagcctgaagtattttgcaacgtattactgtcaactagtttaataattaccctactttcggccctgggaccaaagtggatatcaagcgaactgtggctgcaccatctgtctcatcttcccacctcctcacgcactcgtctgagcggctggcaggcgcatagnn

SEQ ID NO: 118597 - DNA, 141 bp, Homo sapiens; identical to SEQ ID NO: 118590
  misc_feature: GYAE6OF02I20KQ.1.30.C08.1.454.CMB.1.raw
  modified_base (141)..(141): a, c, t, g, unknown or other
  misc_feature (141)..(141): n is a, c, g, or t

SEQ ID NO: 118598 - DNA, 142 bp, Homo sapiens
  misc_feature: GYAE6OF02JOTIY.1.30.C08.1.454.CMB.1.raw
  modified_base (139)..(142): a, c, t, g, unknown or other
  misc_feature (139)..(142): n is a, c, g, or t
tcagacgagtgcgtcacgaccggtgctcgatttagtctgacgtcatcgcggggaaatcaacgaactgtggctgcaccatctgtcttcatcttccgcctccttcacgcactcgtctgagcgggctggcaaggcgcatagnnnn

SEQ ID NO: 118599 - DNA, 144 bp, Homo sapiens
  misc_feature: GYAE6OF02JICRN.1.30.C08.1.454.CMB.1.raw
  modified_base (142)..(144): a, c, t, g, unknown or other
  misc_feature (142)..(144): n is a, c, g, or t
tcagacgagtgcgtcacgaccggtgctcgatttagtctgacgtcatcgcgggggaaatcaaacgaactgtggctgcaccatctgtcttcatcttcccaccctcctcacgcactcgtctgagcgggctggcaaggcgcatagnnn

SEQ ID NO: 118600 - DNA, 265 bp, Homo sapiens
  misc_feature: GYAE6OF01ASOH7.34.21.B10.1.454.CMB.1.raw
  modified_base (244)..(265): a, c, t, g, unknown or other
  misc_feature (244)..(265): n is a, c, g, or t
tcagtacacgtgatcacgaccggtgctcgatttagtgtcgtcgcaagaggagagggggtgccagggggaagaccgatgggccctggtcaaccgtctcctcgagcctccaccaagggcccatcggtcttcccctggcaccctcctccaagagcacctctgggggcacagcggccctgggctgccctggtccaaggacctacttccatcacgtgtacgtgagcggggctgggcaaggcgcagtagnnnnnnnnnnnnnnnnnnnnnn

SEQ ID NO: 118601 - DNA, 708 bp, Homo sapiens
  misc_feature: GYAE6OF01CTEMX.34.21.B10.1.454.CMB.1.raw
tcagtacacgtgatcacgaccggtgctcgatttagtgtcgtcgcaagagaggagggggacccaacaaccacacccctcctaagaagaagcccctagaccacagctccacaccatggactggacctggaggatcctcttcttggtggcagcagcaacaggtgcccactccccaggtgcagctggtgcaatctgggtctgagttgaagaagccgtggggcctcagtgaaggtttcctgcaagccttcgtggactacaccttcactagctatgctatgctagttggggtgcgacgacggcccctgggacgaagggcttggagtgggagtgggatggatcaaactaccgaaacgacgtacgggaacccaaggtactcggcccgagggcttcgactagggtacggttttcgtaccgtttcgtccgtttaggacctaccgttcgtgtaccacggcgaacccgggctaacgttacgtccgtagtacgtaacgtactcgaacggtaccgtaacggtacccttaaggtccgggtacgttagggaaacgggtacctacccggttcggacccggtttgttaaaacgtttccggtaggttcgggaccgggtaacgggttacggtaaccttttaaagtttaacccgttaaggttaacggttaagttaaaacggggttaaacggttttaggttttaaacgttagggttaacggttaaccggg

SEQ ID NO: 118602 - DNA, 719 bp, Homo sapiens
  misc_feature: GYAE6OF01ED4CD.34.21.B10.1.454.CMB.1.raw
  modified_base (286)..(286): a, c, t, g, unknown or other
  misc_feature (286)..(286): n is a, c, g, or t
  modified_base (377)..(377): a, c, t, g, unknown or other
  misc_feature (377)..(377): n is a, c, g, or t
tcagtacacgtgatcacgaccggtgctcgatttagtgtcgtcgcaagagaggagggggctgggcctcaggaagcagcagtcggaggtgcctcagccatggcatggatccctctcttcctcggcgtccttgcttactgcacaggatccgtggcctcctatgagctgacctcagccaccctcagtcgtccggtacgtccccaggaccagaccagcccaggccatccaccgtgccttcgtaggagaattaaaaggtggggaataaatagtgtcgtgcgtaggtactgancaaggacgccgacggccaccgtcccgtgtgtctcgtacctacgtactacgtagtaacgagctaaaaggtccggaaccgttcaccggggtanaccccggtaggtaccgtccggaattccgtacttacggaccttccggaaacttccctacgggtaacctacggaacgtacccaacgtccctacgacccctaagtcccgagtaccggggtaccctaggggaccctaaaggtccgggaacttgaagggtaccgtagggaccttaagttaccgttagttacctacgggtaccgtacggggaaccgtagggaccgtaaccgggacggttaccggggaagttccggggaacgggttaacggggtacccggtaacggggtacccgtacgggaaccccggttaccgtaaccgggttccctaagggtccccgtaaaccgggg

SEQ ID NO: 118603 - DNA, 905 bp, Homo sapiens
  misc_feature: GYAE6OF01BIZZX.34.21.B10.1.454.CMB.1.raw
tcagtacacgtgatcacgaccggtgctcgatttagtgtcgtcgcaagagaggagggggacccaacaaccacacccctcctaacgaagaagcccctagaccacagctccacaccatggactggacctggaggatcctcttcttggtggcagcagcaacaggtcgcccacctcccaggtgcagctggtgcaatcgtaggtcctagagttgaagtacgccggtggggccttacgaggtacgtaacgggttttcctcggtaccgtaaacgttcccgtttcgtacgggtaacttaacccgtacccctttaccgtaaccttaacggtacccgttaattcggtacccgttaacttcggaccgtttaaggttcggggtacgtaccggaaccggtaccggggtaccccgttaggggtaccggtaaacggggttacccgtttaggggtaacggtacggggttacgggttaggggaacgttacgggtaaccgttaccgaaacccgaaaccgtaaacccggaacggtacccgggtaaacccgtaacggttaaccggtaccggaccccggtagggtaccctttaccggaccgttaaccgggttacggtttttacgtacctttccggtaccgtttacggacctaccgttcgtacgtacgtacggacgtaccgtacgtaacttacgtcgtacgccgtaacggtactaccgtacgaacgtaccgtacccggttaaggtacggtaccggttaccggaaggttaaccccgaccggttacgggttaacccggtttacggttaacgttacccggttagggttccggaacggtacgggtaacgttacccgttaattaacggtacgttaaggtaacgttaacgggtttacgttaaagggtttactttaaacggttcggtaaaccggg

SEQ ID NO: 118604 - DNA, 806 bp, Homo sapiens
  misc_feature: GYAE6OF01EZTNF.34.21.B10.1.454.CMB.1.raw
  modified_base (328)..(328): a, c, t, g, unknown or other
  misc_feature (328)..(328): n is a, c, g, or t
tcagtacacgtgatcacgaccggtgctcgatttagtgtcgtcgcaagagaggacgggggacccaaacaaccacacccctcctaaagaagaacgcccctagaccacagctccacacctatggactgacctggagacttcctctcgttgggtggcacgcgagccaagacggtccgccctacctcccggagggtcgacgtacgtcggttggtacgtactacgttcggtgggtctggtaagtaggaacgtacgccgggacggtcaggtaggttacgttactccgacactacgtcgttacgtacggaccttaacctctaccgtaatctacgtnttaccgtactgtcgtactggttacgggtcacggcgaccggtccgtaagggagtaacggtgtacgtaggtacgtagggtactacggtaacacttaaccgaccgtaaccgtaccggtaacgtaccgtaaacccgagtccgggtaccgaccgtacgttccgacgttaagggtaccgtttccggttccttaaccttccgggtaaccctacggttacgtaccgttccgttacgtaccgtcgtaccgtaaccgtatacccgtcgtaaccgtacgtacgtaacgtcgtacccgaaccgtcggaacgttacgtacggtaaccgtggtaacccgtacgtacccggtaaccgttcggttaccgttaaggtcgttacgttaccggtacgttaaccggttaacgttaccgtttctaaacgtttcttaacgttagttaaggtttaaccgggtttaacggtttaaagtttaacgtaggttagggtaaccggg

SEQ ID NO: 118605 - DNA, 776 bp, Homo sapiens
  misc_feature: GYAE6OF01AQ61F.34.21.B10.1.454.CMB.1.raw
  modified_base (183)..(183): a, c, t, g, unknown or other
  misc_feature (183)..(183): n is a, c, g, or t
  modified_base (357)..(357): a, c, t, g, unknown or other
  misc_feature (357)..(357): n is a, c, g, or t
tcagtacacgtgatcacgaccggtgctcgatttagtgtcgtcgcaagaggagagggggacccaacaaccacacccctcctaagaagaagcccctagaccacagctccacaccgactggactggacctggaggatccctcttcttggtggcagcagtcaacgaggtcgcccactcccgaggtcncacgctggtcgacctaatccgtcgggtctacggtacgttagaacgtacgccgtgggtccctagaggtacggtaacggtttccaggacctaacgtcctttacgtaggtaccgtaccgtaccttacgtaacgtacggtaccttagttcgtacttagttcgtcgtagttcggggtanccgacgaccggtaccccgtaggaacggtagggtccttaggacggttaggaggttacgggtagttacggtacgtaacctaaccgtaaccccgtaacgtaccggttaaccggggaaacccgtacggtaaccggtccggaccccggttaggtccctttaccgacggttaacgggtccggtttgttcccgtttacgtccgttacggccctaccgttcgtcgtaccaacgccgtacggtactaacgtccgtgaccgtacgaacgtcgtacaaccggtcgtaacgtcccgtagtccgtaggtacgtacgtaaccgttcgtacgtacccgttaagttacctcgtaccggtcgacggtagttacgtacgttaacgttagacgtacgtaaggttaacgttacgttaaggttaactcggtagttacggg

SEQ ID NO: 118606 - DNA, 766 bp, Homo sapiens
  misc_feature: GYAE6OF01E0XBQ.34.21.B10.1.454.CMB.1.raw
tcagtacacgtgatcacgaccggtgctcgatttagtgtcgtcgcaagagaggagggggacccaacaaccacacccctcctaagaagaagcccctagaccacagctccacaccatggactggacctggaggatcctcttcttggtggcagcagcaacaggtgcccactccccaggtgcagctgatgcaatcgtgggtctgagttagaagacgccgtggggcctcgagtgtaaggtttcctgacaagtccttgtggactaccaccttcgactagtctatcgacttagtgtacgtagtttgggtcgacggaccgaccgggtccccgtaggggaacggtaaaggggtcgtttaggagggttagggaggtcggggtagtacgggtataacccgaaaccaacccaaaaccgtaaccgggtaaccgggtaaaacccccgtaaacggtacgtacccggacccggtacgggtacccttacgaaccgggtaacgggtttacggttttcgttcccgtttccgttacccgtttacgggtaacccttcccgtttacgtacggttaccgtaaccgggtcccgaaccggttacgttaattacccgtttcgtcggtaaccgaacggtactaccgacgttaacccgactaccgttaaggtcggtacgtagggaccggtacctacgttcgggtactttagttagttcgtcggtggaccgttaggtacgttaagttaactttacgagttagtaacgttaaggtaagtttagttagtaagttacgg

SEQ ID NO: 118607 - DNA, 275 bp, Homo sapiens
  misc_feature: GYAE6OF02H7HXK.34.21.B10.1.454.CMB.1.raw
  modified_base (81)..(81): a, c, t, g, unknown or other
  misc_feature (81)..(81): n is a, c, g, or t
  modified_base (232)..(233): a, c, t, g, unknown or other
  misc_feature (232)..(233): n is a, c, g, or t
  modified_base (238)..(238): a, c, t, g, unknown or other
  misc_feature (238)..(238): n is a, c, g, or t
  modified_base (243)..(244): a, c, t, g, unknown or other
  misc_feature (243)..(244): n is a, c, g, or t
  modified_base (247)..(275): a, c, t, g, unknown or other
  misc_feature (247)..(275): n is a, c, g, or t
tcagtacacgtgatcacgaccggtgctcgatttagtgtcgtcgcaagaggagagggggtgccaggggagaccgatggcccnggtcaccgtctcctcagcctccaccaagggcccatcggtcttccccctggcaccctcctccaagagcacctctgggggcacagcggccctgggctgcctggtcaaggctagttccatcacgtgtactgagcgggctggcaaggcgcatagnnagtcntgatnntgnnnnnnnnnnnnnnnnnnnnnnnnnnnnn

SEQ ID NO: 118608 - DNA, 745 bp, Homo sapiens
  misc_feature: GYAE6OF02I9LXJ.34.21.B10.1.454.CMB.1.raw
  modified_base (243)..(243): a, c, t, g, unknown or other
  misc_feature (243)..(243): n is a, c, g, or t
tcagtacacgtgatcacgaccggtgctcgatttagtgtcgtcgcaagagaggagggggacccaacaaccacacccctcctaagaagaagcccctagaccacagctccacaccatggactggacctggaggatcctcttcttggtggcaggcagcaacaggtcgcccactcccaggtgcagctggtgcaatcgtgggtctgagttgaagagccgtgggcctcagtgtacgtttctgcagcttcnggatacctacttcacgtagctatgctagtcgctagttgggtgcgacgacggtccccgtaggaacgaagggtcttggacggtggaggttacgggatagggtactacgaacaaccgtaacgtaacgtacgggtaaacccaacggtcgtaccgcccggtaaggtccgtacgacggtacggttaccggtttcttccgtttccgtttacccgttcggaaccctaccgttcgtacggtttcgaacgcgtaccggattacgtaacgtccgtgtacgtacgtacgttaccgagaccttacggtacctaacgttcgggtacggttacgaaacccgggtaagtaacccgggttccgtaaccgggtttacgtttaaccgttttcgtaggggtttcgaacccgggtaagggttacccggttaatttaaacccttaagttaacggtttaggaaaaccggttttaggttaaaggggtttccggttttaaacgttaacggttaggtttaaaccgggg

SEQ ID NO: 118609 - DNA, 595 bp, Homo sapiens
  misc_feature: GYAE6OF02H4MHL.34.21.B10.1.454.CMB.1.raw
  modified_base (183)..(183): a, c, t, g, unknown or other
  misc_feature (183)..(183): n is a, c, g, or t
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (359)..(359): a, c, t, g, unknown or other
  misc_feature (359)..(359): n is a, c, g, or t
  modified_base (397)..(397): a, c, t, g, unknown or other
  misc_feature (397)..(397): n is a, c, g, or t
  modified_base (421)..(421): a, c, t, g, unknown or other
  misc_feature (421)..(421): n is a, c, g, or t
  modified_base (460)..(460): a, c, t, g, unknown or other
  misc_feature (460)..(460): n is a, c, g, or t
  modified_base (471)..(471): a, c, t, g, unknown or other
  misc_feature (471)..(471): n is a, c, g, or t
tcagtacacgtgatcacgaccggtgctcgatttagtgtcgtcgcaagagaggaggggaccaacaaccacacccctcctaacgaagaagccctagaccacagctcacaccactggactggacctggaggatcctcttctggtggcagcagcacagtgccatccaggtgcagctggtgacaatcnggtactgagttgaagagtcctggggcctcgagtgaacggttctcgcaagtccttctggactacaccttanacttaaggccttatggcttangcctattcgggtncgacgacggccctaggacgtaacggcttgaagtggaactgggactggatcgataacagctaggaaccaaggntcgctacgggacttcaacgcgggttaacgtttcgcttntacccgtggactaccgtctacgtnacgtctaagggcctaattacggtctcggttacaaggtanacgaccgttanagcccgttaagagggtccctaaggacggttacacgttcgtcgtacggtattaaccgtggtacgtacggttagaagtcgtattaccgtaggttgtaacgtaggacgttaggtttatctagtaacg

SEQ ID NO: 118610 - DNA, 748 bp, Homo sapiens
  misc_feature: GYAE6OF02GJ82W.34.21.B10.1.454.CMB.1.raw
tcagtacacgtgatcacgaccggtgctcgattttagtgtcgtcgcaagagggagaggggacccaacaaccacacccctcctaagaagaagcccctagaccacagctccacaccatggactggacctggaggatcctcttcttggtggcagcagcaacaggtcgcccacgtcccaggtcgcagctggtgcaatcgtgggtctgagttagaagacgccgtcggggcctcgaggtgtaacgtttcctgctaacgtccttgtaggactactccttacactagctatgtactatgctagtttgggcgacgacgaccggtaccccgtaggaaccggaacgggtcttacggaggtaggaggttagggagttaggaactacccgaaacctacccgaaaccgtacggtaaccggggaaaccctaacggtacgtaccgacccggtaggtacctacgacgtacgggttacgttttcgtccttccttcgttacggacctaccgtcgtacgtccacggtaccacggctaacgttactccgtagaccgtaacgtacctacgaacgtaccggtaaccgttaccgttaacggtccggtaacgtaccgggaaccggttaaccgtaccgttaccgggtaccgtttacggttaaacttccggttaggtaccggaacggtacggtaaacggttctttaaacgttcgtaacggttaaggtaacgttaaggttaacggttttaggtaactttacgtacgggtttaaccgg

SEQ ID NO: 118611 - DNA, 835 bp, Homo sapiens
  misc_feature: GYAE6OF02IQ1F9.34.21.B10.1.454.CMB.1.raw
  modified_base (238)..(238): a, c, t, g, unknown or other
  misc_feature (238)..(238): n is a, c, g, or t
tcagtacacgtgatcacgaccggtgctcgatttagtgtcgtcgcaagagaggaggggacccaacaaccacacccctcctaagaagaagcccctagaccacagctccacaccatggactggacctggaggatcctcttcttggtggcagcagcaacaggtgcccactcccaggtgcagctggtgcaatcgtgggtctgagttgaagaacgccgtggggcctcgagtgtaacggtttccngacaagtccttcgtaggactaccaccttcactagctatgctagtcgctagttggggtgaccgacgaccgggtcccccgtagggaaccgaaacgggggttcctttagggaacgggttagggacggttgggggaagttacgggtaacttaccgaaaaccgaaaccccgaaaacgtaaccggttaaacgggggaaaaccccctaaacgggttaacgtaccggtacccccgggtaagggggttacccctttaccggaaaccggtaacgggggtttaccgggttttttacgttcccgtttttacccggtttacccgtttacgggtacccttaacccgtttcccgttacgggttaccacgggttacccgaaccgggtaccttaacggttacttccggtacggaaccgttaacgtaaccgtttaccgaacgtaccgtaacggttaacccttaagggtaccgtcgttaagggacgtaccgtaccggttcgtaccggttagttaactttacggtacgtacggtacggtaacgggtacgttaactttagttaactagtaagttaggtaagttaaggttttacgtttaatttacggtaagttaacggg

SEQ ID NO: 118612 - DNA, 670 bp, Homo sapiens
  misc_feature: GYAE6OF02GQIWE.34.21.B10.1.454.CMB.1.raw
  modified_base (47)..(47): a, c, t, g, unknown or other
  misc_feature (47)..(47): n is a, c, g, or t
  modified_base (185)..(185): a, c, t, g, unknown or other
  misc_feature (185)..(185): n is a, c, g, or t
  modified_base (298)..(298): a, c, t, g, unknown or other
  misc_feature (298)..(298): n is a, c, g, or t
  modified_base (330)..(330): a, c, t, g, unknown or other
  misc_feature (330)..(330): n is a, c, g, or t
  modified_base (506)..(506): a, c, t, g, unknown or other
  misc_feature (506)..(506): n is a, c, g, or t
tcagtacacgtgatcacgaccggtgctcgatttagtgtcgtcgcaanagagagggggacccaacaaccacacccctcctaagaagaagcccctagaccacagctccacaccatggactggacctggaggatcctcttcttggtggcagcagcaacaggtgcccactcccgaggtgcagcgtggtncaatcgtgggtctgtagttagaaaggaagccgtggggcctcgagtgtaacggtttcctgccaacgtccttcgtggataccgtaccttcactagtctatgctatgctagttggngcgagccggcccgtaggacgagggtcttaggngtggtaggtgggagtaggactacgaaccgaccaaacgtaccggtaccgggaaaccctacgtaacgtccggacccgtaggtccttacgaacgtacggttaccggtttcgtccgttcttccgttacggacctccgtcgtcgactacggacacggtactacttagtcccgtgacgtacncgtacgcgtacgacgtaccttaagtcggacgtaggtaaccgcgtagtccgttacgttacgtaacgttcgttggtacgacggtaggtacggttactttaacgttaacgtagttaggtaagtttaacggttaaggttacgttttaagttaacttacggttaacggg

SEQ ID NO: 118613 - DNA, 772 bp, Homo sapiens
  misc_feature: GYAE6OF02HPMRC.34.21.B10.1.454.CMB.1.raw
  modified_base (369)..(369): a, c, t, g, unknown or other
  misc_feature (369)..(369): n is a, c, g, or t
  modified_base (542)..(542): a, c, t, g, unknown or other
  misc_feature (542)..(542): n is a, c, g, or t
tcagtacacgtgatcacgaccggtgctcgatttagtgtcgtcgcaagagaggacggggacccaacaaccaccacccctcctaagaagaacgcccctagaccacagctccacaccatggactggacctggaggatcctcttcttgggtggcagcagcaaacaggtcgccccacctcccgaggtcgcagcgtggtcgcaatcgtgggtctagtagttgaagaagccggtggggcctcgaggttagtaacggttttcctgacaacgtccttgtaggactacctaccttacacgtacgcttatcgactagtgctagttggggtcacgtacgaccggcccgtaggaacgagggtcttgggaggtgtagtgggtntggataccgaacaccaacgacggtaaccggaaaccctacgtacgtccggaccgtagggtaccttaaccgacggttaacggggttccgtttacggttcctttccgttaccggtcggtaaccctccgttcgttacgacgtcgaccgacgtctagtactcgtgacttacgactacncgacgtactaccgtaaggtcggtaactacgggaacgtaccgtaccgttccggtaccggtttacttaacggtttacggtaccgggtcgggtaaccgggtaacggttaaccgggttaaccttttaaaccgttaccggtttaagaaaggggttttaaccggttaaaaggggtttaaccggggttttttaaacgttttaaggttttaacccggttaaggttttaacccgggggg

SEQ ID NO: 118614 - DNA, 514 bp, Homo sapiens
  misc_feature: GYAE6OF01DWXA4.39.87.H10.1.454.CMB.1.raw
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (407)..(407): a, c, t, g, unknown or other
  misc_feature (407)..(407): n is a, c, g, or t
  modified_base (502)..(502): a, c, t, g, unknown or other
  misc_feature (502)..(502): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcagagacctggacaaagttcctaagctcctgatcaatgctgcgtccgccttacaatcaggtctccgtctcggttcaggtgcagcggatcgtggacagtatttcnctctcacntcagcagcctgcagcctgaggtatttggaactttntactgtacaagtacttattagtagtcgtccctagaaccgttcggaccgaaagggaccgtagggtagaaactacgaaacgtacgtgtacggactanccacgtgttccg

SEQ ID NO: 118615 - DNA, 509 bp, Homo sapiens
  misc_feature: GYAE6OF01CPOOA.39.87.H10.1.454.CMB.1.raw
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
  modified_base (470)..(470): a, c, t, g, unknown or other
  misc_feature (470)..(470): n is a, c, g, or t
  modified_base (485)..(485): a, c, t, g, unknown or other
  misc_feature (485)..(485): n is a, c, g, or t
  modified_base (500)..(500): a, c, t, g, unknown or other
  misc_feature (500)..(500): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaaatgatttagcctggtatcagcagaaaccagggaaaactcctaaggtcctgatctatgatgctccagtttggaaagtggggtcccatcaaggttcagcgcagtggatcgtggacagtatttcactcncacatcacagcctgcggtcctgtaaagnttttgactaactttatactgtacaactaattttattcttatccgcttcactttcggacggtaggaaccaaggtgganatacgaaaacgatgnggctgactacatctntcttgtacc

SEQ ID NO: 118616 - DNA, 787 bp, Homo sapiens
  misc_feature: GYAE6OF01CQR4G.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcacctcacgacgtctatatgcactggttgcgacacggcccctggacaagggcttgagtggagtgggatgggatacgaaacgggtaacaggtcgggtactacgaactaaaatttacgtgactaacgtaaggttaaaggttttcgaagggggtacctaagggggttacccaaccgtaagttacggaacccggaacgggggaaccctaaccgggtacccgaaagttaaccaaaacgttaaccgaaacggtacccctttaacgaacgttaacggggtaaactacgggaacggaccggtaacggggtacccggtaagggtaaacggtaaccttaccggttaacgggaaacccgggtaacccggtaaccccgggggtaccccggtttaagggtttaaacgtttttaacgggtttcggggttaaccgggtaaccgggtaaacgggtaaagggtaacggtttacgggtaaaccggttttaacccgtttaccccgtttttaccgttaaaccgggtttaacgggtttttaaaccggggggggg

SEQ ID NO: 118617 - DNA, 520 bp, Homo sapiens
  misc_feature: GYAE6OF01A1V89.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaaatgatttagcctggtatcagcagaaaccagggaaaactcctaaggtcctgatctatgatgcctcagttggaagtgggtccatcaaggtcagcgcagtgatcgtggacagatttcactctcaccatcacagcctgcgcctgaagtatttgactaacttattactgtactaactaatttaattcttaactccgtacttactacgtttcggacggtacgggacctagggtgaagtatacgaaacggtaatggtaggccttgactaccattcgtcgttcttctac

SEQ ID NO: 118618 - DNA, 746 bp, Homo sapiens
  misc_feature: GYAE6OF01B4714.39.87.H10.1.454.CMB.1.raw
tcagtcgcactagtcacgaccggtgctcgatttagcagtactgcgttgggtttgggggagtcacgacccactcaggacacagcatggacatggacgggtccccgctcagctccgtggggcttctgctgctctggcctcccaggtgccagatgtgccatccagttcgacccagtcctccactccctccctgtctgcatctgtaggagacagagtcaccatctacttggccgggacaagtcgagggctaaattaaaaatgtaatttacgccgtaggtatcagacaacgaaaaccgaagggtaaaacctccgtaaggtcctagtatctatgatcgtcctcctaggtttaggaaacggtcgggtaccatacgtaacggttcacggcggacgaggtggacgtcggtagggactaggtactttcacgttctaccacctactcccaacccgtacgtcccgttacgggcccggtaccgtaaggtaaacgtttacgttttacggaacccttaaaccttttaacgtttaccgttacgttaaacccttaaaactttaaacttttttaacgttccttttaaccgttcccgtacctttaaccgtacccggttttaccggggaccggggtaacgggtaacccgtaaaggggttacgggaacgtaacgtaacccggtaaaacggtaccgttagggtacggtaccgttaacggacccctaaccgtacgttaccgtttacggttaccctttccgttaaccccg

SEQ ID NO: 118619 - DNA, 734 bp, Homo sapiens
  misc_feature: GYAE6OF01DL2FF.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccggcaagtcaggcaattaaaaatgatttagcctggtatcagacaagaaaccaggaaactcgtaaggtcctagatctatgatcgcctcgtagtttaggaaacggtcgggtacccagtacgaacggttcgaggcggctaaggtggaatcgtagggaactaggtactttccgactcctaccaacccattaccaacctaacgtccctcgggacccggtccttaaggtaaacgttacgtttttacgaccttaaacgtttatttaaccgttagttaacctaaaactttaaactttttaaacttttaccgtttaaccttaccccggttaccgtttacccgtaaccggttttttacccggggaaccgggttaacggggtaaacccggttaaaggggttacgggaacggttaaacgtaaacccggttaaaaacgggtaaacggtttacgggtaccgggtaccgttacgggaacccctaaccccgttaaatttcccggtttacgtttcccgtttcgtttaacccgg

SEQ ID NO: 118620 - DNA, 540 bp, Homo sapiens
  misc_feature: GYAE6OF01EQWG8.39.87.H10.1.454.CMB.1.raw
  modified_base (494)..(494): a, c, t, g, unknown or other
  misc_feature (494)..(494): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcaagaaaccagggaaactcctaaggtcctgatctatgatgcctcagtttggaagtgggtaccagtcaaggttcagcggcagtggatcgtgggactagtatttcactctacacctatccaccacgtcctcggcggtcctagaagttattttgactaactttattactgtactaacttaatttaacttcttactccgtcttactacgtttcggacggtacggaccgaagggtgganaagtacgaaacgtagtggtcgctgacctaccgatctcgtctgtacc

SEQ ID NO: 118621 - DNA, 538 bp, Homo sapiens
  misc_feature: GYAE6OF01D4UKR.39.87.H10.1.454.CMB.1.raw
  modified_base (397)..(397): a, c, t, g, unknown or other
  misc_feature (397)..(397): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcaagaaaccagggaaaactcctaaggtcctgatctatgatgcctctagtttggaagtgggtccatcaaggttcagcggcaggtggatcgtgggacagtatttcactctcaccatccaccagcctgcggcctgaagtnttttgactaactttattactgtactaacttaattttaattcttaactcccgtcttacctacgtttcgggacgggtacgggaacctaagggtggaagatacgaaaacgtactggtcggctgccacctattctcgttctctac

SEQ ID NO: 118622 - DNA, 496 bp, Homo sapiens
  misc_feature: GYAE6OF01ET5LF.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatgggatcgaacggtaacagtggtctcacaaattatgcacagtaagtttcagggcagggtcaccatgacagggacacgtcatcaatacagcctacatgaactgagcaggctgagatctgacgacgacggccgtgtattagtgtgcgagagatgtacgtactattctatgttacggg

SEQ ID NO: 118623 - DNA, 586 bp, Homo sapiens
  misc_feature: GYAE6OF01DTSMX.39.87.H10.1.454.CMB.1.raw
  modified_base (411)..(411): a, c, t, g, unknown or other
  misc_feature (411)..(411): n is a, c, g, or t
  modified_base (448)..(448): a, c, t, g, unknown or other
  misc_feature (448)..(448): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttggccgggacaagtcagggcaattaaaaatgtaatttagcctaggtatcagacaagaaaccaagggaaaactccgtaaaggtcctagattctatgatcgccttaccgtaggtttaggaaaggtcggggtaccccagtacaagggttcaaggcggacgaggtggatcgtagggacagtattcactctacaccatcacncgctgcgctagtaagtatttgacttaacttattactntacaacttaattttaatcttactccgacttactacgtttcgggacggtacgggaacctaagggttacggaagtaagtaccgaaaacgtacgttggtacggacgtacgactaccgtattccttacgttccttctacccg

SEQ ID NO: 118624 - DNA, 548 bp, Homo sapiens
  misc_feature: GYAE6OF01BUX5I.39.87.H10.1.454.CMB.1.raw
tcagtcgcactagtcacgaccggtgctcgatttagcagtactgcgttgggtttgggggagtcagacccactcaggacatagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggcaattaaaatgattagcctggtatcagcagaaaccaggaaactctaaggtcctgatctatgatcgcctcctagtttggaaagtcgggtccagtcgaaggttcagcggcagtgactcgtaggacagactttcactctacaccatccaccagcctgcgtctagaagtatttagactaacttactacgtgtactaactaatttaacttctaactccgtctaccgtacgtttcggacgggtacggacgtaaggtcggaacagtacgaaacgtagtacggttggacttacgaccgtacctagttcttacggtccttcgtaccc

SEQ ID NO: 118625 - DNA, 511 bp, Homo sapiens
  misc_feature: GYAE6OF01DGD0V.39.87.H10.1.454.CMB.1.raw
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (494)..(494): a, c, t, g, unknown or other
  misc_feature (494)..(494): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaacggtacagtggtctnacaaattngcacagaagtttcagggcagggtcaccatgaccagggacacgtccaatcaatacacgacctagatacggaactgacgcgaggctagagctcgtagacgacgacggtccgtagttattagtgtgacgagagatagacttactntttactagtgttacggg

SEQ ID NO: 118626 - DNA, 617 bp, Homo sapiens
  misc_feature: GYAE6OF01AOV24.39.87.H10.1.454.CMB.1.raw
  modified_base (197)..(197): a, c, t, g, unknown or other
  misc_feature (197)..(197): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacgttggccgggacaagtcgagggactaaattaaaatgtatttagcctaggtatcagcaagaaaccagggaaacctcctaaggtcctagactctatgatcgcctactagtttaggaaaggtcgggtaccctagtcgaaggttcaggcggtacgaggtgagttcgtagggactagtatttccactcgtacactactccaccgtacgcccgtcggacccggtcgtaggaagttcttttcggacctaaacgtttacttacgtagtaactaacttaaattttacttcttaactcccgtacttaccgtacgtttccgggacggacgggtaaccgaagggttaggaacgtaactaacgtaaacgtagtaggtcggactacggacctaccgtataccttcgtcttcgtacccg

SEQ ID NO: 118627 - DNA, 494 bp, Homo sapiens
  misc_feature: GYAE6OF01BNE93.39.87.H10.1.454.CMB.1.raw
  modified_base (479)..(479): a, c, t, g, unknown or other
  misc_feature (479)..(479): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaacggtaacagtggtctcacaaattatgcacagaagtttcgagggcagggtcacatgaccagggacacgtcatcaatacagcctacatggaactgagcaggctagagatctgacgacacggccgtgtattagtgtgcgagagatgattactnttcttatgttcgggg

SEQ ID NO: 118628 - DNA, 636 bp, Homo sapiens
  misc_feature: GYAE6OF01DY91I.39.87.H10.1.454.CMB.1.raw
  modified_base (393)..(393): a, c, t, g, unknown or other
  misc_feature (393)..(393): n is a, c, g, or t
  modified_base (585)..(585): a, c, t, g, unknown or other
  misc_feature (585)..(585): n is a, c, g, or t
  modified_base (629)..(629): a, c, t, g, unknown or other
  misc_feature (629)..(629): n is a, c, g, or t
tcagtcgcactagtcacgaccggtgctcgatttagcagtactgcgttgggtttgggggagtcagacccactcaggacacagcatggacatgagggtccccgctcagctcctggggtcttctgctgctcgtggcctcccgaggtcgccagatggtcgccatccagttccgaccctagtcctccatccctcccgtgtctgcatctggtaggacgacagagtccaccatctacttcggcccggacaagtcgaggactaaattaaaatgtattacgccgtggtactcagacaaacgaaaccgaaggtaaacctaccgtaaggtcctagattactagtgtatcgcctacgtaggtttaggaaaggtcgggtacccagtacgtaaggttcaggcgacgnggtaggactcggtacggaacagtacttcgaacttctaacacctatcacgacgacgacctgccgacgtcctagtagttgttactttcgacttaactttattacctacgacctaaattaagttaattaagttagtttaacttacgtaactttacgtttcggaccggtaagggaaccctaggtaccgtaggtaanacgtaaccgaaaacgtacgttaggtcggtactagaacctacgtnttacccg

SEQ ID NO: 118629 - DNA, 549 bp, Homo sapiens
  misc_feature: GYAE6OF01A2KI0.39.87.H10.1.454.CMB.1.raw
  modified_base (339)..(339): a, c, t, g, unknown or other
  misc_feature (339)..(339): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacgaaggcttgagtggatgggatggatcgaacggtaacnggtggtctacaactaaattatgacacaagtaagtttcgagggtcgaggggtccaaccgtatacgaccgaagggacacgtaccatacaagtaccagtacctacagtacggaactagagacgaggctaggagacgtctagacgacgacggacgttagtatttagtcgtagcggagacgtagacgtagtacttgttacttacgtgttacgggg

SEQ ID NO: 118630 - DNA, 673 bp, Homo sapiens
  misc_feature: GYAE6OF01DYORO.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctgggaggatcctcttcttggtggcagcagccacaggagcccactcccaggtgcagctggtgcaggtccgggactggaggtgaagagcgtggggcctgagtgaaggtctccgtgcgaaggcttcgtggaactccaccctcaccgacgtctatatgcacgtggttcgcgacgacggcccgtaggacgaagggtcttaggaggtggagtgggagtagggatacgaacggtaacgaggttacggtactacaaagtaaattagtacgactaaacgaacggttaaaggtttaccggaagggtacgtaacggggtaccgaaccgtaaggtacggaaccggaacggggaacaccggtaccaacgtacaaacgttaacgaacgtacccgttaagaacgtacggtaacgtagggaacgacggaaggtcgtagggagtaacgttacgtacgaaccggacgtaccggtacggttagtaatttacggtgttaggacgtaaggaagtagtacggtaacgttacgttaccgtttacgttaacgttgggtttaacggggg

SEQ ID NO: 118631 - DNA, 511 bp, Homo sapiens
  misc_feature: GYAE6OF01D6Y4R.39.87.H10.1.454.CMB.1.raw
  modified_base (355)..(355): a, c, t, g, unknown or other
  misc_feature (355)..(355): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggatcaccctcaccgacgtctatatgcactggttgcgacacggcccctggacaagggcttgagtggatgggatggatcgaacggtacagtggtctacacaaattangcacagaagtttcgagggcagggtcaccagtcgacagggacacgtacatcaatacacgcctacagtggaactgagcgaggctagagatctgacgacacggccgttgtattagtggtgacggagagatagtagttactctttcgtagtgttacgggg

SEQ ID NO: 118632 - DNA, 535 bp, Homo sapiens
  misc_feature: GYAE6OF01EF2L2.39.87.H10.1.454.CMB.1.raw
  modified_base (362)..(362): a, c, t, g, unknown or other
  misc_feature (362)..(362): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctggacaagggcttgagtggatgggatggatacgaacggtaacaggtggtctacaacaaattangcagtagaagtttcagggcagggtcacatgaccgaggacacggtcatacaatacacgacctacagtacggaactgacgcgaggctagacgtatcgtagacgacgacgggtccgtagttacgttagttggacggcgaggagagtaggtacgttacttcttcgtacgttaacggg

SEQ ID NO: 118633 - DNA, 517 bp, Homo sapiens
  misc_feature: GYAE6OF01BA8KC.39.87.H10.1.454.CMB.1.raw
  modified_base (392)..(392): a, c, t, g, unknown or other
  misc_feature (392)..(392): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcagaaaccagggaaaactcctaaggtcctgatctatgatgcctctagtttggaaagtgggtccatcaaggttcagcggcagtggatcgtggacagtatttcactctcacatcaccagcctgcgcctgaagtntttgactaacttattactgtactaactaattttaattcttatccgtacttctaccgtttcggacggtacgggacctaagggtggagtatacgaaacgatggtgctgaccacatctgttcttctac

SEQ ID NO: 118634 - DNA, 576 bp, Homo sapiens
  misc_feature: GYAE6OF01EQSN1.39.87.H10.1.454.CMB.1.raw
  modified_base (197)..(197): a, c, t, g, unknown or other
  misc_feature (197)..(197): n is a, c, g, or t
  modified_base (532)..(532): a, c, t, g, unknown or other
  misc_feature (532)..(532): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtagganacagagtcaccatcacttgccggcaagtcagggacaattaaaaatgtatttagcctggtatcagcaagaaaccaggaaaactccgtaaggtcctagatctatgatcgcctcgtagtttaggaaggtcgggtacccatcgaaggttcagcggcgagtggatcgtaggactagtattcgactctacacctatccaccgagtcccgtggcccggtacctaggtaacgttacttttacgaacttaaacgtttacttacgtagttaacctaaactttaattttaacttcttaactccgtacttacgtacgtttcgggacggtacggtaccgagggtgaanatacgaaacgtgtggtcgctagacctactatcctgttctgtacc

SEQ ID NO: 118635 - DNA, 541 bp, Homo sapiens
  misc_feature: GYAE6OF01D8BPO.39.87.H10.1.454.CMB.1.raw
  modified_base (344)..(344): a, c, t, g, unknown or other
  misc_feature (344)..(344): n is a, c, g, or t
tcagtcgcactagtcacgaccggtgctcgatttagcagtactgcgttggggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatccacttggccgggcaagtcagggcaattaaaaatgatttagcctggtatcagacaagaaaccagggaaaactccgtaaggtcctgatctatgatcgcctctagttaggaagtgggtccatcaggttcagcggnaggtgatcgtggactagtactttcactctacaccatccaccagcctgcggacctagaagttatttcgactaactttattacttagtactaaactaatttaacttacttactccgtctactacgtttcggacggaggaccgaaggtcggaagactacgaaacgtagtggtcggctgacctacattctgttcttctacc

SEQ ID NO: 118636 - DNA, 606 bp, Homo sapiens
  misc_feature: GYAE6OF01BK74U.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaatgatttagcctggtatcagcaagaacaggaaactcctaaggtcctagatctatgatcgcctctagtttaggaaaggtcgggtcccagtacgaaggttcaggcggcgaggtggactcgtagggactagtatttacactctacacctataccaccacgccgtcggaccggtacctaggtaaacgttacttttacggaccttaaactttaactttactagttactaaacttaattttaacttacctttaactcccgtacttaccgtaccgttttaccgggacgggtaacgggaaccgtaggggtacggagtaactaacgaaaccgtagtggtcggtctacgacctacgtcttacgtcgttcctcttaccg

SEQ ID NO: 118637 - DNA, 591 bp, Homo sapiens
  misc_feature: GYAE6OF01D5GH0.39.87.H10.1.454.CMB.1.raw
  modified_base (252)..(252): a, c, t, g, unknown or other
  misc_feature (252)..(252): n is a, c, g, or t
  modified_base (362)..(362): a, c, t, g, unknown or other
  misc_feature (362)..(362): n is a, c, g, or t
  modified_base (435)..(435): a, c, t, g, unknown or other
  misc_feature (435)..(435): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtagaagaacgccgtggggcctcgagtgaaggtctctgcaggcttgnggaatcaccctcaccgacgtctatatgcacgtggttcgcgacgacggcccgtggacgaagggtcttaggagtggagtgggatgggatacgaaacggtaacaggtgtctanaactaaattatcgactaagagtaagttcgagggtacacggggtacacgtatacgaccgaagggacacgtacanacaatacgagacctagagtcggaactgacgacgaggcgtagagtactcgacggacgaccgacgggtaccgttaggttaacttagttcggtaggacggtaaggtaggtagttaggtacgttaccttctttaacggtacgtttagggtttaccggggg

SEQ ID NO: 118638 - DNA, 876 bp, Homo sapiens
  misc_feature: GYAE6OF01AJQ39.39.87.H10.1.454.CMB.1.raw
tcagtcgcactagtcacgaccggtgctcgatttagcagtactgcggttggggtttgggggagtcagacccactcaggacacagcatggacatgagggtccccgctcagctcctggggcttctgctgctctggctcccaggtcgccagatgtgccatccagttcgacccagtctccatccctcctgtctgcatctgtaggagacagagtcaccatctacgttcggccgggactaaggtcgaaggggtactaaagtttaaaaaacgtcgtaagtttaacgtaccgttagggtaacctaccaacggaccaaacggtaaaaaccccgtaaggggtaaaaaaccttacccgttaaacgggttacccgttaggtaaacttaccgttaacgttcggtaacgttccgggtaccccttaccggttaagggtttttacggggaaaacgggtttccgggggttacccctaagttaccggtaaacgggtttaccgacggtccggggaccgtacggttacggggtaccttaccggtacggggtaacctacggttacgttttacccgacctttacccgtaccgtaaccctagttaacccaacccgtaccggtacccgttcgggacccgggttacccttaagggtaaacgtttacgttttacgaaccctttaaacgtttaacgtttaacgttccgttaaacgtaaactttaaacttttaacctttaccgtttaacgttaccccgtacgttaccgttaccggttttaccggggaccgggtacggggtaaacccgtaagggtcggtaaacgtaaccgttaaccgaaaaccggtaccgtagggttaccgaccgtacgtacctaaccgtacttaccgtcttcccgttcttacccg

SEQ ID NO: 118639 - DNA, 674 bp, Homo sapiens
  misc_feature: GYAE6OF01D0VXB.39.87.H10.1.454.CMB.1.raw
  modified_base (223)..(223): a, c, t, g, unknown or other
  misc_feature (223)..(223): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctggtaggagacagagtcaccatcacttggccggnaagtcagggctaattaaaatgtatttagccgtaggtatcagacaagaaaccgaagggtaaaacctaccgtaaggtcctagacttcgtaatgatcgccttaccgtaggtttacggaaggttcggggtacccagttccgtaagggttcaggtcggacgtaggtagtagtacggtgggaactaggtactttcgacttctaccacctactcctaaccgacgtccgtacggccggtacctaggtaacgttactttacgaaccttaaactttacgttaactagttaactaaactttaattttaactttcctttaacgcccgttaccttacgttaccggtttcgggaccgggtaagggtaacccgtaagggtacgaacgtaaacgtacccgaaacgtaccggttggtcggtaccctgaccccgtactaacgttcctttacggtttctacccttaccgg

SEQ ID NO: 118640 - DNA, 526 bp, Homo sapiens
  misc_feature: GYAE6OF01B1NVT.39.87.H10.1.454.CMB.1.raw
  modified_base (506)..(506): a, c, t, g, unknown or other
  misc_feature (506)..(506): n is a, c, g, or t
  modified_base (517)..(517): a, c, t, g, unknown or other
  misc_feature (517)..(517): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccgggcaagtcagggcaattaaaatgattagcctggtatcagcagaaacaggaaactcctaaggtcctagatctatgatgcctcctagtttaggaaagtcgggtcccagtcaaggttcagcggcagtggagtcgtggactagtactttcactctcaccatccaccagcctgccggcctagaagttatttacgacttaacttattactgtactaattaattttaacttcttactccgtacttcgtacgtttcggacggacggtacgaggtgatacgtacgaacgtatggngctgcactatntctctctac

SEQ ID NO: 118641 - DNA, 702 bp, Homo sapiens
  misc_feature: GYAE6OF01EAVUE.39.87.H10.1.454.CMB.1.raw
  modified_base (309)..(310): a, c, t, g, unknown or other
  misc_feature (309)..(310): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctggtaggagacagagtcaccatcacgttcgccgggacaagtcgagggactaaagttaaaaatgtaatttagcctaggtatcagacaagaaacgaggaaactcgtaagtcctagatctannatcgctcgagtttaggaacgtcgggtaccagtacgtaaggttcaggcgacgtaggtggtactcggtacggaacgtagtactttcacttctaccgaacctactaccgtaccacgtcccgtacggcccggtaccttaggtaagtttacttttacggaccttaaactttacgtttacgttacgtaaccttaaaacttaacgttttaactttactttaacccttacccggtacctttacccgttaaccggttttccggggaaccgggttaacggggtaacccgtaaaggggtcggtaaacggtaaacgtaaccggttaaaaccgtaggttacggtacgggttactaccggacccgtaaaccgttacgttaccggttcgtttccctccgttaacccg

SEQ ID NO: 118642 - DNA, 634 bp, Homo sapiens
  misc_feature: GYAE6OF01EKZJI.39.87.H10.1.454.CMB.1.raw
  modified_base (361)..(361): a, c, t, g, unknown or other
  misc_feature (361)..(361): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtccaccatcacttcggccggacaagtcgagggactaaattaaaaatgtatttaacgccttaggtactcgagaccaagaaaaccgaagggaaaactccgtaagtcctagatctatgatcgcctcgtagttaggaagtcggtccatcgtaagtcagcggnaggtgatcgtaggactagtatttccacttcacaccactaccaccgacgtcccgtagcccggtacctagtaacgttatttcgaaccttaactttacttacgttacgttaacctaaactttaactttttaacgttacctttaactcccgttaccttacgttaccgttcgggtaccggacgggtaacgaacgggttaggaacgtaacgtaaccgaaacggtacgttcggtcggactacgaccgtaccgtacttccgttcgtaccttcggtaacccc

SEQ ID NO: 118643 - DNA, 650 bp, Homo sapiens
  misc_feature: GYAE6OF01BVPTU.39.87.H10.1.454.CMB.1.raw
  modified_base (352)..(352): a, c, t, g, unknown or other
  misc_feature (352)..(352): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctgagtgaaggtctcctgcaaggcttgtggaatcacctcaccgacgtctatatgctacgtggttgcgacgacggccccgtggacgaagggtcttaggacgtggagtgggagtggatacgaacggtaacngtggtctacaactaaattagtgacaacgtagtaagtttcgagggtacgagggtacacgtagtacgaaccgtagggaacctacggtaccaactacgaactacgacgtaccgtaacgacgtacggaactaggaacgacgtaacgggtacctagggtaacgtacgttaccggtacggaaccggaaccggtaccgggtacccgttaggtttaaacgtttacggttaggtcgggtaacggtaggtaacgtaggttacggtaagttaccttacgtttacttaacggttagggtttaacgggggg

SEQ ID NO: 118644 - DNA, 686 bp, Homo sapiens
  misc_feature: GYAE6OF01BV8NT.39.87.H10.1.454.CMB.1.raw
  modified_base (225)..(225): a, c, t, g, unknown or other
  misc_feature (225)..(225): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagcctggggcctnagtgaaggtctcctgcaaggctctggaatcaccctcaccgacgtctatatcgctacgtggttcgcgacgacggccccgtggacgaagggtcttggaaggtgggagtgggatggaatacgaaacggtacaggtggtactacgtaactaaattatcgaacacgtaaggtaaggtttaccgaggggccgtaaggggtaccaaccgtagtacggaccgaacggggtacctaaccgtaccgtaaactacgtaaacgtaccgaacgtacccgtagaaacgtacgggaactacgggaacggtacaacgggtacgtaagggaacgtaacgtaccgtacgaaccggtaaccggtacgggttacccgttaggttaacgtttaagttcgggagtacgggtaaagtaccggttaagtacggttaacgtttacccttacttttaacgttaaacggtttaggtttaaccgggggg

SEQ ID NO: 118645 - DNA, 621 bp, Homo sapiens
  misc_feature: GYAE6OF01BL6E4.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcaagaaaccaggaaactcctaaggtcctgatactatgatgcctcgagtttggaagtcgggtccatcgaaggttcagcggacagtggatcgtggacagtatttcactctacacctatccaaccgacgtcccgtaggcccggtacctaggtaacgtactttttacgacttaaacctttactttaactacgttaactaaacttaaattttaactttcgtttaacttcccgtacttaccgttacgtttcgggacgggtacgggtaaccaagggtacggaacgtaacgtaaccgtaaaaccggtacgttacgggtcggaccgttaggacctaaccgtatttcccgtagtttcccgttcgtaacccg

SEQ ID NO: 118646 - DNA, 582 bp, Homo sapiens
  misc_feature: GYAE6OF01BF6F7.39.87.H10.1.454.CMB.1.raw
  modified_base (288)..(288): a, c, t, g, unknown or other
  misc_feature (288)..(288): n is a, c, g, or t
  modified_base (409)..(409): a, c, t, g, unknown or other
  misc_feature (409)..(409): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcgagtgaacggtcccctgccgaggcttctggatacatcttcagcgcctattatatacactgggtncgccaggcccctggacaagggcctgagtggatgggatgtatcaaccccgagagtggcgacgacaaaatatagcacagagatttcgagggcgaggtccacagtgacgtcggacacgtaccanacaaacagcctacataggaattcgaagtagacgttagaacgtcccaaacgacgaaccggtccgttacgtaacctttcgtagtcgggtacgaaggtacgggacgtaggtaacggttacccgtaacggtagggggtaacgttaaagggttcgaaccgggttaaattttaaccggg

SEQ ID NO: 118647 - DNA, 570 bp, Homo sapiens
  misc_feature: GYAE6OF01BUPHR.39.87.H10.1.454.CMB.1.raw
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcaagaaaccagggaaactcctaaggtcctgatctatgatcgcctcctagtttggaaagtcgggtccatcgaaggttcaggcggcaggtggatcgtggacagtatttcactctcacctatccaccagcctggccggtactaggaagttnttttcgacttaaactttnttacgtgttactaaacttaattttaactttccttaactccgtacttacgtaccgtttcgggacgggtacgggaaccgtagggtggaacgtactaacgaaacgtagtggtggacctcgacctacctattcctcgttccttctacc

SEQ ID NO: 118648 - DNA, 773 bp, Homo sapiens
  misc_feature: GYAE6OF01CMN5O.39.87.H10.1.454.CMB.1.raw
tcagtcgcactagtcacgaccggtgctcgatttagcagtactgcgttgggtttgggggagtcagacccactcaggacacagcatggacatgagggtcccccgctcagctcctggggcttctgctgctctggctcccaggtgccagatgtgccatccagttgacccagtctccatccctccctgtctgcatctgtaggagacagagtcacatcacttggccgggcaagtcgagggactaattaaaaatgtatttagcctaggtatcagacaacgaaacgaacgggaaactaccgtaacggtcctagtaattctatagatcgtacctaccgtaaggtttagggaaacggttcggggtacccaagtacgtaacggttacgaggccgggtacgtaggtggtaacgtcggtagggtactaacgtacgtttaccacgttccgtaccacctacttacccgaacccgtacggtaccccgtacggaccccggtaccttaagggtaaaccgtttagtttttacgaacccttaaagttttaaccttaacgtttacggttaaaccctaaattttaaaccgtttttaacttttaccctttaacgttccccgttaaccgtttcccgttaaccggttttaccggggaaccggggtaacggggtaaacccgttaaaggggttacgggtaaacgtaaaccggtaaccgtaaaaaccgggttacttacgggtaccggtaccgtaacggtacccaacccgttattcccgtttactttccgttaccttacccg

SEQ ID NO: 118649 - DNA, 742 bp, Homo sapiens
  misc_feature: GYAE6OF01EY7RO.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccgaggtgccagatgtgccatccagttcgacccagtctccatccctcctgtctgcatctggtaggagacagagtccaccatccacgttcggcccgggactaaggtccgagggactaaagtttaaaaatgtactttagccgttaggtaatcgagacgaacgaaaccgaagggtaaaacctccgttaaggtcctaggacttactagtgtactcgtcccttacgtaggtttacggaacggtcgggtaccctagtaccgtaaggttacgacggtcggacgtaggtcggtagttccgtagggactacgtactttaccgacttccgtacctaacctacgtacccaccgtacgtccgtacgggcccgtaccgtaggaacgtttacttttaccgaacttaaacgtttactttaccgtacgttaacccttaaacttaattttaaccgttctttaacccgtccgtacttaccggtttaacgtttccggggaacggaccgggtaacggtaagggtacgggtaaacgtaaccgtaaacggtaaaccggttaggtacggttccgggtacctacggtaaccctaaccgtttactacccgtttcgttaccctcccggtttaccc

SEQ ID NO: 118650 - DNA, 755 bp, Homo sapiens
  misc_feature: GYAE6OF01CHKBR.39.87.H10.1.454.CMB.1.raw
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (252)..(252): a, c, t, g, unknown or other
  misc_feature (252)..(252): n is a, c, g, or t
  modified_base (275)..(275): a, c, t, g, unknown or other
  misc_feature (275)..(275): n is a, c, g, or t
tcagtcgcactagtcacgaccggtgctcgatttagcagtactgcgttgggtttgggggcatcacccagcaaccacatctgtcctctagagaactcccctgagcggctccgttccacgaccatggactggacctggagatcctcttcgttggtggcagcacgcccaacgaggacgccccacctcccaggtgcagctggngcacggccgggatggaggngaagacgccgtgggcctgagtaggaacgtcctcgngcaaggtcttcgaggaacctccncctaccgacgtacttacacttagcgtaccgtcggttaggtccgaccgtaaccggcccgtacccgtaagggaaccgaggttcgtaggtggagggaggtggtacgaggttaaccgaacccggttaaacggaaagttgggttaccgattaacctaaaagtaaattcggaacgtaaccaaagttaaaggttaggttacccgggaggttagggtaacccggtactaacggacgaacgtaaccggaaaccgggaccaaccgggttactaaaccggaaacgttaaccctaaacggtaacccgaccgtaaattacccggaaggtaccaaggggtaacctacggagggtccttaaaacgggtacgtacgtacgaaccgaacgccggttacggtacgttaacgttaggtacggtacggtaggaggaaacgtacgtagttaccgttacttaacgtttacgttaacggttaacggttacgggttaaacgggg

SEQ ID NO: 118651 - DNA, 649 bp, Homo sapiens
  misc_feature: GYAE6OF01C5SKE.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagaagccgtggggcctcgagtgaaggtcctcctgacgaaggtcttctggaactccaccctccgaccgtacgtctatacgtgacctacgtggttcgccgaacacggcccccgtagggaaccaacgggtctttggaggtgggagtgggactggactacggtaaaccggtaacacggtggttaccaacgtaaaccgtaaaatttcgacgtacgaaacgtaggttaaacggtttcgaaggggccgtaacggggtaccaaccgtagtaccgaaccgaacgggacctaacgtacccaagtacaaactacgacgtaccctacgtagtaggaactagacgtacgaggactagaacgtattcgaggaacgactacgggtaccgtgttaattacgtgggtagacaggtagacgttgtaagtaccttacttacgtagttgttaacggggg

SEQ ID NO: 118652 - DNA, 634 bp, Homo sapiens
  misc_feature: GYAE6OF01CQWMT.39.87.H10.1.454.CMB.1.raw
  modified_base (251)..(251): a, c, t, g, unknown or other
  misc_feature (251)..(251): n is a, c, g, or t
  modified_base (343)..(343): a, c, t, g, unknown or other
  misc_feature (343)..(343): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcgagtgaaggtctccgtgcaggcttcgnggatcaccctcaccgacgtctatatgcactggtgcgacacggccctaggacaagggcttcggagtggacgtgggatggaatcgaacggtaanaggtgtactcaactaaattactgactacgagtaagtttcgagggtacagggtacactagtacgacgaggaccacgtacatacaactacagccctaacagtaggaaccttggacgtacgacggtaccgtacggtagtacgttcgtacggacgtaaccgaccgggttaccgtaggtttaacgtttacgttacggtaccggtacgggttaaacgaacgggtaacgtttacgggtaacgttttaacccgttcccgtttttaaccgtaaacggtttcgggttttaaaccggggggg

SEQ ID NO: 118653 - DNA, 548 bp, Homo sapiens
  misc_feature: GYAE6OF01BQ1G3.39.87.H10.1.454.CMB.1.raw
  modified_base (436)..(436): a, c, t, g, unknown or other
  misc_feature (436)..(436): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaccctcaccgacgtctatatgcactggttgcgacacggccctggacgaagggcttgagtggagtgggatggatcgaacggtaacaggtggtctacacaaattagtgacacagtaagtttcgagggcgacgggtcaaccgagtacgaccgagggaccacgtccaatacaatacacgcctanataggaactgagcaggctaggatactcgtagaccgacgcggtccgttgtaacgtttgtggtgacgaggagtagtacgtacgttacttactttacgttagtaggtttacgggg

SEQ ID NO: 118654 - DNA, 882 bp, Homo sapiens
  misc_feature: GYAE6OF01EDHKD.39.87.H10.1.454.CMB.1.raw
tcagtcgcactagtcacgaccggtgctcgatttagcagtactgcgttgggtttgggggcatcacccagcaaccacatctgtcctctagagaatccccctgagagctccgttcctccaccatggactggacctggaggatcctcttcttggtggcagcagccacaggacgcccactcccaggtgcagctggtgcacgtccgggactggaggtgaagaagccgtggggcctcagtgaaggtctcctgacaggtcttcgaggaactccaccctccgacccgtacgtctatatcgacctagttgggttcgccggtaaccgaccgggtcccccgtaggggaaccgtaaacggggtcctttagggacgggttagggaaggttgggggtaacttagggtaaccgtaccggtaaaacggggttaacgagggtttacgggttaccttaaccgaaactaaaattttacgcgtaaccaacggtaaacggttaaacgtttacgaaacgggtaccgtaacggggttacccaaaccgttacgtaccggaacccggaaggggtaacccctaaccgggttaccctaaacgtaaccgtaaaccgttaaccgaaccgtaccccgttaaacgaggttaaccggtaaacgtaccgggtaacggacccggtaacgggttacgtaacgggtaacggtaccgtttacccggtaacgggtaacccggtacccgggtaaccccggggttaccgggttttaaaccgttaaaggtttttaaccggggtttccggtaaggggtaaacccggtaagggtaaaacggttacgggttaaaccgttacggttttaaaccggttttacccgtttttaacgttaaaccgggtttacgggtttttaaacgggggggg

SEQ ID NO: 118655 - DNA, 584 bp, Homo sapiens
  misc_feature: GYAE6OF01DRLJ7.39.87.H10.1.454.CMB.1.raw
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
  modified_base (488)..(488): a, c, t, g, unknown or other
  misc_feature (488)..(488): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagccccactcccaggtgcagctggtgcaggtccgggactgaggtgaagaagccgtgggcctcgagtgaggtctctgcaggcttctaggaactcaccctcgaccgacgtctatatcgactacgttggttcgacgacgacggccccgtaggaacgaaggggtcttggaggtggagtgggatgggactacgaacggtaacgnggttacgtctacgaactaaattntacgacacgtaagtaagttacgagggtacgacgggtacaccgagtacgaaccgagggtacctacgtaccatacaatacacgtactacgagtagaactggacncgagcgtagtagactcgtagaccgacgaccgtgttattaattgtggtgacggtagagtatacggtacttactactttactaggttaggttacgggg

SEQ ID NO: 118656 - DNA, 679 bp, Homo sapiens
  misc_feature: GYAE6OF01AUMZO.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccgggcaagtcgagggctaattaaaatgtatttagcctggtatcagacaagaaaccagggaaactccgtaaggtcctgatctatgatcgcctcctaggtttaggaaaggtcgggtacccagtacgaaggttcaggccggacgaggtaggactcgtagggactagtactttcactcgtaccacctctaccaccacgtccgtcggccggtacctaggtaacgttagttttacgaccttaaactttactttactacgttaacctaaacttaaactttttaacttaccgtttaaccttcccgtactttaccgttaacccggttttaccggggacccgggtaacgggtaaccggtaaggggttacggaaacgtaacgttaacccggaaaacgggttaccgtagggttaccggtacgttaccggaccgtaccgtacgttaccgttcgttcccctttacgttaaccccg

SEQ ID NO: 118657 - DNA, 522 bp, Homo sapiens
  misc_feature: GYAE6OF01DUR2O.39.87.H10.1.454.CMB.1.raw
  modified_base (372)..(372): a, c, t, g, unknown or other
  misc_feature (372)..(372): n is a, c, g, or t
  modified_base (498)..(498): a, c, t, g, unknown or other
  misc_feature (498)..(498): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccggcaagtcagggcataaatatgattagcctggtatcagcagaaacaggaaactcgtaaggtcctgatctatgatcgcctccagtttaggaagtgggtcccagtcagttcagcgcagtggatcgtggactagtacttcactctcaccatccacngctgcgctagactatttgactaacttattactgtactaacttaatttaacgttcttactccgtcttacctacgtttccggcggtaacggaccgtaaggtggagtataacgtaaacgagtggtacgntacgacacctattctgttcttacc

SEQ ID NO: 118658 - DNA, 801 bp, Homo sapiens
  misc_feature: GYAE6OF01BBOPX.39.87.H10.1.454.CMB.1.raw
  modified_base (264)..(264): a, c, t, g, unknown or other
  misc_feature (264)..(264): n is a, c, g, or t
  modified_base (584)..(584): a, c, t, g, unknown or other
  misc_feature (584)..(584): n is a, c, g, or t
tcagtcgcactagtcacgaccggtgctcgatttagcagtactgcgttgggtttgggggtaggtcgagacccactcaggacacagcatggacatgagggtccccgcgtccagcctccgtcggggccttcgtgctggcctcgtcggcctcccgacgggtcgcccgagtacgtggttcggccctaactcccgtaggttccgacccctacgtcctccctacttcccctcccttcggtctcgactacgttcgttcggtaagggacacgnggaactccacctactcacgttcggcccggataagtcggacgggactaaagtttaaaacgtgtaacgtttacggtaccgtaggtacgtacaacggtacgaacggaaaaccggtaacgggaaaaccgttaccgtaaacggttaccgtcgtaacttactaacgtagttacgacgtaccctaccggtaagtttacgggaacggttacgggttaccaagttacgtaacgttacgtacggaccgagtacggggtagtactacgggtacgacggttaacgtaccgtttaccgtactaactcctaaccgagttacccgacggtaaccnccggtacgtaccggtaccgttacggaacgttacgttacgtaacgttactaagtttaccctgtaaccttaacgttaactttaactttacccttataccccgtcttaaccgtccgttacggacccgggtacggaaccgttaggacggtaagtaaccgaggtaaccgttactcgggttgaccggttccaagtacccgtattacgtcgttacttccgtacc

SEQ ID NO: 118659 - DNA, 725 bp, Homo sapiens
  misc_feature: GYAE6OF01AQGUH.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgccccactcccgaggtgcagctggtgcaggtccggactggaggtagaagaagccgtggggcctcgaggtgaacggtcctccgtggacgaaggtcttcgtaggaactcccgaccctccgacccgtacgtctatagtgcctacgtggttcgcgaccgaccggccccgtaggaacgagggtcttgggaggtggggagggaggtatcgtattcgtacgttagttaggttacgaacctaccgtagtttcggttacgtaccgaacgttaacgtacgacgtaacgaaggtaaccggttaccggaaggtaccgaacggtacgtaccgtaacggtaacgttacccggacgggtaaccgtaaacgttccgtaacggacgacccgtaaacgtaccgtacccgtaacgacggtcgggaccgtacgtaacggaaggtaaccgttcgaagtaacgtaccgtacgacggtaaccggaaccggtcccgggtaccgtttccgttagtttcggtcggtacggtaacggtaagggtacgggtacgggtacggtaacgttaccgtaaccggttaacggg

SEQ ID NO: 118660 - DNA, 520 bp, Homo sapiens
  misc_feature: GYAE6OF01EXK5I.39.87.H10.1.454.CMB.1.raw
  modified_base (290)..(290): a, c, t, g, unknown or other
  misc_feature (290)..(290): n is a, c, g, or t
  modified_base (349)..(349): a, c, t, g, unknown or other
  misc_feature (349)..(349): n is a, c, g, or t
  modified_base (484)..(484): a, c, t, g, unknown or other
  misc_feature (484)..(484): n is a, c, g, or t
  modified_base (506)..(506): a, c, t, g, unknown or other
  misc_feature (506)..(506): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacnggcccctggacaagggcttgagtggatgggatggatacgaaggtaacagtggtctcaanaaattatgacacagtaagtttcgagggcagggtcacgatcgacgagggacacgtccatacaatacagcctaacagtaggaactgacgcgaggctaggagtactcgtagaccgacgacggtccgtgtattagttgngcggagagatagatactacttntacgtgttacgggg

SEQ ID NO: 118661 - DNA, 757 bp, Homo sapiens
  misc_feature: GYAE6OF01BJR15.39.87.H10.1.454.CMB.1.raw
tcagtcgcactagtcacgaccggtgctcgatttagcagtactgcgttggggtttgggggcatcacccagcaaccacatctgtcctctagagaactcccctgagagctccgttcctcaccatggactggaccgtgggaggactccttctttcgttgggtggcagcacgccacgaggacgccccacctcccgaggtcgcagtcgtggtcgcgacggtccgggactggaggtagaaaggaacggccggtcggggcctacgaggtacggtaacggtcctccgtggacgaacggtcttcgtacggtaactccaccctcgaccgtacgttactatacgtcgactacggttgggttcgaccggaaccggaccgggtccccgtagggaaccggtaagggtcttagggaggtgggaggtgggagtaggtacgtaacggtaaacggtaacgtaggttacgtactacgtaaacgtaaagttacgtacgactaacgtaaggttaacggttacggacgggtacgtaacgggtaccaacggtacggtaccgggaaccggaacgggaaccgtaccgtaccaacgtaaccgtaacgtaaccgacgtaccgtaacgtaaggtaacggtaacgtacggacggacggtacggtacggtacgtaacggtaccgtacggacggaccggaaccggtaccggtacgttagttagttacggtcggagacggtacgtacgtagtacgttacgttacttacgttacgttaggttgggtacggg

SEQ ID NO: 118662 - DNA, 775 bp, Homo sapiens
  misc_feature: GYAE6OF01DTJNU.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctgggcttctgctgctctggctcccaggtgccagatgtgccatccagttgacccagtctccatcctccctgtctgcatctgtaggagacagagtccaccatccacttcgccggcaagtcgagggctaattaaaatgtatttagccgtaggtatcagacaacgaaaccgaaggaaactccgtaaggtcctgatactatgatcgtcctcgtagttttagggaaacgtcgggtaccctagtacgtaaggttacgaggcggacgaggttagggtaagtcggtacggggaacctaggttacttttccgaccttcctacctaaccgtaccttaacccacccgaacgtcccgtacgggccccggtacgtacggtaaagtttacgttttacgtaaccttaaactttaacgtttaaccgttacggttaaaccttaaaacttttaaactttttaaccttttacctttaaccgttccccgttaccgtttacccgtttaaccgggttttccggggaacccggggttaaggggtaacccggttaaaggggttacgggaaacgtaacggttaaaccgtaaaacccggtaacggtttacgggtaacgggttacccgttaggaaccccttaacccggttaacttccccggtttacgtttaccccgtttccgttaacccccgg

SEQ ID NO: 118663 - DNA, 746 bp, Homo sapiens
  misc_feature: GYAE6OF01C7EFP.39.87.H10.1.454.CMB.1.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccgaggtgcagctggtgcaggtccgggactggaggtgaagaacgccgtcgggggcctcgaggtgaacggttcctccgtgacgtaagggtcctttacgtaggtaactcccgaacccttccgaacccggtacgttactaatacgtcggcctacggttgggttacggaccgtaaccgaccgggacccccgttagggaaccggtaacggggtctttagggaaggttagggtaggttggggaagttcgggaacttaccggtaaaaccgggttaacgtagggtttacggtacctaacgtaaacgttaaaagtttacgtacgaccgtaaacgtaaggtttaaacgtttacgggaacgggtacggaacgggttaccaacgtaacgtacggaaacccggagggtaacctacggtaccaacgtacaactacgacgacctagaacgtacggaactcggaacgcggagtacgtaggaacgtactcggtacggaccgtacggacggttaccgtagttacgtttaggtggtactacgggagtacgtagtacggttaacttcgtttacctagttcggttaacggg

SEQ ID NO: 118664 - DNA, 511 bp, Homo sapiens
  misc_feature: GYAE6OF01DPIMC.39.87.H10.1.454.CMB.1.raw
  modified_base (354)..(354): a, c, t, g, unknown or other
  misc_feature (354)..(354): n is a, c, g, or t
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
  modified_base (495)..(495): a, c, t, g, unknown or other
  misc_feature (495)..(495): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggtgcgacaggcccctggacaagggcttgagtggatgggatggatcgaacggtacagtggtctcaactaaattntgacacagtaagtttcagggcagggtcaccatgaccgagggacacgtcaatcaatacacgcctacatcgaactgagcgaggctagagatctggacacgacggtccgtagtattagttgngacgagagngtagtacgtactntttctgttgttagggg

SEQ ID NO: 118665 - DNA, 762 bp, Homo sapiens
  misc_feature: GYAE6OF01D31N8.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcacgccacgaggacgcccacctcccgaggtgcagcgtggtgcgtacggtccgggacgtggaggtagaagacggccggtcgggcctacgaggtaggaacggtcctcgtgacgtaacggtcttcgtacggtaacctcccgaccccttacgaacccggtacgttacctaatacgtcgacgtacggttgggttacgaccggacggacccgggtccccgtacgggaacgtaacgggtcttaggaggtggaggtgggagtggaactaccggtaaacggtacgtaggtcgtactaccgaaagttaagttacgcggaactaacggtaaggttaaggtttaccggagggtccgtaagggtacccaacgtaggtaccggacggtaacgggacctaccggtactaataaccaagtaccgacctaccgtaagaacgtacggaacgtacggacgacggtaggtacgtagaacgttacctacggtacggaaccgtaaccggtcggggttaccttaggttaatttacggtcgggaaccggtacggtaaaggtcgttaaacgttacgggtaaccgtttacttaccggttttaaccttaggggttaggggttttaaaccgggggg

SEQ ID NO: 118666 - DNA, 551 bp, Homo sapiens
  misc_feature: GYAE6OF01A8VFE.39.87.H10.1.454.CMB.1.raw
  modified_base (375)..(375): a, c, t, g, unknown or other
  misc_feature (375)..(375): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaaatgatttagcctggtatcagcagaaaccagggaaaactcctaaggtcctgatctatgatgcctcagtttggaaagtgggtccatcaaggttcagcggcaggtgatcgtggacagatttcactctcaccatccaccncgccctgcggacctgtaagtagttttcgactaacttatttactgtactaactaattttaacttcttaactccgtcttactacgtttacgggccggagggaacctaagggtggaacgacgtacgaaaaccgtaagttggtacggtctcgaccaccgtactcttcgttccttcgtacc

SEQ ID NO: 118667 - DNA, 749 bp, Homo sapiens
  misc_feature: GYAE6OF01EBX3S.39.87.H10.1.454.CMB.1.raw
  modified_base (679)..(679): a, c, t, g, unknown or other
  misc_feature (679)..(679): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggaggtagaagaacgccgtggggcctcgagtgaaggtcctaccgtgacgaaggtcttacgtaggtaactcccacccgtccgacccgtacgttacctaatagtcgacctacgttggttcggaccgaacgcccgggtaccccgtgggaacgaacgggtccttgggacggttggaggtagggagtggtactacgtaaacggtacgtaggttcggtacctacgtaaactaaacgttagcgacctaaagtaacggttaagtttacggacgggtacgtacgggtacctaaccgaggtaccgaaccgggtaacgggtaacccaccgtaccctaacgtacccgtaactaaccgtacctacccgttaaacgacgttacggaaccgtcgtaaggccgtaagggcctagggtaaccgtaacgttcggtaaccggtacccgaaacggtccgggttaaccttaggttaagttttacgtgggttaacggnggtaaacggacggttaaggtaacgttacgtttacccgttactttaacgttcgggttaaggtttacggggg

SEQ ID NO: 118668 - DNA, 681 bp, Homo sapiens
  misc_feature: GYAE6OF01BW8YX.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagacgtcaccatcacgttcgccgggacaagtcgagggacaattaaaaatgtatttacgccttaggtatacagacaacgaaaaccgaagggaaacctccgtaaggtcctgtactctatgatcgcctacgtagtttagggaaggttcgggtaccagtacgaaggttcaggcggacgtaggtggtagtcggtagggaactacgtactttaccgaccttacctaccgtaaccctactacccgaaccgtacgtccccggtacgggcccggtaccgttaggttaaacgtttacgttttaccgaacctttaaacctttagtttaacccttagtaaccttaaacgtttaaactttttaacctttaccgtttaacgttccccgtacttacccgttaccgggttttacccgggacgggtaacggaccgtaaggggtcgaagtaaccgtacgaaacgtagtggtcgactcgacctactatcgtctctctacc

SEQ ID NO: 118669 - DNA, 587 bp, Homo sapiens
  misc_feature: GYAE6OF01BT3OP.39.87.H10.1.454.CMB.1.raw
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (565)..(565): a, c, t, g, unknown or other
  misc_feature (565)..(565): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagagcctggggcctcagtgaggtctcctgcaaggcttcgtggaactcaccctcaccgacgtctatatgctactggttgcgacgacggcccctggacgagggcttggagtggagtgggatggatacgaacggtacaggtgtctacaanaagttncgacaacgagtaagttcgagggacgacgggtacaccgtagtacgaccgtagggacctaccgtacaactacaaacgtacgacgtaccctaacgagtacggaaccgtggacgacgtacggtcgagtacgtaactcggtacgaacgaccggtaccggacgtttagtaagtttcgtcggtagaggagtagtagtagtacttaccttnttaccgttagtgggttacgggg

SEQ ID NO: 118670 - DNA, 724 bp, Homo sapiens
  misc_feature: GYAE6OF01D31E2.39.87.H10.1.454.CMB.1.raw
  modified_base (392)..(392): a, c, t, g, unknown or other
  misc_feature (392)..(392): n is a, c, g, or t
  modified_base (556)..(556): a, c, t, g, unknown or other
  misc_feature (556)..(556): n is a, c, g, or t
  modified_base (576)..(576): a, c, t, g, unknown or other
  misc_feature (576)..(576): n is a, c, g, or t
tcagtcgcactagtcacgaccggtgctcgatttagcagtactgcgttgggtttgggggagtcagacccactcaggacacagcatggacatgagggtccccgctcagctccgtggggcttctgctgctcgtggcctcccgaggtcgccagatgtcgccatccgagttcgaccctagtcctccactccctccctgtctgctattcgtaggtacggacgaacgaggtactaccaacctactcctacgttcgggacccgggtactaacggtcggaagggtaacttaaaagttaaaaagtcgttaacgtttacggccgttagggttacaccgaagaaccgaaaacggaaaaccgtaaacgggtaaaccttcgtaacggtcctagtacgttacttagngtacgtccgtaccttaacggtagggtttacgggaacggttccgggtacctaggtacgtaacggtcgacggtcggacgttaggtcgtacgtacggtacggacttagtaccttcgaactccgtacactactaccgacgcctcgtcggacgttacgaagttacgttntttacgactttaattacgtntacgtaataattactttacgtcttacgccctacgtttacgacgggttcggagggtacctaacgggtaaggttcaaaccgtagttaaaccggacgttagtcgggactccaggaacctaccgttgttaccttccggtactcggttacccc

SEQ ID NO: 118671 - DNA, 835 bp, Homo sapiens
  misc_feature: GYAE6OF01AJCND.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttcgaccctagtcctccactccctcccctgttcctcgtcctacttctaggtaaggagaccaggtacgtccacccgtatacctaccgttcggcccgggactaaggtcgaacggggtactaaaatttaaaaaacgtgtaacgttttacggtacccgttaggttaataccgtaacgtaaccgtaaacggaaaaccccggtaaacggggtaaaaaccccttacccggttaaacgggttacccttaacggtaaccttaccgttaagttacggtaacgtttcccgacccgttttaccggtaaacgggttttaacgggaaaccgggtttaccggggttacccctaacgttaaccggtaacgggttaccggacgggtacggtaacgtacggttacggaagttcgggtaacgggaacgtacgtatttacccgacgttacctccgtaaccctacgtacccgaccctacggtcccgttacggaccgtactaacggtaatttaacgttccgtaacttaacttacgttaccagttaacttaactttaaattttaccgttatttaacccgttcgaacctttccgtaccgttagggaccggtaacgaaccggttaggaccgttaagaacgtaacgtaaccggtatggtccgtacgtccgtaactacctacttaccggctttcctcgttacccc

SEQ ID NO: 118672 - DNA, 727 bp, Homo sapiens
  misc_feature: GYAE6OF01EBTI9.39.87.H10.1.454.CMB.1.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggacgcccactcccaggtgcagcgtggtgcgacggtccgggactggaggtagaagacgccgtgggcctgagtgacggtctccgtgacgagtcttcgaggaactccaccctcaaccgtacgttactatacgtcgactacgtttggttacgaccgaccgtaccgggtcccccgtagggaaccgtaacggggtccgtttagggaggttagggaggttcggggtaagtcgggaactaaccggtaaacggttaacgacgggtttcgttacctacgtaaacgttaaagtttcgtacgacgaacgttaacggttaacggtttcgaacggggtaccgtagggtaccaaccgtaagtaccggaaccgtaagggaccctaacgtactaacctaacgtaacgtaaccgacgtaaccctagtaagtacgaacgtgaacgacgtagtcgtagaacgtgtacggacgaaccggccgtaccgggtccgtttaagttaggtttacgtacgggacggtagggaacgtaggtaagttcggtaacgtttaccctttacgtttacggttacgtttaacggggg

SEQ ID NO: 118673 - DNA, 590 bp, Homo sapiens
  misc_feature: GYAE6OF01CL24H.39.87.H10.1.454.CMB.1.raw
  modified_base (247)..(247): a, c, t, g, unknown or other
  misc_feature (247)..(247): n is a, c, g, or t
  modified_base (274)..(274): a, c, t, g, unknown or other
  misc_feature (274)..(274): n is a, c, g, or t
  modified_base (314)..(314): a, c, t, g, unknown or other
  misc_feature (314)..(314): n is a, c, g, or t
  modified_base (364)..(364): a, c, t, g, unknown or other
  misc_feature (364)..(364): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaggctntggaatcaccctcaccgacgtctatancgctacgtggttgcgacacggcccctggacaagggcttgngtggagtgggactggatcgaacggtacaggtgtctacaactaaatttacngacacagtaacgtttcgagggtacagggtcaacgagtacgaccgagggaccacgtcaatacaactacagtacctagagtagaacgtgaagcgaggcgtagagtactcgtacgacgaaccggtccggtccggttagttagttacgttcgggtacgaccggaagtaacgtagttacggtaacggtttacccttacgttaccgttaacggttaggttttaaccgggggg

SEQ ID NO: 118674 - DNA, 759 bp, Homo sapiens
  misc_feature: GYAE6OF01C76JH.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggactggagatcctcttcttggtggcagcagccacaggacgcccacctcccaggtgcagctggtgcgagtccggatggaggtagaagaagccgtgggcctcagtagaaggtctccgtgacgaaggtcttacgtaggaactccacccgtccgaccgtacgttactaatacttgacctacgttaggttcggaccgtaacgaccggtaccccgtaggaaccggtaacggtacgtttaggaaggttagggtaaggttacggggtaagtagggtaaccgtaacggtaaaccgggtaaacgtagggttacggttactaaccggtaaactaaaaagtttacgtacgtaaccgaaacgttaacggtaaacgttttacggaacgggttaacggtaccggggttaaccaacccgtaaggtaaccggtaacccggaaacgggtacccgtaaaccggtaaccaacgttaaacgaaacttaaccgaaccgttaccctaactaacggttaacgaaccgttaggaacgtacggacggtactaacgggtaactagtaccgtaacggtacgaacggtaccggtaccgtagttactaggttgacggtagaggacgagttacgtacgttacttcgttactagttagttacgggg

SEQ ID NO: 118675 - DNA, 574 bp, Homo sapiens
  misc_feature: GYAE6OF01B9M1Z.39.87.H10.1.454.CMB.1.raw
  modified_base (427)..(427): a, c, t, g, unknown or other
  misc_feature (427)..(427): n is a, c, g, or t
  modified_base (547)..(547): a, c, t, g, unknown or other
  misc_feature (547)..(547): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagtcacaggagcccagtcccaggtgaacttggtgcagtctgggtttgaggtgaagagccgtggggcctcgagtgaacggtcccctgccaggtcttctggatacatcttcagcgcctattatatacactgggtgcgcacggccctggacgaagggcctggagtggagtgggatgtactccgaaccccgagaggtcggcgaacaacaaaatatagcaacagagatttcgagggcgagggtacacgatcgacgtcgggacacgtacatacaaacncgacctacagtagattcgaagtagacgtaggaactaccgaaacgacgtacggccgtacgttacttacgtgtcggacgaggacggctaaggtacgttcccgaggtaggggaacttaacggnggtaacggtaatttcggagttttaggg

SEQ ID NO: 118676 - DNA, 587 bp, Homo sapiens
  misc_feature: GYAE6OF01EJ4FB.39.87.H10.1.454.CMB.1.raw
  modified_base (543)..(543): a, c, t, g, unknown or other
  misc_feature (543)..(543): n is a, c, g, or t
  modified_base (566)..(566): a, c, t, g, unknown or other
  misc_feature (566)..(566): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggagatcctcttcttggtggcagcagccacgaggagcccactcccgaggtgcagctggtgcaggtccgggactggaggtgaagacgccgtgggcctcgagtgacgtctcctgacgagtcttcgtaggactccaccctcgaccgtacgtctaatactgctacgtggttgacgacgaccggcccgtaggacgaacggtcctggagtggacgtgggagtggactcgaacgtacgagtcgtctaacataaactgtcgcacgtagtaagttcgaggtcgaggtaccacgtactacgaccgacgacgtaccgtacatacgaactacgacgtactacgtagacgtaacacgtaacgcaaggtacgtagaacgtacgtacgtacggaccgacgtacggccgttagttagttagttcggtanaggtagacgataggtacttactntttacctagtggtttacgggg

SEQ ID NO: 118677 - DNA, 737 bp, Homo sapiens
  misc_feature: GYAE6OF01CG1T3.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgccccactcccgaggtgcagctggtgcaggtccgggactggaggtaggaagaacggccgtggggcctacgaggtgaaggtcctcctggaccgaaggtccttagtggaactccgaccctcaccgtacgtctatatcgctaggttggttcgacgtaccgaccggtccccgtaggaacggaacgggtcgtttagaggtaggagtggggatagggtaatacggaaccggttaacgtaggtacgtactaccaaataaagttagtagaccgtaaacgtaaggttaacggtttacggaaacggggtaccgtaacgggggttacccaaccggtaacgtaaccgggtaacccggaaacggggtaaccctaccggtaaccgtataaccgaacttaccgaacgtacccttaagaacgtacggtaagtacgaggaccgaaggtcgtaacggagtaccgtcgaccgggacgtaaccggcccggttaacgttgttaaagttcggttagacgggaacggttaggaacgttaggttacgtaacgtttaccgttacgttaccgtttaaggttcggtttaaacgggggg

SEQ ID NO: 118678 - DNA, 661 bp, Homo sapiens
  misc_feature: GYAE6OF01C2PB6.39.87.H10.1.454.CMB.1.raw
  modified_base (250)..(250): a, c, t, g, unknown or other
  misc_feature (250)..(250): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgagtctctgcagtctctagacncaccctcaccgacgtctatatgacacgtggtgaccgacgacggtccccgtaggacgtaagggcttggaggtggagtgggagtggatacgaacggtaacaggtcgtctacaacgtaaattatacgacacgtaaggtaacgtttcgagggcgtacgggtacaccgtagtaccgaaccaacgacgaactaaccgaactacccgacgacggaccgtaccgaccgtaacgaagtccgggaaccgtacgggaacggacgtcccgtagaacgtacgttaccgacggtaccgaccggtacccgggtaccttaggttacttacggtacggtacggacgggtaaggtaacgggtaacggttaacggggttaaaacttttacggttttaccggtaaccgttccggtttaaccccgtttaccg

SEQ ID NO: 118679 - DNA, 742 bp, Homo sapiens
  misc_feature: GYAE6OF01CRSR1.39.87.H10.1.454.CMB.1.raw
  modified_base (218)..(218): a, c, t, g, unknown or other
  misc_feature (218)..(218): n is a, c, g, or t
tcagtcgcactagtcacgaccggtgctcgatttagcagtactgcgttgggtttgggggagtcagacccactcaggacacagcatggacatgagggtccccgctcagctccgtggggcttctgctgctctggctcccaggtgccagatgtgccatccagttcgacccagtcctccactccctccctgtctgctatctagtaggagacagacgtcaactntaccgacgttgaccggacaagtcgaggactaaagttaaaaatgtaacgtttacgccgttaggtactcaacgacaacggaaaccgtaaggtaaacctccgtaaggtcctagtactctaagtgactcgtaccgtacgtaggttaacgggaacggtccggtaccagtaccgtaggttcgacggcggtagtaggtacgtagttacggacgggtaactacggttactttaccgacgttccctaccaaccgtacctaccgtacccgacggtcccgtacggcccgttacgtaattaacgttacttttcggaacttaacctttatacgttaagttaacctaaactttaaatttacttccttaaccgttccgtaccttaccgttaacggttaccgggaacgggtaccggtaacggtaagggtacgtaaagtaaccgtaaaaccggttaaaccgtaggttacggtacggttacccctaagtaccccgttaaactacggtttaccggttccctttacccgtaacttccccccggg

SEQ ID NO: 118680 - DNA, 709 bp, Homo sapiens
  misc_feature: GYAE6OF01D8222.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctgggcttctgctgctctggctcccaggtgccagatgtgccatccagttgacccagtcctccatccctccctgtctgcatctggtaggagacagacgtcaccatcacttcggccgggacaagtcgagggactaaattaaaatgtaatttacgccgttaggtactcgaagacaaacgaaaaccgaaagggtaaaaccctaccgttaaggtccctagtactacgtatgtactcgtccttacgttaggtttaggaaacgggttcgggtaccctagttacgtaacgggttcgacgggtacggacgtaggtaggtacgttcggtagggactaggtactttaccgacttaccgtacctaacctacgttacccgaccgacggtcccgtcgggtaccggtccgtaagtaagtttacgtttacgacttttaaacttacttactacgtaacttaaacttttaatttaactttccttacttccgtccttaccgttacggttaccggacgggtaacgggtaaccgtagggtacgtaaacggtactaaaccggtaaacgtcggtaggtcggtccgtagtaccctacttcttacctttcggttcctaccgttcc

SEQ ID NO: 118681 - DNA, 586 bp, Homo sapiens
  misc_feature: GYAE6OF01CDE1W.39.87.H10.1.454.CMB.1.raw
tcagtcgcactagtcacgaccggtgctcgatttagcagtactgcgttgggtttgggggcatcacccagcaaccacatctgtcctctagagaatccccctgagagctccgttcctcaccatggactggacctggaggatcctcttcttggtggcagcagccacaggagcccactcccaggtgcagctggtgcagtccgggactgaggtgaagagccgtgggcctcagtgaaggtctctgacaggcttcgtggaatccaccctcaccgacgtctatatcgcacgtggtgcgaccgacggcccctggaacgaagggtcttggaggtggtagtgggagtggagtacgaacggtaactaggtggtacctacgaactaaattagtgacagtaagtaagtttcggagggacgtaggggtacctacgaagtcgaacggacgggaacctaaccggtcctaactacgaactaccacgtaccctacgacgtaacggacgtacgacgcgtacggcgtagagtagtcgtacgacgacgcggtacgtgttattgtagtggacgtgacgtagtgtacgtacttagttctagtgttacgggg

SEQ ID NO: 118682 - DNA, 591 bp, Homo sapiens
  misc_feature: GYAE6OF01AGK2O.39.87.H10.1.454.CMB.1.raw
  modified_base (256)..(256): a, c, t, g, unknown or other
  misc_feature (256)..(256): n is a, c, g, or t
  modified_base (385)..(385): a, c, t, g, unknown or other
  misc_feature (385)..(385): n is a, c, g, or t
  modified_base (445)..(445): a, c, t, g, unknown or other
  misc_feature (445)..(445): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaacgccgtggggcctcagtgaacggtctctgacgaggtccttcgnggtaactccaccctcgacccgacgtctatatgctacgtggttcgcgtacgacggccccgtaggaccgaagggtcttggagtggagtgggtatggatcgaacggtaactggtcgtcgtacaataattagngacacgagtaacgttcgagggcgacggtcacgatacgacgacggacacgtcactacgaanaccgagacctacgagtacggtaacgtagacgcgaggtcgagtacgctacgtaccggacgaccgacgggtacgttagttacgttagttcgaggcgtaagagtagtagtaccgttacttaccgttacgttagttacggtttacggggg

SEQ ID NO: 118683 - DNA, 778 bp, Homo sapiens
  misc_feature: GYAE6OF01CTCE5.39.87.H10.1.454.CMB.1.raw
  modified_base (158)..(158): a, c, t, g, unknown or other
  misc_feature (158)..(158): n is a, c, g, or t
tcagtcgcactagtcacgaccggtgctcgatttagcagtactgcgttgggtttgggggagcatcacccagcaaccacatctgtcctctagagaactcccctgagagccttccgttcctcaccagtggactggacctggagtactcctctttcgttggnggcagcacgccacgaggacgcccactcccgaggtcgcaggtcgtggtgcgacggtccgggataggaggtagaacggacggccggtagggtacctagtaggttacggaacggttcccgtccgtaggacgtaacggtcctttacggtaggtaacccttacccgacccttacccgaaccggttaacccgttagttaacgttaacgtacggtaccgtaggtttcgggttacgaccggtaaccgcccgggtccccgtaggaacggtaacgggtcgttaggaggtacgggagtcgggtaacgtgtaacgtaaccggaaacggttacgtagggttaccggttactaaccgaaaacttaaggttagtaacgtactaacggtaaggttaacggttcggacggtacggtacgtaccgaacgagtacgaacggacgaccgtacacgtactacgtaactaacgtaccgtactacgtcgtaaaaaaacgtcgtacgaagaccggtagtacgtacgaacgtacgtaacggacgaccgtaacggtaccggtaccgttagtaacgtttggttagacggtacggaagtacgaagttacggttacgttaacgttacgttagttaccggtttaacgggg

SEQ ID NO: 118684 - DNA, 621 bp, Homo sapiens
  misc_feature: GYAE6OF01BP4TD.39.87.H10.1.454.CMB.1.raw
  modified_base (358)..(358): a, c, t, g, unknown or other
  misc_feature (358)..(358): n is a, c, g, or t
tcagtcgcactagtcacgaccggtgctcgatttagcagtactgcgttgggtttgggggcatcacccagcaaccacatctgtcctctagagaatcccctgagagcctcccgttcctcaccatggactggacctggaggatcctcttcttggtggcagcagccacaggagcccactcccaggtgcagctggtgcaggtccgggactggaggtgaagaagccgtggggcctcgaggtgaacggtcctcctggcaaggcttcgtaggaactccaccctcaccgtacgtctatatgacacttggtgcgacacggcccgtggacgagggcttggagtggagtgggatggatacgaaacggtacnggtgtacacaataaagtcgtagactaacgagtaacgttcggagggacgtaacgggtacaaccgagtccggaaccgacgggaacctaaccgtacaacgtacaactaccaacggacctaagacgtacggaactaggacgacgacggtcgtaagacgtacttccgacggaccggtacgacggtacgttacgttaagtttagtggttagacggtaaggagttagacgtaagttacgtttacccgtagttaccggttggttaacgggg

SEQ ID NO: 118685 - DNA, 598 bp, Homo sapiens
  misc_feature: GYAE6OF01CBW5X.39.87.H10.1.454.CMB.1.raw
  modified_base (295)..(295): a, c, t, g, unknown or other
  misc_feature (295)..(295): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtgcagcagccacaggacgcccactcccaggtgcagctggtgcagtccgggactggaggtgaagaagccgtggggcctcgagtgaggtctccgtgcgagcttcgtaggactccgaccctcgaccgacgttctatactgctacgtggtncgacgacgcccgtgacgaggcttggagtggagtgggatggactacgaacggtaacnggtgtctactactaagttanggacctacgtacgtaaggttacggagggtacgtacgggtaccacgtagtaccggacgaacggtacaaccgtacactacaacgtacacgtcctaagatacgacgtgacgacgacgtacggacgtagtacgtagacggtaaccgtcggaccggttccgtagttacgttaggtcggtagacggttagagttagtcgtacgttacttacgtctttaaggtcggttacgggg

SEQ ID NO: 118686 - DNA, 597 bp, Homo sapiens
  misc_feature: GYAE6OF01BG3Z9.39.87.H10.1.454.CMB.1.raw
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagacgtcaccatccacttgcccgggcaagtcagggcaattaaaaatgtatttagcctggtactcagcaagaaaccaggaaaactccgtaagtcctgactactactgntcgcctactagtttggaagtcgggtaccagtcagttcagcgnagtgagtcgtggactagtatttcacgtctacacataccacgacgtccgtgtaccggctaggtaagtcttttaggaccttaagttactttactagttaccaatttaactttaagttccttaactccgtacctaccttacggttttaccgggacgggtacgggtacccgtaagggttacgagtacgtaaacgaaaccgtacgtaggtcgaccgtagtacccgattccgttaagtcggttccttctaacccg

SEQ ID NO: 118687 - DNA, 647 bp, Homo sapiens
  misc_feature: GYAE6OF01C502V.39.87.H10.1.454.CMB.1.raw
tcagtcgcactagtcacgaccggtgctcgatttagcagtactgcgttgggtttggggcatcacccagcaaccacatctgtcctctagagaatcccctgagagctccgttcctcaccatggactggacctggagatcctcttcttggtggcagcagccacaggagcccactcccaggtgcagctggtgcagtccgggactgaggtgaagagccgtggggcctcaggtgaacggtctctagcaaggtcttcgtaggactccacccgtcacccgacgtctatatcgactacgttggttcgacgaccgacggccccgtaggacgaagggtccttggacgtaggaggtagggattaggactacggtaaacggtaacgtaggttcgtacgtactaacgtaaagtttacacgtacgacgtaacgtaacggtttcgagggtcggtacggtaccaaccgtagttaccggaacgacgggtacctacgtaccaactacgaactacgtacgtacctagtaacgtagaacgtgacgtacgacggtcgtagtacgtacttacgacggacgtaccggtacggtccgttagttattacggttggtgacggtaagtaggtaagtcggtacttacttcgtttaactggtttacggttaacggggg

SEQ ID NO: 118688 - DNA, 636 bp, Homo sapiens
  misc_feature: GYAE6OF01AOVQ3.39.87.H10.1.454.CMB.1.raw
  modified_base (303)..(303): a, c, t, g, unknown or other
  misc_feature (303)..(303): n is a, c, g, or t
  modified_base (592)..(592): a, c, t, g, unknown or other
  misc_feature (592)..(592): n is a, c, g, or t
  modified_base (626)..(626): a, c, t, g, unknown or other
  misc_feature (626)..(626): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatccttcttcttggtggcagcagccacgaggacgccccactcccgaggtcgcagcgtggtgcaggtccgggactggaggtagaagaacgccgtcggggcctcgaggtagaacggttcctccgtgaccgtaaggtcttcgtagaactccaccctcaccgtacgtctatncgctacgttggtcgacgacgaccggtcccgaggacgaggtcgtgaggtgaggtggagtggacgtacgaacggtaatacggtacgtactacgtaaactaaacttcgtacgacaacggtagttaacggttcggaaggaccgtacggtaccaacgtacggtacggaaccggacgggaacctacgtaccgtaactacgaaacgtacgaacctaccgttacgagttaacggacgtacggacgtaccggtacggtacgacgtaacggtactaccgagacgtaccgagtcgtagtntacggtgacaggcgagtcgtagtctactatagtntgggttacgg

SEQ ID NO: 118689 - DNA, 697 bp, Homo sapiens
  misc_feature: GYAE6OF01C3B50.39.87.H10.1.454.CMB.1.raw
  modified_base (106)..(106): a, c, t, g, unknown or other
  misc_feature (106)..(106): n is a, c, g, or t
  modified_base (155)..(155): a, c, t, g, unknown or other
  misc_feature (155)..(155): n is a, c, g, or t
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (478)..(478): a, c, t, g, unknown or other
  misc_feature (478)..(478): n is a, c, g, or t
  modified_base (494)..(494): a, c, t, g, unknown or other
  misc_feature (494)..(494): n is a, c, g, or t
  modified_base (501)..(501): a, c, t, g, unknown or other
  misc_feature (501)..(501): n is a, c, g, or t
  modified_base (508)..(508): a, c, t, g, unknown or other
  misc_feature (508)..(508): n is a, c, g, or t
  modified_base (523)..(523): a, c, t, g, unknown or other
  misc_feature (523)..(523): n is a, c, g, or t
  modified_base (673)..(673): a, c, t, g, unknown or other
  misc_feature (673)..(673): n is a, c, g, or t
tcagtcgcactagtcacgaccggtgctcgatttagcagtactgcggttgggtttgggggagtcacgacccactcaggacacagcatggacatggacgggtccccgntcagctccgtggggtcttctgctgctcgtggcctccgaggtcgccagtntgcgcctatcctagttcgaccctgtccacctctccctccgtagtcncggcctagtacgtaggtacggaacgtaccgaggtctaccactactacctacggtcgggaccggataacggacgtaggtaactaaaagttaaacgngtacttacgcgtaggtanacgaacgtacgaacgtaaacggaacgtaaacctaggttacgtactaagtactttaagcgtacgtacgtacgttaccggttaagggttaaccgtaagggtcccggttacctaagtccgttaaggtcggacgcgtacgagtcggatacggtcacgtgttaacttcncgtacaccgtactacncgtaacncgtccgngtaccgacggttaanacgttcttagaacctttattacctagtacctaagtaactttagttacctaacgtcgaccgttacgtcggttacggtcccggaaggtaaccgggtagtaaaggaccgtagtaaccaaaccgtaaggtccgtggacggtcacgtcctacgtntaccgtgttcctactccttacccg

SEQ ID NO: 118690 - DNA, 746 bp, Homo sapiens
  misc_feature: GYAE6OF01BUAKF.39.87.H10.1.454.CMB.1.raw
  modified_base (715)..(715): a, c, t, g, unknown or other
  misc_feature (715)..(715): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtaggagacagacgtcaccatcacttggccgggcaagtcgagggcaattaaaatgatttacgccttaggtactcagacaaggaaaccgagggaaaacctccgtaaagggtcctaggactacgtatgactcgaccgttaccgtaggtttacgggaaacggttcgggggtacccctaaggttaccgtaacggggttacgtaacgggccgggtacgtaagggttacgggacgttacggttacggggaactaacgggttaacttttcccaaccgttcctacccgtaacctaacgttacccaacccggtacgtacccgtcgggtaccccggtaccgttaaggtaaacgtttacgttttaccggaaccttaaaccgttttactttaaccgttacgtttaaacctaaacgtttaaacttttaacgtttccctttaaccgtcccgtacctttaccgttaccggtttcgggaacgggtacgggtacccgtaagggtacggataacgtaacgtaaacggtaacttggacggcgtanacccgtactagttccgtcgttactctacccg

SEQ ID NO: 118691 - DNA, 707 bp, Homo sapiens
  misc_feature: GYAE6OF01C7OLR.39.87.H10.1.454.CMB.1.raw
  modified_base (148)..(148): a, c, t, g, unknown or other
  misc_feature (148)..(148): n is a, c, g, or t
  modified_base (169)..(169): a, c, t, g, unknown or other
  misc_feature (169)..(169): n is a, c, g, or t
  modified_base (177)..(177): a, c, t, g, unknown or other
  misc_feature (177)..(177): n is a, c, g, or t
  modified_base (204)..(204): a, c, t, g, unknown or other
  misc_feature (204)..(204): n is a, c, g, or t
tcagtcgcactagtcacgaccggtgctcgatttagcagtactgcgttgggtttgggggagtcagacccactcaggacacagcatggacatgacgggtccccgctcagctccgtggggctttctgctgctctggctcccaggtgccagntgtgccatccagttcgacccngtcctccntccctcctgtctgctatcgtgtagganacgagagtccacctatcctacgttcggaccgggactaacggtcgacgggactaaagttaaaatggtatttacgccgttaggtactcgagtacaacggaaaccgaaggtaaacctccgtaagtcctagattctagtcgactcgtacctacgtaggtttagggaaacggttcggtaccctagtacgtaaggttcgagtcggagtacggtgacgttcggaggactacggttacttccacttcctacactaactaccacccggtcgtacccgcggtaccggtaccgtaagtaacgttacgtttacgtaacctttaaacttacttactacgttaacttaactttaacgttttactttacgtaaccttccgttacgtttaccgttaccggttcgggtaacggtacggtaccggtaaggttacggaacgttaaccgtaccgtaaaacggtcgttacggtcgtaccgtacggaccttaaccgtactttaggttacctcgtttacctacccg

SEQ ID NO: 118692 - DNA, 528 bp, Homo sapiens
  misc_feature: GYAE6OF01E47LA.39.87.H10.1.454.CMB.1.raw
tcagtcgcactagtcacgaccggtgctcgatttagcagtactgcgttgggtttgggggagtcagacccactcaggacacagcatggacatgagggtcccccgctcagctcctggggcttctgctgctctggctcccaggtgccagatgtgccatccagttgacccagtctccatcctccctgtctgcatctgtaggagacagagtcaccatcacttgccggcaagtcaggcattaaaatgatttagcctggtatcagcaagaaaccagggaaaactcctaaggtcctagatctatgatgcctcgtagtttggaaacgtgggtcccagtacaaggttcagcggcaggtgagtcgtgggactagtatttcgactctacaccatccaccagcctgcggcctagagtactttgactaacttatactgtactaactatttaattcttatccgcttctacgttcggacgagggaccaaggtgagtaagtcgtaaacgagtcggtgcgtagactaccgattactcttcttcgtac

SEQ ID NO: 118693 - DNA, 572 bp, Homo sapiens
  misc_feature: GYAE6OF01AHNFH.39.87.H10.1.454.CMB.1.raw
  modified_base (370)..(370): a, c, t, g, unknown or other
  misc_feature (370)..(370): n is a, c, g, or t
  modified_base (522)..(522): a, c, t, g, unknown or other
  misc_feature (522)..(522): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggatgaggtgaagagccgtggggcctcagtgaaggtctcctgcaaggcttcgtggaactccaccctcaccgacgtctagtatgcacgtggttgcgacacggcccctggacaagggcttggagtggatgggatgggatacgaacggtaacgacggtcgtctacgaactaaatttngaccataaggtaagtttcgagggctagggtacacagtacgaccgaagggacctacttaccatcaacgtacacgacctacagtacggaactagagccgaggtcctagagtatcgtacgaaccgaccgacggtccgttagttacgttagttggngacggtagacgtatacggtacttacgtacttactacgttaggttacgggg

SEQ ID NO: 118694 - DNA, 705 bp, Homo sapiens
  misc_feature: GYAE6OF01DH9R1.39.87.H10.1.454.CMB.1.raw
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (448)..(448): a, c, t, g, unknown or other
  misc_feature (448)..(448): n is a, c, g, or t
tcagtcgcactagtcacgaccggtgctcgatttagcagtactgcgttgggtttgggggagcatcacccagcaaccacatctgtcctctagagaactcccctgagagcctccgttcctcaccagtggactcggaccgtggaggactccttcttcgttggtcggcagcacggccacgaggacgcccacctcccgaggtcgcaggcgtggtcgacgacggtcccgggatggaggtgaacggacgccggtgggcctcgtaggtaggtacgtcctcgtgacgtaggtctttcgtacgacgttccacccgtacgtaccgtacgttctaactagtcgctacgttggtcgacgacgtccgccgaggacgtaacgggtctaggacgtagggngtaggngtacggtaacgtacggtaaaacggtcgtagggttacgaccgttaacgaaagttaacgtntaccggtacgaaaacgttggtaacttcggggacgggtagtaccggactaaccggtaagccggaacggtacgaccgtacgtaccgtaactacgaacgtacgtccgtaacgaacgacggtacgaaccggtagaccgaaggtaccgagtacgacgtacgtaccgtaacgggacgtacccgggtaacgtcgtttacgttagtcggttaggacgtggaacgttagtacgtacgtacgttcttacgtacgtggtttaacgggg

SEQ ID NO: 118695 - DNA, 761 bp, Homo sapiens
  misc_feature: GYAE6OF01CCLWW.39.87.H10.1.454.CMB.1.raw
  modified_base (304)..(304): a, c, t, g, unknown or other
  misc_feature (304)..(304): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggactcctcttcttggtggcagcagccacaggacgcccactcccaggtgcagcgtggtgcgacggtccgggactggaggtagaaggaacgccggtgggcctcgaggtgaacggtctccgtgcgaaggtcttcgtaggaactccaccctacgaccgtacgtctatacgtnaccgtacggtggttcggaccgaccggaccggtcccccggtagggaaccggtaagggtcttagggaaggtgggtacggtagggtagtacggtactaaaccggtaacggtaacgtaggtacggtacctaacgtaaacgttaaagttacgtacgaaccgtaaacggtaaggtttaacggttacgggacggggtaccgtaacgggtaccaaccgtaggtaccgaaccgggtaacgggacctaccggtaacaaccgtaactaaaccgtacggaacctaccgtaagtacggtaacggtaacgtacgaacggtcgtaacggtcgtagtacgtactacgtaccgaaacggtcccggttaacggtccgttaagttacgtttaggtacgggttaacgccgggtaagtaacgttagggttacgttaaccgtttccgtttaccgttaaccgttaagggttttaccgggg

SEQ ID NO: 118696 - DNA, 673 bp, Homo sapiens
  misc_feature: GYAE6OF01CE59C.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtagaagaagccgtggggcctcgagtgaacggtctccgtgacgaaggtcttcaggactccaccctcgaccgtacgtctaatactgactacgttcggttcgacgtaccgacggtaccccgtggaacgaacgggtctaggagtcggagtgggatggacgtacgaacggtacaggtcgtactacaactaagttagtcgactaagacggttaaggttccggaagggtaccggtagggtaccaaccgtagtaccgaccggaacggggacctaaccggtactaactaactaacgaactacgtaacctacgtaacgtaacgtaacgtagacgacgtaggccgtaagggtatacgtacgtaccgggacgaccggtaccggtacggttagttacgttcggttcggaggacggttagaacggttacgttaggtaacttacccggttactttaacgtcgtttaagggtttaaccggggg

SEQ ID NO: 118697 - DNA, 679 bp, Homo sapiens
  misc_feature: GYAE6OF01BC080.39.87.H10.1.454.CMB.1.raw
  modified_base (289)..(289): a, c, t, g, unknown or other
  misc_feature (289)..(289): n is a, c, g, or t
  modified_base (612)..(612): a, c, t, g, unknown or other
  misc_feature (612)..(612): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagagccgtcgggcctgagtgaacggtctccgtgacaaggtcttcgtaggaactccgaccctccgaccgtacgttctaatntacgctacgttgggttcgacgaccgcggtccccgtaggacgaggtctaggacgtaggagtgggatggataccgaacggtacgtggtacgtactacgaactaaagttcgacgacgtaacgtaaggtacgtttaccggaagggtcgtacgggtccaaccggtagtacggaacggtacggacctaccgtacctaataccgtaactaccgtaacgtacccgtaacgagtaccggtaatacggacgtacggacggtacgtaggaacgtacgttacgacggtaacgaaccggtaccgggttacgttacgtttaacgttaggtttccggngtaacggacgtagtacggttacgtaccgtttacttacccgtttacgttaacgtgggtttaaccgggg

SEQ ID NO: 118698 - DNA, 589 bp, Homo sapiens
  misc_feature: GYAE6OF01CNFHR.39.87.H10.1.454.CMB.1.raw
  modified_base (102)..(102): a, c, t, g, unknown or other
  misc_feature (102)..(102): n is a, c, g, or t
  modified_base (417)..(417): a, c, t, g, unknown or other
  misc_feature (417)..(417): n is a, c, g, or t
tcagtcgcactagtcacgaccggtgctcgatttagcagtactgcgttgggtttgggggagtcagacccactcaggacacagcatggacatgagggtccccgntcagctcctggggcttctgctgctctggctcccaggtgccagatgtgccatccagttgacccagtctccatcctccctgtctgcatctgtaggagacagacgtcaccatcacttgccgggacaagtcagggctaattaaaatgtatttagcctggtatcagcaagaaaccgaggaaactcctaagtcctgatctatgatcgcctccgtagtttacgggaaacgttcgggtccagtcaaggttcaggcgcagtggagtcgtggacagtacttcactcacaccactccgaccacgtccgtggcgtacctaggtaatnttttacgacttaactttacgtactagtactaacttaatttacttaccttactaccgtacttacgtacgtttacgggaccggtagggaacccgtagggttaccggaaagaacgtaaccggaaacgtacggtgtcgggtctcgaccgtacctagtcctcggttctttccgtacc

SEQ ID NO: 118699 - DNA, 557 bp, Homo sapiens
  misc_feature: GYAE6OF01C37RZ.39.87.H10.1.454.CMB.1.raw
  modified_base (182)..(182): a, c, t, g, unknown or other
  misc_feature (182)..(182): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (406)..(406): a, c, t, g, unknown or other
  misc_feature (406)..(406): n is a, c, g, or t
  modified_base (433)..(433): a, c, t, g, unknown or other
  misc_feature (433)..(433): n is a, c, g, or t
  modified_base (510)..(510): a, c, t, g, unknown or other
  misc_feature (510)..(510): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtncagctggtgcagtccgggactgaggtgaagagccgtggggcctcgagtgaaggtctcctgcgaaggtcttcgtaggaactccaccctcaaccgtacgtctaatagtcgctacgttggtcgaccgacacggcccctggacgaagggtcttggagtggagtgggatggatcgaaacggtacagtggtcacaataacttngacanagtagttgaggcgaggtcacgngtcgacgaggacacgtcagtacaatanacgactacgagtcggaactggacgacgaggtctagagtactcgagaccgacgcggtaccttagtaacgtttgtaggngtacggagtagagttacggaattccttacttcgttacgttaacgggg

SEQ ID NO: 118700 - DNA, 697 bp, Homo sapiens
  misc_feature: GYAE6OF01B8OOJ.39.87.H10.1.454.CMB.1.raw
tcagtcgcactagtcacgaccggtgctcgatttagcagtactgcgttgggtttggggggagtcagacccactcaggacacagcatggacatgagggtccccgctcagctcctggggcttctgctgctctggctcccaggtgccagatgtgccatccagttcgacccagtcctccactccctccctgtctgcatcgtagtaggagacagagtccaccatcacgttcggccgggtacaaggtcgagggactaaatttaaaaagtgtaatttacggccgtggttaactcgagacgaaacgaaaccgaacggggtaaaacctaccgtaacggtcctagtactactatagatcgcctacgtaggtttagggaacggttcgggtaccatacgaacggttcgacggcggtacgaggtggtacgtcggaggtactagtactttacacctcctaccaccgactacccaccgtacggtccccgtacgggtccccgggtaccttaggtaaacggttacttttacgaacctttaaacgttttacgttaccttacgtaaaccttaattaaactttttacttacctttaaccgtcctacttaccgttaccggttacgggacgggtacgggaacgtagggtacgacgtaacgtaaccgaacgtagtcggtcggctacggaccctacgtacttccgttcttccttcgtacccg

SEQ ID NO: 118701 - DNA, 792 bp, Homo sapiens
  misc_feature: GYAE6OF01DUXM4.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctgggaggactcctcttcgttggtggcagcacgccacgaggacgcccactcccgaggtgcagtcgtgggtcgcgtacggtccgggacgtggagggtagaaacggacggtccggtcggggtcctagaggtacggacggttcctccgtaggacgtaggtccttcggtacgaaccttacccacccgtaccgtaaccgtacgttacctatacgtcgaccttacggttcgggtacgaccggaccggaccccgggtcccggtaagggaaccggtacggggtcttagggtagggtcgggaaggtacggggtagtacgggtaacgtacggaaacgggtacgtcgggttacggttaccaacgtaaacgttaaagttcgacgactaacggtaaggtttacggttaccggagggtaccgtaacggtacctaacgtacggtaccgacgggtaacgggtacccctaaccggtacctaacgtacaacttaccgaaccgtaccgtacgaggtaacggaacgtcgaacgaccggagtcgtagggtactacgttacgacggaccggtacggtcccggtagttcgttaactttgggtaacggtagaacggtacgtaggttaccgttacggttaccgtttacccttagttttaccggtaacgggtttaggggtttaacggggg

SEQ ID NO: 118702 - DNA, 656 bp, Homo sapiens
  misc_feature: GYAE6OF01BJFTK.39.87.H10.1.454.CMB.1.raw
  modified_base (390)..(390): a, c, t, g, unknown or other
  misc_feature (390)..(390): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacgaggacgcccactcccgaggtcgcagctggtgcgaggtccgggactggaggtagaagagccgtgggcctcgaggtgaacggtctccgtgacgaggtcttcgtaggaactccaccctccaaccgtacgttctaatacgtcgacctacgttcggtacgaccgacgaccgggccccgtaggaaccgtaagggtcgttagacggtggagtgggatggactacgaaacggtacnggtacgtcacgtaaactaaagttcgacgacaacgtaagtaacgtttacggaacgggtcgtacgggtacaccgtacgacgaacgacgggactaccgtactaactaccgaataccgtacgtacgaactagtacgaacgtaggaacgcgaacggtcgtaaggtacgacgtagtacgaaccggccgtaacggtcgttaagtagttagtggtacgtaacggaacgtagtagttaggtacgtttactagtttacgttagttggttaaccggg

SEQ ID NO: 118703 - DNA, 991 bp, Homo sapiens
  misc_feature: GYAE6OF01C76PE.39.87.H10.1.454.CMB.1.raw
  modified_base (145)..(145): a, c, t, g, unknown or other
  misc_feature (145)..(145): n is a, c, g, or t
tcagtcgcactagtcacgaccggtgctcgatttagcagtactgcgttggggtttgggggagtcagacccactcaggacacagcatggacatggacgggtccccgctcagctccgtggggtcttctgctgctcgtcggcctcccgnggtgccagatgtgccatccagttcgaccagtcctccactccctccctgtctgctatcgtaggtacggagacgagacgtccacctactcgtacgttcgggccgggtacaacgggtccgaagggtaacttaaaagtttaaaaacgtgttaacgtttacggaccgttaggttaactaccggagaaccgtaaaacggtaaaaaccggaaaaccgggttaaaacccttaccgtttaaccgggttaccgtacgtaacttacgttaacttcggaaccgttccgtacccgtttacggtaaagggttttacggggaaaccgggtttccgggtaaccgtaacggttaacggtacgggttaccggtaacggcggggtaaccgttaggggttacggtaaccggttacggggtaacggggttaaacttaccggttttaccctttaacccggtcccttaaacccgttaccctaaaccgttacccgaacccggttaccccgtaccggtaccccggttaaccggggtaccccggttaaaccgttaacgggtttaaacggtttaccgtttttaaccgtaaaccctttaaacgtttttaccgttaaaccgtttaatttaaaccctttaaaacgttttttaacgttttacctttaaaccggtttccgttaccccgtttaccggtttaaccgggttaccgggttttacccgggaacgggggttaaaccgggttaccgggttaaacggtaggtaaacccggtaaccggttaaacgtaaaccgggtacggtttacgaccgggttccctaaaccgtacggtttacccgtttaaccgttcgttttcccgtaacccttttccggtaccccg

SEQ ID NO: 118704 - DNA, 593 bp, Homo sapiens
  misc_feature: GYAE6OF01AJ3GB.39.87.H10.1.454.CMB.1.raw
  modified_base (253)..(253): a, c, t, g, unknown or other
  misc_feature (253)..(253): n is a, c, g, or t
  modified_base (279)..(279): a, c, t, g, unknown or other
  misc_feature (279)..(279): n is a, c, g, or t
  modified_base (353)..(353): a, c, t, g, unknown or other
  misc_feature (353)..(353): n is a, c, g, or t
  modified_base (378)..(378): a, c, t, g, unknown or other
  misc_feature (378)..(378): n is a, c, g, or t
  modified_base (537)..(537): a, c, t, g, unknown or other
  misc_feature (537)..(537): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttctggtggccagcagccacaggagcccatcccaggtgcagctggtgcaggtccggactggacggtgaagagccgtcggggcctcgagtgacggtctcctgcaaggcttcgnggaactcaccctcaccgcgtctatangcacggtgttcgcgacgacgcccgtaggacagggtctgacgtggatcgggtatcggactacgaaccggtaacgngtggtttccacgaactaaatttcgnggtaccacgaagtttaaggttcgagggtcgtacgggtccacgtacgtacggtaccgagggtaccacgtacctacgtacaatccgtagtccctaagagtacgaacgtgaacgtgagtcgtgagactcgaagacgacgtacggtctgttagtcgttacggnggtacgaggacgtaaggtcgtaacgttcctagtttcctaaggttccggttaagggg

SEQ ID NO: 118705 - DNA, 680 bp, Homo sapiens
  misc_feature: GYAE6OF01A0DLF.39.87.H10.1.454.CMB.1.raw
  modified_base (380)..(380): a, c, t, g, unknown or other
  misc_feature (380)..(380): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcaggtccgggactggagggtgaagaagccgtggggcctcagtgaaggtctcctgcgaaggcttcgtggaactccaccctcaccgacgtctatatgcacgtggttcgcgacgcggtccccgtggacgaagggtctggagtggagtgggagtggatacgaaaggtaacgtaggtgtctacgaactaagttangacacgaaggtaacgttacgacggggagtacggggtaccaacgtacggtacgtaaccccggaaggggtaacccgtaaccgtaccgtaaacgttaaccaaaccgtaaccgtaaccggtaccccgtaacgtaacgggttacggtaaacgtacgggaacggacgtaacgggtacgtacgggtaacgtacgtacggtacggaaccggtacggtaaccgggtcccgttagttacgttaagtcggtacggacggtaaggacgtagtacggtacgttacgtactttcggtaagttagggttacgggg

SEQ ID NO: 118706 - DNA, 812 bp, Homo sapiens
  misc_feature: GYAE6OF01DATR9.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacgaggacgcccactcccaggtgcagctggtcgcacggtccgggactggaggtagaaagaacgccggtggggccctacgaggtcggaacggttcctcccgtaggaccgtaacggtcctttacgtacggaacttcccgacccctaccgacccgtacgttcttatacgtcgcctacgttgggtcgaccggaccgaccggtaccccgtaggaaccgaacgggtccgtttagggacggtagggtacggtaggggtagtaggtacctaacggtaacggttaacgtagggttcgtactaccgtaaactaaagttacgtacgaaccgtaagtaacggtttaacggtttaccggaacggggtacggtaacggggtacctaacccgtaaggttacccgggaaacccgggtaacggggtaaccccctaaccggttaacccaaacgtttaacccgaaacgtaacccgtaaccggtaacccttaacgtaaggttaccggaaacgtcggaacggccggtacggtaccgttagggaacgttacgttacggaccggtaaccggccgtaaccgggttcgttagttaactttggtcggtaggacgtaaggtaggttactaggttaacctacgtttccgttaaacgttacggttagggttttaaccggggg

SEQ ID NO: 118707 - DNA, 667 bp, Homo sapiens
  misc_feature: GYAE6OF01CBKQC.39.87.H10.1.454.CMB.1.raw
  modified_base (363)..(363): a, c, t, g, unknown or other
  misc_feature (363)..(363): n is a, c, g, or t
  modified_base (404)..(404): a, c, t, g, unknown or other
  misc_feature (404)..(404): n is a, c, g, or t
  modified_base (629)..(629): a, c, t, g, unknown or other
  misc_feature (629)..(629): n is a, c, g, or t
tcagtcgcactagtcacgaccggtgctcgatttagcagtactgcgttgggtttggggagtcagacccactcaggacacagcatggacatgagggtccccgctcagctcctgggcttctgctgctctggctcccaggtgccagatgtgccatccagttgacccagtctccatcctcctgtctgcatctgtagagacagagtcacatcacttcgccggacaagtcgacgggactaattaaaaatgtattttagccttaggtactacagacaacgaaaccgtaaggtaaacctactaaggtcctgtatctatgatgcctacgtagttaggtaacggtggtaccctagtacgaaggttcgaagcggngtagtgagtcgtaggacagtatttccacttacgcctaaccngtacccacccgaagtccccgtagggcccgtactaggttaaacttagttttacaaccgtttaaactttaacggtttaaccctggtttaaacccaaacttttaaaattttacctttaccttttaacgtcccggtacctttaccgttacggttttaacgggaccgggtaaggtaaacccgttagggtaaggtaccgttaaagaaccgtaaaacggtactcgggttacncggttaacacctacgtatgtttcgttactccgttaacc

SEQ ID NO: 118708 - DNA, 799 bp, Homo sapiens
  misc_feature: GYAE6OF01BKPQW.39.87.H10.1.454.CMB.1.raw
  modified_base (771)..(771): a, c, t, g, unknown or other
  misc_feature (771)..(771): n is a, c, g, or t
tcagtcgcactagtcacgaccggtgctcgatttagcagtactgcgttggggtttgggggcatcacccagcaaccacatctgtcctctagagaatcccctgagagcctccgttcctcaccatggactggacctggagatcctcttcttggtggtcagcagccacgaggacgcccactcccgaggtcgcgagtcgtggtgactacggtccgggactggaggtagaagaacgccggtggggccttcgaggtaggaacggtcctccgtgacgtacggtccttgtaggactaccgtaccctaccgaccgtacgttactatactcgaccgtacgttggttcggaccgaccggtccggcccggtacggaacggtacggggttctagggtagggtcgggtaggtgggttagtacgggtacgtaaccggtaaacgggtaactaacggttacggtacctaaaccgtaacttaaaacgtttacgacgttaacgtaacggttaaccggttaacggtttaaccgggaacggggtaccgtaacgggtacccgtaaccggtaacggtaccggaaccgggtaaccgggtaaaccgtaccgttaaccgaacttaacccgttaacggtaaccttacccgtaaccgttaacgtacggtaaacggtaacgtaacggacgtaaccgtagggtaccgaaggtacgtacgtacgtaacggacgttaaccggcggtaggttagtagtttaggtcggtaggtaacgaggtaccgtaaggtacgttacgttacgttntaaccgtttaggttcggtttaacggggg

SEQ ID NO: 118709 - DNA, 633 bp, Homo sapiens
  misc_feature: GYAE6OF01BUM99.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctgggcttctgctgctctggctcccaggtgccagatgtgccatccagttgacccagtctccatcctccctgtctgcatctgtaggagacagagtcaccatcacttggccgggtcaagtcgagggcaagttaaaaatgattagcctggtatcagcaagaaaccgaggaaactcctaaggtcctagactctatgatcgcctcgtagtttagggaaacgtcgggtacccagtacgtaacggttcacggcgtacgaggtgatcgtagggactagtagtttccactcctacgacctatcccacgacgtccttaggcccgtacgttaggaaagttactttcgaacctaacgtttatacgtcgtaactaacgttaaattttaactcgtttaacgtcccgtacgttacgtaaccggtttcgggacgggtaaccggtaacccgtaaggggtccgtaaagtaacctaacgtaaaccggtaagtcgggtacgcgtacctaccgtaacccagtttcctacgttcctaccgttaccg

SEQ ID NO: 118710 - DNA, 848 bp, Homo sapiens
  misc_feature: GYAE6OF01DXVJN.39.87.H10.1.454.CMB.1.raw
tcagtcgcactagtcacgaccggtgctcgatttagcagtactgcgttggggtttgggggagcatcacccagcaaccacatctgtcctctagagaatcccctgagagctcccgttcctcaccatggactggacctggaggactcctcttcttggtggcagcagccacgaggacgccctactcccgagggtcgcagtcgtgggtcgcgacggtccgggactggagggtagaagacggccgtggggcctgagtggtaacggtcctccgtgacgtaaggtcctttcgaggtaaactcccctacccgtacccgaacccgtaacggttacctaagttaacgtcggtacctaacggttttcggggtccgaaccggtaccggtacccggggtcccccgtaaggggtaaaccggtaacggggttcgttaggtagggttggtaaggtcggggtaatacggtaacgtaaacggtaacggtacgtaggttacggttacctacgtaaacgttaaatttagacgtacgtaagtaaggttaaccgtttacgggaacggtcggtaacgggtacccaaccggtaagttcccggaaacgggtaacggtaacccgtaccgttaaaccaaccgttaacgaaacgttaccgaaccgtaccggtaaactaggtacccggtaacgtggaaccgtaccggaaggtctaacggtcggtaactcccggttaaacgggccggtaacccgggtaccgggtttccgggtttaggttaacgttttcggtagggttaccaaaggggttaagtacgttaacggtttggtaaacccggtttacggtttaacccgttaggttttaccgttaaacccgggggg

SEQ ID NO: 118711 - DNA, 861 bp, Homo sapiens
  misc_feature: GYAE6OF01D9ENJ.39.87.H10.1.454.CMB.1.raw
  modified_base (308)..(308): a, c, t, g, unknown or other
  misc_feature (308)..(308): n is a, c, g, or t
  modified_base (567)..(567): a, c, t, g, unknown or other
  misc_feature (567)..(567): n is a, c, g, or t
  modified_base (649)..(649): a, c, t, g, unknown or other
  misc_feature (649)..(649): n is a, c, g, or t
tcagtcgcactagtcacgaccggtgctcgatttagcagtactgcgttgggtttgggggagtcagacccactcaggacacagcatggacagtgacgggtccccgctcgagccttccgtggggtccttcgtgctgccttcgtcggtccttcccgaggtcgccgaaggtactggtcgcctaacttccgtagtttccgacccctagttccctacctacttccctccctgtcctgctatcgtaggacgacgacagtactaccacagtccacgttcggaccggtactaacgcgaaggtaactaaatttaaaagngtaacgttcgtaccgtagtacgtacgaagaccgaaaacgaaccggtaaacggtaaaccctaccgggttaacgtcctaacggttacttaacgtagtacgtacgtacgttacccggttagtttaacgggtttaaagggtaaccggttcggtaccgtaagttacgtaacgggttcgaacgcgggtactacggttaggacctaggtacgggtactagttaccgttcaacgtcctaccgaactacgccgtaccgcgtacccggngtaccctacggtaatttacgtttacggttacctaaccgttttaatttaccgttacgttaaaccttaacttttaaaccgtttntttttaaccgacgttaccggttaccgttcccgtttacgttaaccgggggttccgggaacgggttaaaccgggtacgtaaaggggtacctaaaacggttaaccgtaaaacggtaccggttttaaggtccggttcccggtaaaccgtttacccgaccgttacgtttttaacgtcccccgtttaggttaaccccccttaacggtttaccccccgg

SEQ ID NO: 118712 - DNA, 705 bp, Homo sapiens
  misc_feature: GYAE6OF01CI6H5.39.87.H10.1.454.CMB.1.raw
  modified_base (239)..(239): a, c, t, g, unknown or other
  misc_feature (239)..(239): n is a, c, g, or t
  modified_base (687)..(687): a, c, t, g, unknown or other
  misc_feature (687)..(687): n is a, c, g, or t
tcagtcgcactagtcacgaccggtgctcgatttagcagtactgcgttgggtttgggggagtcagacccactcaggacacagcatggacatgagggtccccgctcagctccgtgggcttctgctgctctcggctcccgaggtcgccagatgtcgccatccgagttcgacccagtcctccactccctccctgtctgcatcgtagtaggagacagacgtccacatctacgtcggaccggganaacgtcgaaggtactaaagttaaaagtgttactttacgccgttaggtactcgacgaccgaaacggaaaccgtaacggtaaacctccgtaacggtcctagtacttcgtagtcgactccgtacctacggtaggttagggtaacggtccggtaccagtacgtaacggttcgacggccggtagtaggtacggtagtacggtacggactagttacttccgaccttcactaccactccaccgacgtccgtgcccggtacgtaaggtaacgttctttacgtaacctttaacttacttaacgttacgttaaactaactttaaagttttaccttaccttaccgtacccgttccgttaccgttaccgggtttaaccggacggggtaacgacggttaaggtacggtaactacgtaaacgtaacgtacgtggtcgtaccgtacgaccgttactacgtttntaccttcttacccgtccc

SEQ ID NO: 118713 - DNA, 896 bp, Homo sapiens
  misc_feature: GYAE6OF01EYVUR.39.87.H10.1.454.CMB.1.raw
tcagtcgcactagtcacgaccggtgctcgatttagcagtactgcgttgggtttgggggcatcacccagcaaccacatctgtcctctagagaactcccctgagagctccgttcctcaccatggactggacctggagactcctcttcgttgggtggcagcacgccacgagggacgcccacctcccgaggtgacgtaggtcgtggtcgcgacgggtaccgggacgtagggacggtaggaacggacggtccgggtacggggtcctacggtaggtacgtaacggttcctcgtcggacgtacgtcgttacgtacggtaactcccgtaccctaccgaccgtacgttactagtacgtcgaccgttacggttcggtacgaccggaccggtaccccggtaccggtacgggaaccgggtaacgggttcggtagggtacgggtagggtagggttacggggtaagttaccgggtaacggttaaaccggaaaccgggttacggttacggggttacgttaaccgtaaacctaaagtttaaacgtttacgtaccggtaaacgttaacggttaaacggttacggttaccgggacggggttaccggttaaccgggtaacctaaccgggtacggaaccggggtaaaccggggtaaccggtacccctaaacccggttactaacggtaaacccgtaaccgttaaaccgggtccctaaacccggtttaagaaccgggtttaaaccgggacggttaaccggacgggtaccggtaagggtccgtaaggtaaccgtccgtaccgtacgggaacccggtaccgtcggttaccggttaattaccgttaggtcgggacgtagggtaagaccggttagtaccggtttactccgtttacgtagtttaacgggttgggttacggggg

SEQ ID NO: 118714 - DNA, 780 bp, Homo sapiens
  misc_feature: GYAE6OF01CPZU2.39.87.H10.1.454.CMB.1.raw
  modified_base (105)..(105): a, c, t, g, unknown or other
  misc_feature (105)..(105): n is a, c, g, or t
  modified_base (351)..(351): a, c, t, g, unknown or other
  misc_feature (351)..(351): n is a, c, g, or t
  modified_base (493)..(493): a, c, t, g, unknown or other
  misc_feature (493)..(493): n is a, c, g, or t
tcagtcgcactagtcacgaccggtgctcgatttagcagtactgcggttggggtttgggggagtcagacccactcaggacacagcatggacatggacgggtccccnctcagctcgtggggcttctgctgctcgtggcctcccgaggtcgccagatgtcgccatccaggttacgaccctagttcctcctacttcccctccccgttgtcctcgtactacttcgtaggtacggaacgaacgaaggtacgttaccaacctacttacgtacggttaccgggacccggggaacgtaaacggttcggaacgggtacttaacttaaccttaaagttttacgttacgtccggtaaggttanaccgagtacaaaccgggaaacggtaagggtaacgtacttaagcccgttcgagtacttctagtctacgtactacctacgtttcccttatacgaaccgtagtaccgggtcccggtctaacgttccggttcgtagcggttacggngacggttggtacttcgggaggtaactgtttacttacccgtctactaccgacctacgtacgacgtacctacgttcgaccgtactaaccggtactaagttaacgtacttacgttaagttacccttttaactttacgtttaactaacggtaaactttaaactccgtaaccgggtacccttaacccggttccccgtaaacccgttcccgggttacccggaccgggtacggaccggttaagtacggtaaccaagttaacgaacggttacgacgtgtaacggtctacgtaccg

SEQ ID NO: 118715 - DNA, 641 bp, Homo sapiens
  misc_feature: GYAE6OF01A7YUT.39.87.H10.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacatgagcccactcccaggtgcagctggtgcaggtccgggactgaggtgaagagccgtgggcctnagtgagtctcctgcaggcttcgngactccaccctcaccgcgtctatatgcactggtcgcgacgaccggcccgaggacgacgggtcttggaggtcggagtgggagtacgggataccggaaacggtaacgaggttcggtacctacgaaactaaagtttctagtaccaacgtaaggttaacgtttcggacgggacgtacgggtacaccgtaagtaccgaaccggacggaaccacggttaccaacgtaccgaaacttaccgacgtaccctagaacgtacgaacctggacgacgaaggtcgtaggacgtatacgacggaacccgacggaccgggttacggttactttaaggtttcgtaggtaccggcgtaaggagttacgttaggtaccgtttacttccctttaacgttaggtttacggggg

SEQ ID NO: 118716 - DNA, 623 bp, Homo sapiens
  misc_feature: GYAE6OF01BDKQ6.39.87.H10.1.454.CMB.1.raw
  modified_base (253)..(253): a, c, t, g, unknown or other
  misc_feature (253)..(253): n is a, c, g, or t
  modified_base (284)..(284): a, c, t, g, unknown or other
  misc_feature (284)..(284): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcgagtccgggactgaggtgaagaagccgtggggcctcgagtgaaggtctcctgcaaggcttcgnggaactccaccctcaccgtcgtactatatancacgtgtgcgacgtcggcccgtacgacggacggacgttgtaggtggtagtgggtagtaggtagtaccgtaacggtaacgtaggtcggtacgtacaacgtaagttactacgacgacgaagtaagttcgaggacggaggtccgtaacgacgtagaccggaacggtaacgtacgtaccgtactacgactaacgtacgacctacgtagtaggtaacgtagacggtcgacggtacgtagtaagactcgacggaccgaccggtacggtacccgtagttacgttaagttggtacgaggtagagtatacggttattacgtacctttagtaaccgttggttaacgggg

SEQ ID NO: 118717 - DNA, 864 bp, Homo sapiens
  misc_feature: GYAE6OF01C85BN.39.87.H10.1.454.CMB.1.raw
tcagtcgcactagtcacgaccggtgctcgatttagcagtactgcgttgggtttggggcatcacccagcaaccacatctgtcctctagagaactcccctgagacgccttccgttcctccaccagtcggactcggacctggaggactccttctttcgttggtgcacgcacgccacgacggaccgccctacgtcccggaggtcgcgacggtcgtgggtcgaccgtacgggttaccggagtggaaggtaggaaaggacggtccgggtacgggtacctacgtaggtacgtaaccggttcctacgtacggaccgtaagttccgttacggtaaccggtaccttaccctaccccggtaacgtacccggtacgttactaacgtgtaccgtaaccggttggtttaccgggtaccggaaccggtaacccgtacccggggttacccggtaaacgggaacgggtaacgggtttccggttagggacgggtttaagggtagggtaaacgggttgaaacgggtttaaccaaaacgggttaacgtaaacggttacggtaaccgtaactaaaccgtaaaacggtttaacttacggacgtaaccgttaaagggtagggtttaaacggtccgggacggttaaccgaccggtaactacggtaccgaacgggtaccgaagggtaacccacgtacgacttaaggaccacgcctaacgtctaacgtaacggtcgataccggagttaacgcgtaaggtacgttacgacggttaacgaccgtacggttaccggttaactagttacggttacgtacgggtagaccggtagttaaacgggtataccggttactttaccgttaagttcgggtttaacgttcggggttaaaggg

SEQ ID NO: 118718 - DNA, 820 bp, Homo sapiens
  misc_feature: GYAE6OF01ERE6H.39.87.H10.1.454.CMB.1.raw
  modified_base (102)..(102): a, c, t, g, unknown or other
  misc_feature (102)..(102): n is a, c, g, or t
  modified_base (145)..(145): a, c, t, g, unknown or other
  misc_feature (145)..(145): n is a, c, g, or t
  modified_base (213)..(213): a, c, t, g, unknown or other
  misc_feature (213)..(213): n is a, c, g, or t
  modified_base (309)..(309): a, c, t, g, unknown or other
  misc_feature (309)..(309): n is a, c, g, or t
tcagtcgcactagtcacgaccggtgctcgatttagcagtactgcgttgggtttgggggagtcagacccactcaggacacagcatggacatgagggtccccgntcagctccgtggggcttctgctgctctggcctcccgagggtcnccagatgtgccatccctagttcgaccctagtcctccactccctccttgtctgcattcgtaggtagganactaggacgtaccacctatacctacgttccgggaccgggactaaggtcgaagggtacctaaaatttaaaagtgtaagtttacgaccgttaggtacnccgtacgaaccgtaaacggaaaaccggtaaacgggtaaacccttacggtaacggtcctaggtacttcgttaacgtacggtactacgtcccgttacggttaggtttaacgggacggttccgggacctaagtacggtaggttcgaggtacggtctaggtagtagtcggaggtaactaggttactttaccacgtacctaacccgtacctacgtacccaaccgtacgtacccgtaccggtacccggttaccgtaacgttaacggtttaccgtttaacgtaaccctttaaacttttacgtaacgttaaccgttaaacgttaaacttttaaacgttttaaccgtttctttaacccgtacccgttaccgtttaccggttaccgggtttaccgggaaccggggttacggtaaaccgtaggggtacgtaaacggttaacctaaaccgggttaaaccgtggttacggtaccggttactacctaccgtacttacgttaccttcggtttaacctcttaccccg

SEQ ID NO: 118719 - DNA, 742 bp, Homo sapiens
  misc_feature: GYAE6OF01EHMMU.39.87.H10.1.454.CMB.1.raw
  modified_base (205)..(205): a, c, t, g, unknown or other
  misc_feature (205)..(205): n is a, c, g, or t
  modified_base (285)..(285): a, c, t, g, unknown or other
  misc_feature (285)..(285): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggcctcccaggtgccagatgtgccatccagttacgaccctagtcctccactccctccctgtctgcatcgtgtagganacgagagtccaccatcctacgttcggccggacaaggtcgaggtactaaattaaaagtgtaatttacgccgttaggtaacnccgaagacctaaacggaaaaccgaacgggtaaaaccttccgttaaacggtcctaggtacttacgtatcgtacttacgcccttacgtaaggtttacgggtaaacggtccgggtaccctaaggttaccgtaacggttacgacggtcggacgttacggtagtacgttacggacggtaacttacggttactttcccaacgtttccacctaacccgtaataccccgtaacccgagtaccccgtacggtcccgtacgttaacgttaaggtttacttttaccgaacttttaacttttacgtcctaacgttaacttaaactttaattttaacgttccttaaccttcccgtactttaccgtaccgggtttacgacgggtaaggacccgttaaggtacggataaacgttaaccggaagtacggttggtccgcaagtcccacgttatccgttcgtacctcgttacccg

SEQ ID NO: 118720 - DNA, 660 bp, Homo sapiens
  misc_feature: GYAE6OF01C1TOW.39.87.H10.1.454.CMB.1.raw
  modified_base (655)..(655): a, c, t, g, unknown or other
  misc_feature (655)..(655): n is a, c, g, or t
tcagtcgcactagtcacgaccggtgctcgatttagcagtactgcgttgggtttgggggagtcagacccactcaggacacagcatggacatgagggtccccgctcagctccgtggggcttctgctgctctggctcccgaggtgccagatgtgcctatccagttcgacccagtctccatccctccctgtctgcatctaggtaggagacagacgtaccaccactctacgttcggaccgggacaaggtcgaagggtactaaattaaaactggtacttagccgttaggtactcgaagaccgaagaaaaccgaaacgggaaaccttaccgtaacggtcctagtatctagtcgactcgaccttacgtaggtttacgggtaaacggtccggggtacctagtacgtaacggttcgacggcggtacgtaggtgacgttcggtaggaactagttacgtttacaccgttcacctacgtaacctccacctacggtcctcggacgtccgtaaggtaacttgtttacgaactttaacttagtcttaacgtaactaactttaacgttttacttacttaccgtccgttactaccgttacggttcggacgggtacgtacgtaggagtacgactaaccgtagtaggtgcgtcacgacaccgtattcgtctcgtntcccg

SEQ ID NO: 118721 - DNA, 753 bp, Homo sapiens
  misc_feature: GYAE6OF01DC3IS.39.87.H10.1.454.CMB.1.raw
  modified_base (705)..(705): a, c, t, g, unknown or other
  misc_feature (705)..(705): n is a, c, g, or t
  modified_base (713)..(713): a, c, t, g, unknown or other
  misc_feature (713)..(713): n is a, c, g, or t
tcagtcgcactagtcacgaccggtgctcgatttagcagtactgcgttgggtttgggggagtcagacccactcaggacacagcatggacatgacgggtccccgctcagctccgtggggtcttcgtgctgcctcgtggcctcccgaggtcgccaggatgtcgccatccagttcgacccagtcctccactccctcctgtctgctatacgtgtagagacagtacgtaccaccatacgtacgttcggacccgggataacggtcgaacgggacttaaaagtttaaaaagtggttaacgttttaacggacccgtttaggtaactacggaacgaaccgaaacggtaaaaccggaaacgggttaaacctaccggttaaacgggtacctacggtattacgtaaccgtaggtaactccggtaccccgttaagttacggttaacgggtaaacggtccgggtaccaacgtttacgaggttacgaacggcgaccggtaggtagtaggtacgtacgggaatacgtacgtttcaccggttacaacccgtaactacgaccgtaccctacgtccgacgggtaccgtccgtaaaggttaacgtttaacttacgaactttaacttataccttagaattaacttattacgtttaccgaacttccgtactccttacggttcggaacggtaggaaccgtaaggtagaccgtaaatacgaaacggttancgggttanacccgtcaacgtactacgttacctgtttcccaggttaccc

SEQ ID NO: 118722 - DNA, 820 bp, Homo sapiens
  misc_feature: GYAE6OF01ACP12.39.87.H10.1.454.CMB.1.raw
  modified_base (103)..(103): a, c, t, g, unknown or other
  misc_feature (103)..(103): n is a, c, g, or t
tcagtcgcactagtcacgaccggtgctcgatttagcagtactgcgttgggtttgggggagtcagacccactcaggacacagcatggacatgagggtcccccgntcagctcctggggcttctgctgctctggctcccaggtgccagatgtgccatccagttcgacccagtcctccatccctccctgtctgctatcgtgtaggagacagacgtcaccatctacgttcggaccgggactaaggtcgaacgggtactaaaagttaaaaagtgtactttacggccgttaggtactcgacgacctaaacggaaaaccgaacgggtaaacctaccgttaaacggtccttaggtaactaccgtatcggtacttaccgtcccgttacggttaacgggttttacggggaaacgggttcccggggtacccctaaggttacccgtaaagggtttccgaacgggtaccgggacgttaacgggtgggtaacgttacggtaccggggaactaaccgggtttaacctttacctaacccgtacccttacccgtaaaccctaccgttaccgaacccgtaaccgggtcccgtacgggtacccgttaacgtaacgggttaaactttacgttttacgtaaccttttaaaccgttaacgtttacgtaactttaaccgtaaacttttaacttttaacttttaccgtaacgttacccgtaccttaccggttacgtttaccggggaccgggttaacggaaccggtaggtaggaacgttacgaaaccgtaacggtacgtacggtcgtccgactaccgtcctacgttactcgtttcctgttaccccg

SEQ ID NO: 118723 - DNA, 953 bp, Homo sapiens
  misc_feature: GYAE6OF01D2HPU.39.87.H10.1.454.CMB.1.raw
tcagtcgcactagtcacgaccggtgctcgatttagcagtactgcgttgggtttgggggcatcacccagcaaccacatctgtcctctagagaactcccctgagagcctccgttcctcaccatggactggacctgggaggtactcctcttcgttggtggcagcagccacgacggacgcccactcccgaggtcgcgagtcgtgggtcgacgtacggtccgggacgtaggagggtagaaaggaacggtccggtacgggggtcctacgtaggtacggtaacggttccgtccgtagacggtaacggtcgttacgtacggtaactacccgaaccccgtaccgtaaccggtaaccgttacttaactacgtcgtaccgtacgttggggttcgaccggtaccggacccgggtacccggtacgggtaacggtaacggggttcgtttacgggacgggttaggggtaacggttaggggtacgttaacgggtaaccgtaaaccgggtaaaccggttaacggtacggggtttaacggtaccctaaccgttaaaacgggtttaaaactttaacggtaccgtaacgtaaacgttaaaacgggtttaacgggtttaacggacgggggtaccggtaacggggttacccaaccggttaaaccggttaaccgggaaccccggggttaaacggggtaaaccccttaacccggtaacccgtaaacgttaaaccctaaacgttaacccggtaaccgttaaccccgttaaggaacggtttaacggtacgtaacgggtaacgaccgggtaacggtacgtacggtaacgttaacgtaacccggtaacgtacccgggaaccgtaccggggtttacgttaacggtttaacgttaggttacggtagggtaacggtaaggtaacgttaggtaacgttaccggtttaccttaagtttacggttacggtttacggggttaacgggg

SEQ ID NO: 118724 - DNA, 779 bp, Homo sapiens
  misc_feature: GYAE6OF01DS2RF.39.87.H10.1.454.CMB.1.raw
  modified_base (312)..(312): a, c, t, g, unknown or other
  misc_feature (312)..(312): n is a, c, g, or t
tcagtcgcactagtcacgaccggtgctcgatttagcagtactgcgttgggtttgggggcatcacccagcaaccacatctgtcctctagagaatcccctgagagcctccgttcctcaccatggactggacctgggaggatccttcttcgttggtggcagcagccacaggacgccccacctcccgaggtgcagcgtggtgcgaggtccgggacgtggaggtagaagaacggccggtggggccctcgaggttaggaacggttcctccgtgacgaacggtcttcgtaggaactccaccctcgaccgacgtctatancgctacgtggttcgaccgaccgaccggtccccgtagggaacggtacgggtcgttggaggtagggtagtgggagtagggaacgtaacgtaaacggtaacgtaggttacggtactaaccgtaaactaaagttacgtagaccaaagtaaggttaaacggttacggaacgggtcggaacgggtaccaaccgtaagtaccgggaacccggaaaggggtaaccctaaaccggtaccctaaacgtaaccgtaaaacgtaacccgaaccgtaaccccgtaacgtaacggtaacgggtaacgaacgggaacgaaccggtacgggtactaagggaacggtacgttaccggtaaccggacccggaaacccggtaccgggttaccgttaagtttaagtttaacgggttgtacggaaggtaacggataacggtagttaccggtttactacgtttaccttaaggttaggggtttaacgggg

SEQ ID NO: 118725 - DNA, 720 bp, Homo sapiens
  misc_feature: GYAE6OF01EMI45.39.87.H10.1.454.CMB.1.raw
  modified_base (674)..(674): a, c, t, g, unknown or other
  misc_feature (674)..(674): n is a, c, g, or t
tcagtcgcactagtcacgaccggtgctcgatttagcagtactgcgttgggtttgggggagcatcacccagcaaccacatctgtcctctagagaactcccctgagagctccgttcctcaccatggactggacctggaggatcctcttcgttggtggcagcacgccacgaggacgcccactcccgaggtcgcagtcgtggtcgcgacggtccgggacgtggaggtagaaagacgtccggtggggcctacgaggtcggtaacggtcctccgtagacgaacggttcttaccgtaggtaacctcccgaccctcgaacccggtacttataactacgtcgtctacgttgggttcgaccggaccgtacccgggtcccgtacgggaacggtaacgggtccgtttaggacgggtagggaggttacggggtaagtacggtaacgttaaccggaaaccgggttaagtacgggttacgggttactaaccgtaaagttaaaacgtttcaacggtactaagtaaacggttaggtttaccggacgggtacggtacggtaccaccgtagtacggaacggtacggtaacctacgtcaactagaacgttaccacgtacctagaggtaccgagtacgagtacggagcgtagacgttagcgacgacggacgtcgtacgtagttacgtcgttaggngtacggaagtgaacgtgtaacttcgtactttacgcgttaacggggg

SEQ ID NO: 118726 - DNA, 692 bp, Homo sapiens
  misc_feature: GYAE6OF01B1EA1.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcgtcttcttggtggcagcagtcacaggagcccagtcccaggtgaacttggtgcagtcgtgggtttgaggtgaacgaagtccgtggggcctcgagtgaacggtcccctgccgaggtccttcgtggtatacgtattcttcgagccgccgttaattatattaccacgtgggtcgcgcccgacgggcccccgtgggacgaacgggtcctaggaggtgggagtgggatggttactaccgaaccccgtgaggtcggccgaacaactaaaatacgtagacgacagacgtactttacgagggtcacgggtaccaccgtacgtaggaccgtcgggaacacccgtacccgaacttaccgaaaaccgacgtaccctaaccgtaagtacggtaacttacgtaacggtaacgttacgaaggtaaccgtaccggaaacccgtaccggaaccgggtacgttacggttaaccgttcgtagggttacgcggtaacggaggtcgtaagtacggttcccgtaaggtggggtaagtagggtacgacggtttaacgtttcgggttagttttagggg

SEQ ID NO: 118727 - DNA, 921 bp, Homo sapiens
  misc_feature: GYAE6OF01CTV2W.39.87.H10.1.454.CMB.1.raw
  modified_base (183)..(183): a, c, t, g, unknown or other
  misc_feature (183)..(183): n is a, c, g, or t
  modified_base (758)..(758): a, c, t, g, unknown or other
  misc_feature (758)..(758): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacgaggacgcccacctcccaggtncagcgtggtcgcgtacggtccgggacgtaggaggtaggaacgaacggtccggtcggggcccttacggaggttacggtaacggttccttacccgtacggaccgtaagggtccgttacggtaacgggtaaaccttccctaacccccggttaccctaaaccccgggtaccctttacgtttaaacttaacgttcggtaccccgttaacgggtttcgggtttacggaccccgggtaaccccgggaaccccggggtacccccgggtaagggtaaacccggggttaacggggttaccttttaaggggggacggttacgggggtaagggttagggggtacgttaacggggtaacccgttaacgggtaaaaccgggtttaacggtaggtttacccgggttaacctaaccgtaaaacgtttaaagttaacgtacgtaaccctaggtaaacgggttaacggtttaccgggaacgggtaacggttaccggaacccgtacgtacgtaacgggaccccggaaagggtccccggtaaccgttaacctaacgaacttaaccgaactccgaaccgtaagacgttaacggtanacgggtacccgtaagaacgggtacgacgtagtacctacgggtacggtacccacgggtccggttacgtagttaagtttggtaacggttccgaaagggtgtaaagtacggtttaacgtcccgtttaagttacccttacggttaacgggttagggttttaacgggg

SEQ ID NO: 118728 - DNA, 870 bp, Homo sapiens
  misc_feature: GYAE6OF01EM7YG.39.87.H10.1.454.CMB.1.raw
tcagtcgcactagtcacgaccggtgctcgatttagcagtactgcgttggggtttgggggcatcacccagcaaccacatctgtcctctagagaatcccctgagagctccgttcctcacccatggactggacctggaggatcctcttcttgggtggcagcagccacaggacgcccacctcccgaggtgcaggcgtgggtgcacggtccgggactggaggtagaagtacggccgtcggggtcctacgaggtaggtaacggttcctccgtcggacgaacggtccttcgtacggtaactaccctacccctaccgaaccggtaccgtactaagtagtccgaccgtacggttcgggtcggaccgtaacggtacccggccccggttagggaacgaacggggttacgtagggtacgggtacgggtaaggtcggggaacgtaacggtaacggttaaccgtaaaaccgggttaacgtacgggttacggtaccctaaacgtaaattaaacgtttacgacgtaactaaacgggtaaggtttacggttaacggaacggggtacggtaaccgggttacccgaaccgttaacggtacgggtaacccgggaaaccgggggttaacccctaaccgggttcctaaaccgttaaccgaaacgttaaccgaaacccggttaaacccggttacttaaaccggggttacggtaaacccgtagggaaccgggttacgggaacgggtacgtaagggaaccggttacggttaaccggtaccggaaccggttaccggaaccgggttagttaacggtttacgtttaaggtcggttaggaacggttagacgtaaggtcttaccggttacttacgtttacgtacggttggttaacggggg

SEQ ID NO: 118729 - DNA, 760 bp, Homo sapiens
  misc_feature: GYAE6OF01CF8MB.39.87.H10.1.454.CMB.1.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaacgccgtcggggcctcgaggtggaaggtcctaccgtgcgaaggtcttcgtaggaactccaccctacgaacccgtacgttccttaatacgtcgcctacgtgggttcgaccggacgtaccggtcccccgttagggaaccgtaacggggtccttagggacggtggaaggtggggagtacgggaataccgtaaacggttaaacgtacggttacggtaccgtacaaacgttaaaagtttacgtacgtacgaaacgtaacggttaacgtttaccggaacgggtacgtaacgggtaccaacccggtacgtaccgggaaccgtagggtaaccgtaccgtaacccgtaactaccgaaattaccgacgtacccgtaacacggttaacgaaccgttggaacgtacgtagggtacgtaggtagtacttccggtaggaacccggtaccgaaccggggttcccgttaaggtttacgtttacggttaggttcggtaaccggtaggtaacgtaggttaacggttaccttacggtttccctttacgttaacgggtttaacggg

SEQ ID NO: 118730 - DNA, 911 bp, Homo sapiens
  misc_feature: GYAE6OF01DU4EZ.39.87.H10.1.454.CMB.1.raw
  modified_base (731)..(731): a, c, t, g, unknown or other
  misc_feature (731)..(731): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatccttctttcgttgggtggcagacaaacaacgaggtcgcccacctccctaggttcagctggtacagtcgtggagctgagtagtggaacggaagcccggtggggccctgaggtagtaacggtccttccgtggacgtaacggtcctttaccgttacggttaacccttaacccttttaacccgtaacttacggttacgggttaacgttccggttaagggttttcgggggtacgacccggtaaccggtaacccggggtaccccccggtaggggtaaaccggtaaacgggggttcgtttagggacgggttaggggtaaggtaggggttaaggtacgggtaaaccgtcggaacgggtaccgttaccgttaaacgtaacggttacggtaaccaaacgtaaaaccctaaaagtttacgtaccgtaaccgtaaacccgaccggtaaaccccggttaaccggaacgggtaccaacgggtaaccgttacccaaaccgacgttaacccgaaaccgaaccgtaaccgtaacccaaccggtaaccgaccccggacgtaacccggacccgggtaaaccccgtacctaacgggtacgtaccgggttaaccncgggggaaacgtaacccggtcggtaaaggtccgttaacgtccggttaacgggacccgaccggggtaaccgttccggttaaccgtttaagtttaccggtggggacgcgaaagggtaacgggtacgggttaaacgggttaatttaccgggtttaggtaccgttccccggtttagtttaccgg

SEQ ID NO: 118731 - DNA, 929 bp, Homo sapiens
  misc_feature: GYAE6OF01BRMR0.39.87.H10.1.454.CMB.1.raw
  modified_base (158)..(158): a, c, t, g, unknown or other
  misc_feature (158)..(158): n is a, c, g, or t
  modified_base (314)..(314): a, c, t, g, unknown or other
  misc_feature (314)..(314): n is a, c, g, or t
tcagtcgcactagtcacgaccggtgctcgatttagcagtactgcgttgggtttgggggagcatcacccagcaaccacatctgtcctctagagaactcccctgagagcctccttcctccaccatggactggacctggaggacttccttcgttcgttggnggcagcacgaccacgaggaccgacccctacctaccccgaggtacgactacggcgtggtgaccgacgggtccgggactggaggtagtaagacgtccggtacgggcctagtaggtacggaacgtcctcgtacggacgtacgtcttacgacggtaaccnccgtacccctaccgaccgtacgttactaacgtagtcgtacgtcgttcggtacggaccgtacggcccggtaccccggttaggaacggtaacggttcgttaacgggtaggtagggtacggtagggtacgtaggtaacgtaaaccggtaaacggtagtacggtccgttaacgtaacctaaacgttaacgtagtacgtaacgaagggttaacttaaccggggtttaccgagggtaccgggttaacggactacccggaagttaccgggaaacccggtaacgggaacccttaccgtacccgttaaacgtaccgtaaaaacgtccggtaacccgtaaccgttaacgtaacgggtttaacggaaccgggtacggtaaaccggtacccggtaacgggggtacttaaacccgggagtttaaccccggttcggggaaaacccggtttacccgggaacccggggtttaaccggtttaacccgggtttaaacggtttttacgggttccggtttaacggggtaacggttccgggaaaaggttaacgggttacgtttaaccgggttttaccgggtttaaaccccttttaacgggtttaacgggtttaaaccccggttttaacgggggggg

SEQ ID NO: 118732 - DNA, 787 bp, Homo sapiens
  misc_feature: GYAE6OF01DJCZF.39.87.H10.1.454.CMB.1.raw
tcagtcgcactagtcacgaccggtgctcgatttagcagtactgcgttgggtttgggggagtcagacccactcaggacacagcatggacatgacgggtccccgctcagctccgtgggctttctgctgctctcggcctcccgaggtcgccagagttgtcgcctactccgtagttacgaccctagtcctccacttccctcctgtctgctatcgtaggtaggagacgagacgtccactactctacgttcggccggacaacggtcgaggtactaaattaaaacgtgttacgtttacgtccgttaggtactacgaacgacgaaacggaaaccgaacggtaaaccttaccgtaacggtcgtagtacttgtagtacgtactcgtaccttacggttaggttacgggtaacgggtccggtacctagtacgtacggtcgacggcggtacgtaggtacgtacgtcggtacggtaacgtactttacgttcctaccgttaccgtacctaacctaccgtaacccaccgtaacgtcccgttacggggacccgttaggttaacgttaaacgtttcttttaaccgaaacttttaacgtttacttaacgtaccgtttaaacttaacttttaacgtttttaccttcgtttaccgtccccgttaggtttaccgttaaccgggttcgggaaccggggtacgtaacgggtaaggttacggaaacttaccgtaaacgtaaaccggttggtacggtcggtaccttaaccgaccgtttacctacttcccgtttaagttcccctccgttacccg

SEQ ID NO: 118733 - DNA, 755 bp, Homo sapiens
  misc_feature: GYAE6OF01A1WGZ.39.87.H10.1.454.CMB.1.raw
  modified_base (353)..(353): a, c, t, g, unknown or other
  misc_feature (353)..(353): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcgttggtggcagcagccacaggacgcccactcccaggtgcagctggtgcacggtccgggactgggaggtaggaaggaacggtccgtcgggggcctcgaggtacgaacggtcctccgtgacgacggtccttcggtacggaactcccaccccgtaccgtaaccgacgtctactatcgacctacggttgtcggacgtaccgaccggtacccgnggaacggtaacggtacgtttaggaacggtagggtagtcggggtagtacggaacgtaaccggtaacggttaaacgtgggtcgttactaaccgtaaacttaaattacgaacgaccgtaaagtacggttaacggttacggacggtacgggacgtaaccgaacgttacggaccgaacgggtaacggtacccaaccggttacaacgtaacgaacgtaccgaccgtaaccctaagacgttacgggaacgtacgggaagaaccggagttacgaagaacgttacgtacgaacggaaccgtaccggaccggtttacgtaggtttaaccgttaggttaggttaccggaggtaacgtaaggagttacgtacgttacctttaacgtacgtttaacggttgggtttaaaccgggg

SEQ ID NO: 118734 - DNA, 709 bp, Homo sapiens
  misc_feature: GYAE6OF01BP6ST.39.87.H10.1.454.CMB.1.raw
  modified_base (164)..(164): a, c, t, g, unknown or other
  misc_feature (164)..(164): n is a, c, g, or t
  modified_base (397)..(397): a, c, t, g, unknown or other
  misc_feature (397)..(397): n is a, c, g, or t
tcagtcgcactagtcacgaccggtgctcgatttagcagtactgcgttgggtttggggcatcacccagcaaccacatctgtccctctagagaatcccctgagagctccgttcctcaccatggactggacctggagatcctcttctggtgcagcagccacaggacncccacgtcccgaggtcgcgagtcgtggtagccgacggtccgggactggtagggtagaaacgacgcggtcggggaccctagaggtaggtaacggttcgtaccgtacgacggtaacggtcgttacgtaggaacctacccacccgtacgaacccggtacttacctacgtagtaccgacgtacggttgggtaccgaccgtaccggcccggtacccgtaggaaccggtagtcgtaggnggtgacggtggtagtcgactacgaacggtacgtaggcgttacacaagtaagtcgtagaacgtagtacggttaagttcggaacggtacggtacgtaaccacggtaacgcggtaaccgacgttctaaaccggtccaaagtacctaagtaccgaccctacgtaacgacggtacgtaactacgggaacgtcggaacgttcggaagtacctacggtacgtaacggacccgaccgggttctacgtaaagttcgttagccgtagacgtagagtacttacgggtaactttccctagtttaccgtagtccggggtttaagg

SEQ ID NO: 118735 - DNA, 1047 bp, Homo sapiens
  misc_feature: GYAE6OF01C1PV0.39.87.H10.1.454.CMB.1.raw
  modified_base (105)..(105): a, c, t, g, unknown or other
  misc_feature (105)..(105): n is a, c, g, or t
tcagtcgcactagtcacgaccggtgctcgatttagcagtactgcgttgggtttgggggagtcagacccactcaggacacagcatggacatggacgggtcccccgntcagctccgtgggccttctgctgctcgtcggcctcccgaggtcgaccaggactgtgccctatccaagttcgacccagtcctccacgtccctccgtgtctgcagttcgtagtaagacgaccgtaagactccaaccctattaccgtaaccgttcgggaccccggggtactaaacgggttccggaaagggtactttaaaaacggtttaaaaagttacggttaacgttttaacggtaccccgtttaagggttaaaccttaccggtaacgaaaccgtaaaaccgggaaaaaccccggtaaaacggggtaaaaccccttccggttaaaacgggttccccgttacggtaacttaccgttaagttacggttaaccggttacccggttacccgttttaaccgggtttaaacggggttttaaccgggggtaaaaccgggtttaccccggggtaaccccttaacgggttaacggttaaaccggtttaccggaacgggtaccgggtaacggtagggtttacggtaaacggtttccgggaaacggggttaacttacggttttaaccttcccgtaaaccgtttaccctaacccgtacccgttaaccgttaccccgaaaccgttccggtaccccgtacggtacccccgggttattaacgttaaacgtttcgtttaaccgaacttttaaacgtttaccgtttacggtacccttaaaccgtttaaaacgtttaaccgttttttaactaccgttttaccgtaccccgtttcggtttaacccgttcggggttacccgggtaaccggggtaggttaaaccccggtaaagggttaccgtaaaaccggtacgttaaaacccggaaaacggtccggttttacgggaaacccggtttcctaaacccggtcgttaaaaccccggtttacttttgtacccggtttaacccgttacccgttaaccccgg

SEQ ID NO: 118736 - DNA, 771 bp, Homo sapiens
  misc_feature: GYAE6OF01BD1VW.39.87.H10.1.454.CMB.1.raw
tcagtcgcactagtcacgaccggtgctcgatttagcagtactgcgttgggtttgggggagtcagacccactcaggacacagcatggacatgagggtcccccgctccagctcctggggcttctgctgtctctggctcccaggtgccagatgtgccatccagttcgacccagtcctccactccctccctgtctgctatcgtggtaggacgacaggactaccgacctatcctacgttcggacccgggtactaaaggttccgaaggggactaaaagtttaaaaagtgtaattttaacgccgttaggtaacttcaaggaccgaacgaaaacccggaacggggtaaaaaccttcccgtaaggtacccgtgtaacttcgtattgaccttaccgcccttaccggtaggtttagggaaacggttccggggtaccacgttacggtaacggttccgaggtccgggtacgaggttacggtagtcgttacggggaactacgttaacttttcccacgtcccttccgtaaccctcgtaacccgaccgtaacggtcccttcgggtacccgtccgttaagtacgttttatttaccgactttaaacctttcgttaacttaggtaccttaaactttaagttttaacctttcgttacctacccggtacttacgttaccggttcgggaccgggaacggtacctagggtacgtaggtaaccgtaaccgtaagtaccggtggttcgaccgttcggacctaacccgttagtactttccttccggtatttaccccg

SEQ ID NO: 118737 - DNA, 800 bp, Homo sapiens
  misc_feature: GYAE6OF01BKG7P.39.87.H10.1.454.CMB.1.raw
  modified_base (109)..(109): a, c, t, g, unknown or other
  misc_feature (109)..(109): n is a, c, g, or t
  modified_base (241)..(241): a, c, t, g, unknown or other
  misc_feature (241)..(241): n is a, c, g, or t
  modified_base (254)..(254): a, c, t, g, unknown or other
  misc_feature (254)..(254): n is a, c, g, or t
  modified_base (606)..(606): a, c, t, g, unknown or other
  misc_feature (606)..(606): n is a, c, g, or t
tcagtcgcactagtcacgaccggtgctcgatttagcagtactgcggtttggggtttgggggagtcagacccactcaggacacagcagtggacagtcggacgggtccccntcagcctccggtggggtcttctgctcgctcgtcggcctccgagggtcaccaggtatcggtccgacctactccgtagttccgaccctgtcctacctctcccttctcgtctgactcgtcgtaggaggacgtacngtacacctacctntcgtacggtcggccgtacggtacgacggaacggtaacttaaagttaaagtcgttaacgtttccgacggtacgtaacacgtaacgtacgaaaacggtaaaccggaacggtaaacccggttccggtaacgtccgtagttacttacgtaacgtcgccgtttaccgtaccgtaggtttaacgggtaacgggtacggttaccgggtactaaacgggttacggaaccggttcgacggtcggtacggtacggtacggtacgcgggtaacgtattaaccgggtctaacccgtacgttaccacctaccgaccgtaccgtccgtaccggtccgtcgtacggttaacgtacgttaacggtttnttaaccggtatttaaccgtcgtttaacggtacttaactttaacgtttaaaccctttctaccgttccgttactcccgttaacgggttcggtaacggaacggtttacgggaaactcggtaaagacggtacttacggtaacgtagggtaccgtcgacgtacgtacctacgttactaggttcctaaccgttctacccg

SEQ ID NO: 118738 - DNA, 770 bp, Homo sapiens
  misc_feature: GYAE6OF01CFHLE.39.87.H10.1.454.CMB.1.raw
tcagtcgcactagtcacgaccggtgctcgatttagcagtactgcgttgggtttgggggcatcacccagcaaccacatctgtcctctagagaactcccctgagagctcccgttcctccaccatggactggacctgggagactccttcttcgttggtggcagcacgcccgacgacggaccgaccccaccgtacccgaggtcgaccgaggtccggtgggtcgaccgaaccgggtccgggacgtagggaggtaaggaaacggaaccggcccggtcggggtaccctacggtacggtaggtaaccggttcctaccgtgacgtacggttcgttacgtaggtaacctacccgtaccccgtaccgtaaccgtaccgtacttaacgtacgtaccgacgttacggttggtccgaaccggtaccgacccggtcccgaggaaccgtacgggtacgttggaggtcggtaggtacgggacgtaggacgtaaccggtaaacggtacgtgggttcgtacaactaacttaagttacgacgtacaaaccggtaagtcgttaacggacgggtacgtaccgggtacacggtacgtacggaccgtaacgggacctaccgactaacacgtaacgacccgtaacgaccgtaaagtcggtaacgacgtacgacggcgtaaggtccgaagtcgactacggacgaccgacgtaccgttgtacgttagtacgttcggacggacgttaggagttacgttagtacgttactacggttaacgttgggtagggtttaacggg

SEQ ID NO: 118739 - DNA, 770 bp, Homo sapiens
  misc_feature: GYAE6OF01EVSE0.39.87.H10.1.454.CMB.1.raw
  modified_base (104)..(104): a, c, t, g, unknown or other
  misc_feature (104)..(104): n is a, c, g, or t
  modified_base (598)..(598): a, c, t, g, unknown or other
  misc_feature (598)..(598): n is a, c, g, or t
  modified_base (638)..(638): a, c, t, g, unknown or other
  misc_feature (638)..(638): n is a, c, g, or t
  modified_base (649)..(649): a, c, t, g, unknown or other
  misc_feature (649)..(649): n is a, c, g, or t
  modified_base (658)..(658): a, c, t, g, unknown or other
  misc_feature (658)..(658): n is a, c, g, or t
tcagtcgcactagtcacgaccggtgctcgatttagcagtactgcgttggggtttgggggcatcacccagcaaccacatctgtcctctagagaactcccctgagngcctcccgttcctccaccagtcggactggaccgtgggaggtactcctctttcgttggtgcagcgacgccacgacggaccgcccctaccgtcccgaggtcgacgtcgtccgtgggtcgaccgcgggtccgggtacggtagggaaggtagaacggaaccggtccggttacggggcctacggtaggtaacgggtaaccggttcctaccggtacggacgtacggtccgttacggaacggtacctacccgacccgtactaccggtacttactatacgtcgtacctacggttcgggtcaccggtacggacccggtacccggtaggaaccggtacgggttcgtaggtaggtacggagggttaggaggtacggtacgtaaacggtaacgtaacggtacggtacgtagtaacctaacggtaaatgtacggaacaacggtaacgttacggtacgggacggttacgaccgtacaccgtagaccggtaacgacggaccgtaccgtntaacaacgtactaacgtaccaagtagtaacgcgtagacgnggtaccgaggngtaaccgtnaccttcggagtaacccgcgttacgggcctttaagtgttaacgccgggttagaaccggtagtacgtagtaccgtacggttaccttacgtaacgtttagggtagggtttacggg

SEQ ID NO: 118740 - DNA, 783 bp, Homo sapiens
  misc_feature: GYAE6OF01BBO71.39.87.H10.1.454.CMB.1.raw
  modified_base (105)..(105): a, c, t, g, unknown or other
  misc_feature (105)..(105): n is a, c, g, or t
  modified_base (456)..(456): a, c, t, g, unknown or other
  misc_feature (456)..(456): n is a, c, g, or t
  modified_base (517)..(517): a, c, t, g, unknown or other
  misc_feature (517)..(517): n is a, c, g, or t
  modified_base (772)..(772): a, c, t, g, unknown or other
  misc_feature (772)..(772): n is a, c, g, or t
tcagtcgcactagtcacgaccggtgctcgatttagcagtactgcggttggggtttgggggagtcagacccactcaggacacagcatggacatgacgggtccccgntcagctccgtggggcttctgctgctcgtcggcctcccgaggtcgccagatgtcgcctagtccaggttcgaccctagtcctccactccctccctgtcctgaccacttcgtaggtacgggacacaggacgtacaccatcctacgttccggccggggacaacgttccgaggtaactaaagttaaaaacgtgttatttaacgccgttagtaactacgaagtacaaacggaaaaccgtaacgggtaaaacctaccgtaacggtaccgtaagacttacgtatcggtactccggtaccgttacgtagggttaaggaacgggttccggtacctagtacggtagtacggacggaccggtnaagggttcgacgtcgggtacggaactcggttacttaccgacgtttccaactaccgtaaccnccgaacctaccgggccgttcggtaccggtaccgttaaggttaacgttacgtttaccgtaacgtttaactttacgttaaaccttacgtaacttaaactttaaactttaacgtttacctttacggttaccctaacgtttaccggttaccggttacggaaccgggtaacggtaaccggtaggtaacggtacccgtaaagtaaccggtaacgtaacggtggccgttacacgaaccttctactttcccgtcgttaacccncgtttaacccg

SEQ ID NO: 118741 - DNA, 753 bp, Homo sapiens
  misc_feature: GYAE6OF01CQ28L.39.87.H10.1.454.CMB.1.raw
tcagtcgcactagtcacgaccggtgctcgatttagcagtactgcgttggggtttgggggcatcacccagcaaccacatctgtcctctagagaatcccctgagagctccgttcctcaccatggactggacctgggaggatcctcttcttggtgacagcagccacaggacgccccacctcccaggtgcagcgtggtgcgacggtccgggactggaggtggaaagaaggccgtgggggacctcgaggtaggaaggtcctcctgacgaaggtcttcgtaggtaactccaccctaccgacccgtaccgttcctaatactcgactacgtggttgcgaccgtacggccccgtaggacgaacgggtctggaggtgagtgggagtggactacgaacgtagagtgtctacgtaactaaatcgacgtacacgtaaggtaacggtttgagggacgtaggtacccaacgcgtaacggaaccggacggggtaacctaccgtaacctaactaccgtaactaaaccggcctaaccgtaacgtacggttaacggtaacgtcgggaacggtacggtaaccggtacgttaaggacgttaacctccgggtaacggtaacccgaccgggttaaacccggggttaccgtttaaggttaacttttacgggttcggggtaacgaccgggtaagggtaaccgttaagggtacccgtttaaacggttaccctttacgttttaaacccggtaacccggttttggggtttaaaccgggggg

SEQ ID NO: 118742 - DNA, 653 bp, Homo sapiens
  misc_feature: GYAE6OF01EGAK1.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccactcctccctgtctgcatctgtaggagacagagtcaccatcacgttcgccgggacaagtcgagggactaattaaaatgtattagctggtatcagacaagaaaccgaggaaactcctaaggtcctagactctatgatcgcctaccgtaggtttaggaaaggtcggggtaccagtacgtaggttacgaggtcggcgtaggtggtagtcggtagggtactagtactttaccgaccttaccgtacctacctatacccaccgtacgccgtcggcccggacctaaggttaacgttaactttcgaacttaactttacttacgtattaactaaacttaagttttaactttaccgttacgtcccgtacttaccgttacgtttaccgggacgggtaacgggtaacgtagggttacggaacgtaacgtaccgtaaacggtacgttgggtcgacgtcgacccgtactacgttacttcgttacctcgttaccccg

SEQ ID NO: 118743 - DNA, 690 bp, Homo sapiens
  misc_feature: GYAE6OF01B9FVN.39.87.H10.1.454.CMB.1.raw
  modified_base (103)..(103): a, c, t, g, unknown or other
  misc_feature (103)..(103): n is a, c, g, or t
  modified_base (129)..(129): a, c, t, g, unknown or other
  misc_feature (129)..(129): n is a, c, g, or t
  modified_base (140)..(140): a, c, t, g, unknown or other
  misc_feature (140)..(140): n is a, c, g, or t
  modified_base (160)..(160): a, c, t, g, unknown or other
  misc_feature (160)..(160): n is a, c, g, or t
  modified_base (210)..(210): a, c, t, g, unknown or other
  misc_feature (210)..(210): n is a, c, g, or t
  modified_base (563)..(563): a, c, t, g, unknown or other
  misc_feature (563)..(563): n is a, c, g, or t
tcagtcgcactagtcacgaccggtgctcgatttagcagtactgcggttgggtttgggggagtcagacccactcaggacacagcatggacatgagggtccccgntcagctcctgggtcttctgctgctcnggctccaggtncaggatgtgccatccagttnccagtctccatcctcctgtctcgctatctgtaggagacagactccaactntacacttcggaccgggactaaggtcagggacaaattaaaagtgtatttacggaccgttggtatcaacgactaacggaaaccgtaagggaaacttcctaaagggttccctagttacgtcttatacggtaactcggacctacgtagggtttaacggaaacgggttcgggtacccctagtacggtaaacggttcgaacgggtcgagttaaaggtcgaacgttcggtacggtacagtactttcgacttcgacgtaccactaccaccggagtccgcggtacggactaacggtagttacctttaggaacccttaagttactaccgtagttaacctaatttaattttcttaccgttaacncgggtacccttaccggttaacgtttcgggaaccgttagggaaccgaagggttctaggtaaaaccttacgggaaaccttgttaccggaagtcgtaccgaacctgaacttcggtacttctactaccccg

SEQ ID NO: 118744 - DNA, 697 bp, Homo sapiens
  misc_feature: GYAE6OF01DE40Q.39.87.H10.1.454.CMB.1.raw
  modified_base (141)..(141): a, c, t, g, unknown or other
  misc_feature (141)..(141): n is a, c, g, or t
  modified_base (228)..(228): a, c, t, g, unknown or other
  misc_feature (228)..(228): n is a, c, g, or t
  modified_base (456)..(456): a, c, t, g, unknown or other
  misc_feature (456)..(456): n is a, c, g, or t
  modified_base (651)..(651): a, c, t, g, unknown or other
  misc_feature (651)..(651): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctnttcttggtggcagcagccacgaggcgccactcccagtgcagcgtggtcgcaggtccggactggaggtagaagagccgtgggccctgngtacgaacggtctcgtagctaacggtcttacgacggtactacccgaccctcctaaccggtaccgttacttaaacgtcgtacgtaccgtaacgttcgggtttccgaccggtaccggacccgggtaccccggtagggaaccgaaggggtccttagggtacggttaggaggtagggtactagggactacggtaaacggtaactgggtacgtacgtaccgaattaaacgttncgactacgaagttaaggttcggaaggtcgtaacggtaccgtactacgtaccgaacggaacggtacctaacgtaccaagttacctaacggtcaaccgtactaaacgtggtaccgtaagcggtacgaacgcggtaactagacgtagtacgacgtaccgaagtcccggtagtacgtttagttcgttaaggccggagtnacggtagtaagttccttaacgttcttacgtcggttaaggttcgggg

SEQ ID NO: 118745 - DNA, 896 bp, Homo sapiens
  misc_feature: GYAE6OF01CGYHI.39.87.H10.1.454.CMB.1.raw
tcagtcgcactagtcacgaccggtgctcgatttagcagtactgcgttgggtttgggggagtcagacccactcaggacacagcatggacatgagggtcccccgctcagcctccgtggggcttctgctgctcgtcggcctcccgaggtcgccagatcggtcgcctactccgagttcgaccctagtcctcctactccctcccgtgtctcgctatcgtaggtacggagacgagacgtaccacctactaccgtacgtccggaccgggtactaacggtacggaacggtaacttaaaaagttaaacgttggttaaccgtttacgtccgtaggtaactacgaacgtaaccgaaacggtaaaaccggaacggtaaacttaaccggtaacgtcgtagtatccgtagtacgtacgaccgttacccgttacgggtaagggtttaacgggaccgggttaccgggtacccgtaaacgtaacgggtaaccggttacggacggtaccgggtaaccggttagggtacggtacggtacggtacggaacttacgtttacttaaccgtccaaccgtacgtaaccgactaccgtaccggtaccgtcccgtaagggcccccggtaacttaggttaaacctttagttacccgttaaacgttaaacctttcgttaaccgtaaccgttaaaccttttaaagtttaccgtttaacggttcccttaccgttaccgtaccctaaccgggttttaccggggaaaccgggtaccggggttaacccgaaagggttacccgggtaaacgtaacccggttaaacgtaaaccccggggttaacgttacggtaacgggtcgtttaaaccccgaccgttaaccgccgttttaaaccgccccgtttaggtttcccctaaccctttaccccggg

SEQ ID NO: 118746 - DNA, 754 bp, Homo sapiens
  misc_feature: GYAE6OF01DK96O.39.87.H10.1.454.CMB.1.raw
tcagtcgcactagtcacgaccggtgctcgatttagcagtactgcgttgggtttgggggcatcacccagcaaccacatctgtcctctagagaatccccctgagagctccgttcctcaccatggactggacctggaggatcctcttcttggtggcagcagcccacaggacgccccactcccaggtgcagccgtggtgcgtaggtccgggacgtggagggtagaaaggaacggccgtcgggggcctcgaggtggaacggtcctccgtgacgaggtcttcgtaggacctccacccgtcgaccgtacttacctatacgtcgctacggttcggttcgccggaccgaccggtccccgtaggacggaacgggtcttaggaggtgggtagtgggagtggtacgtacgtaacggtacgtaggtacgtactactaacgtaaatttcgacgtactaagtaggttaacggtttacggacgggtacggtaccggtaccaaccgtacgtacggaacccggtaacgggaccctaccgtaaccgaataccaacgtacgaccgttacctaagacggttaacgtaacgagaccggtagacgggtactagggtaagtccggttacgtaaccgggtaccggtaaccggtaccgggttacgttaggttacgtttacggttcggtacgggtacggtaaggttaacggttaggaacgtttaccgtttacggtttaaccgtttacggttttaaacgggtaggggttttaaaccgggggg

SEQ ID NO: 118747 - DNA, 552 bp, Homo sapiens
  misc_feature: GYAE6OF02HAYFW.39.87.H10.1.454.CMB.1.raw
  modified_base (339)..(339): a, c, t, g, unknown or other
  misc_feature (339)..(339): n is a, c, g, or t
  modified_base (391)..(391): a, c, t, g, unknown or other
  misc_feature (391)..(391): n is a, c, g, or t
tcagtcgcactagtcacgaccggtgctcgatttagcagtactgcgttgggtttgggggtaggtcgagacccactcaggacacagcatggacatgagggtccccgctccagctcctggggcttctgctgctctggctcccaggtgccagatgtgccatccagttgacccagtctccatcctccctgtctgcatctgtaggagacagagtcaccatcacttgccgggcaagtcaggcaattaaaaatgatttagcctggtatcagcagaaaccagggaaaactcctaaggtcctagatctatgatgcctcagtttgaaagtgggtccatcaaggtcagcgnagtggatcgtgggacagtatttcactctcacatcaccagcctgcgctgaatntttgacaatttattactgtcaaactaatttaattcttaatcccgtacttctaaccgttttcggcggtacggaaccgtaagggtggagtattaacccgaaacggtaaccttggtacggtccgttacgggccaaccctacttccgtagttacctttcgtaacc

SEQ ID NO: 118748 - DNA, 777 bp, Homo sapiens
  misc_feature: GYAE6OF02IKZFW.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccactctagtccacctagtccactctcccctcctcgtctgactacttcgtaggtaggaacgaacgaaggtactaccaacctactacctacgttccggggccccggaacgtacgtacggaggacttaaaaattaaaagtgttaagttacgccggtagttacacgacgacaaacgaaacggaaaggtaaacctacggtaacgtcctagtacttactagagtatccgtccctacgttagggttaaaggaacgggttccgggtacctagtaacggtaacggttcgacgggcgaacgtagggtagtacgtcggtacggacgtaagtttacttaccgaacccttctaccctaaacctctacccgaacccgccgtcgtaccgggccgttacctaaaggtaaagttttacgtttcgaaacctttaaactttttacgtacggtttacctaaactaaaaacttttaaactttttactttaccttaaccgtcccgttacttaaccgtttaccgggttcgggaacggggtaaaccgtaaaccggtagggttaaggacttaacgtaaacccggaaaacgttacggtcgggtaccggtactacgacccacgttaccgttcgttacgtttcctacgttacccg

SEQ ID NO: 118749 - DNA, 618 bp, Homo sapiens
  misc_feature: GYAE6OF02HSUGO.39.87.H10.1.454.CMB.1.raw
  modified_base (611)..(611): a, c, t, g, unknown or other
  misc_feature (611)..(611): n is a, c, g, or t
tcagtcgcactagtcacgaccggtgctcgatttagcagtactgcgttggggtttcgggggaagtccagaccccactcaggacaccagcatggacatgagggtccccgctcaggctcctggggcttcctgctggcgtctgggctcccaggtagccgtaggactgtcgccgaatccaagtttggacccagtctccagtcctcctgtctggcatcgtgtaggagacagtacgtcaccagtcacttggccgggcaagttcagggtacctaattaaaaatgtaatttagaccttgggtatcgagcacgaaaccgagggaaaacgtcctaaggtcctgatcgtatggatgacctccagttggaagtcgggtaccatcgaaggttcgagtcgcaggtggtatcgtgggactaggtactttccacttctccaccattaccaccgacgcctcggccggtcctagaagtacttttgactaactttattacttagtacctaataaatttaacttcttatcccgtattctacgtttcggcgggtaaggaccgtaagggtggagtactacgaaacggtacgtggtacgggtctagggacgtacctagttccgtaggttccgttntaaccgg

SEQ ID NO: 118750 - DNA, 524 bp, Homo sapiens
  misc_feature: GYAE6OF02IXAQ7.39.87.H10.1.454.CMB.1.raw
  modified_base (394)..(394): a, c, t, g, unknown or other
  misc_feature (394)..(394): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcagaaaccagggaaaactcctaaaggtcctgatctatgatgcctccagtttggaaagtggggtcccatcaaggttcagcggcagtgatcgtgggacagattcactctcacatcaccagcctgccggctgaagtnttttgactaactttattactgtacctaaactaatttaattcttatccgtactctacgtttcggacggaggaccaagggtgagatacgaaacgtaactgtacggctgacacctagtactgttacctatacc

SEQ ID NO: 118751 - DNA, 490 bp, Homo sapiens
  misc_feature: GYAE6OF02GX9CR.39.87.H10.1.454.CMB.1.raw
  modified_base (413)..(413): a, c, t, g, unknown or other
  misc_feature (413)..(413): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaacggtaacagtggtctcacaaattatgcacagaagtttcagggcagggtcacatgaccagggacacgtccatcaatacagcctanatgaactgagcaggctgagatctgacgacacggcctgtattagtgtgcgagagatgatactcttactactattcggg

SEQ ID NO: 118752 - DNA, 501 bp, Homo sapiens
  misc_feature: GYAE6OF02GE0CZ.39.87.H10.1.454.CMB.1.raw
  modified_base (498)..(498): a, c, t, g, unknown or other
  misc_feature (498)..(498): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaatgatttagcctggtatcagcagaaaccagggaaaactcctaaaggtcctgatctatgatgcctcagtttggaaagtggggtcccatcaaggttcagcggcagtggatctgggatagatttcactctcaccatcaccagcctgcggcctgaagattttgctaaacttattactgtacaactaatttaattctattccgcttctacgtttcggcggaggtaccaaggtgagatacgaaagactgtgctgcacatctgtctntac

SEQ ID NO: 118753 - DNA, 500 bp, Homo sapiens
  misc_feature: GYAE6OF02G50M3.39.87.H10.1.454.CMB.1.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggagtgggatggatcaacggtaacaggtggtctcacaaattatgcacagaagtttcgagggcagggtcaccgatgaccagggacacgtcatacaatacagcctacataggaactgagacaggctagagatcgtagacgacgacggcgtagtagttatgtgcgagagatgagtactcttctatagg

SEQ ID NO: 118754 - DNA, 574 bp, Homo sapiens
  misc_feature: GYAE6OF02G2W61.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcagaaaccagggaaaactcctaaggtcctgatctatgatgcctccagtttggaaagtcggggtcccatcgaaggttcagcggcagtggatcgtgggacagtattcactctcacatcaccagcctgccggctagaagtatttgactaactttattactgttactaaacttaattttaattccttaactcccgtacttacctaccgttttcgggacgggtaacggaaccgtaaggggtggaagacgtacgaaaaccggtaacttgggtacggcgttaggacctaaccgtagttcccgttacggttccttactaccg

SEQ ID NO: 118755 - DNA, 500 bp, Homo sapiens
  misc_feature: GYAE6OF02G7RG2.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaaatgatttagcctggtatcagcagaaaccagggaaaactcctaaggtcctgatctatgatgcctcagtttggaaagtgggtcccatcaaggttcagcgcagtggatctgggacagatttcactctcaccatcaccagcctgcggcctgaagtattttgactaactttattactgtacaactaatttaattcttatccgcttctactttcggcggtaggaccaggtgagatacgaaacgactgtgctgcacatctgtctctac

SEQ ID NO: 118756 - DNA, 553 bp, Homo sapiens
  misc_feature: GYAE6OF02JIGN1.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaaatgattagcctgtatcagcagaaaccaggaaaactcctaaggtcctgatctatgatgcctcagtttggaagtgggtccatcaaggttcagcggcagtggatctgggacagtacttcactctcaccatcaccagcctgcggcctgaaacgtattttgactaaactttacttactgtactaaactaatttaattccttaatccgtcttactaccgttttcggcggtaacgggaccctaagggtcggagaacttacgaaaaccggtacttggtggtacctaggacctaaccgtattccgtacgttccttactaaccg

SEQ ID NO: 118757 - DNA, 718 bp, Homo sapiens
  misc_feature: GYAE6OF02JAX17.39.87.H10.1.454.CMB.1.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcgagtgaaggtctcctgcaaggcttcgtggaatcacctcaccgacgtctatatgcactggttgcgacacggccctggacaaggcttgagtggagtgggatggatcgaaacggtacgaggtggtctacaactaaaattagtacggacaacgtaagtaacggttttaccgaggggtaccgtaggggtacctaaccgaagttacggaaccggaacggggtaaccgtaaacccggtaccgaaacttaaccgtaaacgttaaccgtaacgggtacccttaaacgtaacgttaacgggtaaaccgttacggaaacggaccgtaacgggtaccgttaagggaaacggtacttaccggttacggaaacccggtaaccgtaacccgggtccggtttaacggttaacgttttaacggttaaggttacgggaccggtaaggtaacggtaagttacggtaacggtttaacccgttaccgtttaacgttaacgttttaacggggg

SEQ ID NO: 118758 - DNA, 537 bp, Homo sapiens
  misc_feature: GYAE6OF02JIEP1.39.87.H10.1.454.CMB.1.raw
  modified_base (433)..(433): a, c, t, g, unknown or other
  misc_feature (433)..(433): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcacctcaccgacgtctatatgcactggttgcgacaggcccctggacaagggcttgagtggatgggatggatcgaacggtaacagtggtctacaataaattatgacacgagaagtttcgagggacgagggtcaaccgtagtagaccgaagggacacgtcaatacaaactacagacctaanataggaactgaacgcaggctgaacgtatatgacgacgacgtccgtagtagttagtcgtagacgagtaagagtagagttaccgttattacgtactgttaacgggg

SEQ ID NO: 118759 - DNA, 536 bp, Homo sapiens
  misc_feature: GYAE6OF02JBSPZ.39.87.H10.1.454.CMB.1.raw
  modified_base (357)..(357): a, c, t, g, unknown or other
  misc_feature (357)..(357): n is a, c, g, or t
  modified_base (432)..(432): a, c, t, g, unknown or other
  misc_feature (432)..(432): n is a, c, g, or t
  modified_base (516)..(516): a, c, t, g, unknown or other
  misc_feature (516)..(516): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaggctctggaatcaccctcaccgacgtctatatgcactggttgcgacaggcccctggacaagggcttgagtggagtgggatggatcgaacggtacgagtggtctcacaaatatgcanagtaagtttcgagggcagggtcacctatacgacgaggacacgtccatacaatacacgacctactagtacggaacngacgcgacggtcgtagagacgtacgtacgacgacgacggtcgtacgtattacgttgtaggagacgagtagtacggagttacctnttactacgttagttacgggg

SEQ ID NO: 118760 - DNA, 626 bp, Homo sapiens
  misc_feature: GYAE6OF02G4S9W.39.87.H10.1.454.CMB.1.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcgagtgaaggtctcctgcaaggcttctggaatcaccctcaccgacgtctatatgcacgtggttgcgacaggcccctggacaagggcttgagtggagtgggatggatacgaaacggtaacaggtggtctacaactaaaattagtgacaacgaggtaagtttcgagggtacagggtacacagtcgaaccgtaggacacgtaccgaatacaatacacgtacctaagaagtaggaactgaagaccgaagggtcctaggaacgtacgttacgtacggaaccgaaccgtaccgggtaccgttaggttaacgtttaacgtttagggtacggtaacgggtaacgggtaaggtacgtttacggtaaacggtttaacccgtttccgttttaccgtaacgtttaaccggggg

SEQ ID NO: 118761 - DNA, 491 bp, Homo sapiens
  misc_feature: GYAE6OF02IUM54.39.87.H10.1.454.CMB.1.raw
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
tcagtcgcactagtcacgaccggtgctcgatttagcagtactgcgttgggtttgggtgagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggccctggacaagggcttgagtggatggggatggatcgaaacggtaacaggtggtctacactaaattatgacacaggaagtttcgagggcagggtcacgatcgacagggacacgtccatacaatacagcctacatcgactgagcgagctagagntctgacgacncggctgtatatgtgacgagcgatgatctctatacg

SEQ ID NO: 118762 - DNA, 595 bp, Homo sapiens
  misc_feature: GYAE6OF02G2UEL.39.87.H10.1.454.CMB.1.raw
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (467)..(467): a, c, t, g, unknown or other
  misc_feature (467)..(467): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatccaccctcaccgacgtctatatgcactggttgcgacacggcccctggacaagggtcttgagtggatgggatggatcgaacggtacagtggtctanaactaaattnagacaacgtagtaacgttcgagggcgtacgggtacactagtacgaaccgagggacctacgtacatacaactacacgtacctagtagacgtaactggacgacgtacggngtacgaacgtcgtaccgtacggaaccgtaaccggtaccgggtaccgttagtttacgttacggtgtacggaggtaacgaggtacgtagtacgttaccttacgttaccgtttagtacgggtttaacgggg

SEQ ID NO: 118763 - DNA, 512 bp, Homo sapiens
  misc_feature: GYAE6OF02GLYVJ.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaggcattatttagcctggtatcaacagcacccggggaaggttcctagactcctgatctatgatgcatccaatttagaaccaggggtcccatctcgattcagtggcggtgggtctggggacagatttcactctcaccatcagcagcctgctgccctgaagatgcttgcaactttattacctgtacaaaagtatgactagtgtcccgtggtaccgttcggcccgagggaccgaaagggtggaaactcgaaacgacgttcggtggcctagcaccattccg

SEQ ID NO: 118764 - DNA, 486 bp, Homo sapiens
  misc_feature: GYAE6OF02JH9ER.39.87.H10.1.454.CMB.1.raw
  modified_base (385)..(385): a, c, t, g, unknown or other
  misc_feature (385)..(385): n is a, c, g, or t
tcagtcgcactagtcacgaccggtgctcgatttagcagtactgcgttgggtttgggggagtcagacccactcaggacacagcatggacatgagggtccccgctcagctcctgggcttctgctgctctggctcccaggtgccagatgtgccatccagttgacccagtctccatcctccctgtctgcatctgtaggagacagagtcaccatcacttgccgggcaagtcaggcattaaaatgatttagcctggtatcagcagaaaccagggaaactcctaaggtcctgatctatgatgcctccagttgaaagtgggtcccatcaaggttcagcggcagtggatctgggacagatttcactctcaccatcaccagcctgcgcctgaagntttgctaacttatactgtcaacaatttaatcttatccgctctactttcgcggtaggacaagtgagatcaaacgactgtggctgcaccgatctcgtctctac

SEQ ID NO: 118765 - DNA, 540 bp, Homo sapiens
  misc_feature: GYAE6OF02F7TMR.39.87.H10.1.454.CMB.1.raw
  modified_base (441)..(441): a, c, t, g, unknown or other
  misc_feature (441)..(441): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgattagcctggtatcagcagaaaccaggaaactctaaggtctgatctatgatgcctcagttggaaagtgggtccatcgaagttcagcggcagtgatcgtgggacagtatttcactctacacctatacaccagcctggccgctagaagtattttgactaacttattactgtactaaactaattttaattacttatcccgtnttactacgtttcggacggtacgggaccgtaagggtcggagataccgaaaacggtaacttggacggtctggactacctattctcgttaccttcttacccg

SEQ ID NO: 118766 - DNA, 546 bp, Homo sapiens
  misc_feature: GYAE6OF02I4POB.39.87.H10.1.454.CMB.1.raw
  modified_base (386)..(386): a, c, t, g, unknown or other
  misc_feature (386)..(386): n is a, c, g, or t
tcagtcgcactagtcacgaccggtgctcgatttagcagtactgcgttgggtttgggggagtcagacccactcaggacacagcatggacatgagggtccccgctcagctcctgggcttctgctgctctggctcccaggtgccagatgtgccatccagttgacccagtctccatcctccctgtctgcatctgtaggagacagagtcaccatcacttgccggcaagtcaggcattaaaatgatttagcctggtatcagcagaaaccaggaaaactcctaaggtcctagatctatgatgcctcagttacggaaagtcgggtccagtcaaggttcagcggcagtggatcgtgggacagatttcactctcacatcacagctgcgctagaatntttgactaatttactactgtactaaataacttttaatctttaactcccgacttactacgttttccgggacggaacgggtaaccaacgggttgacgtaacttacgaaaacgtaacgtgtaacggtctacggctaacccgaattcgtagttcgttactaccg

SEQ ID NO: 118767 - DNA, 535 bp, Homo sapiens
  misc_feature: GYAE6OF02G7SC6.39.87.H10.1.454.CMB.1.raw
  modified_base (530)..(530): a, c, t, g, unknown or other
  misc_feature (530)..(530): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcagaaaccagggaaaactcctaaggtcctagatctatgatgcctccagtttaggaagtggggtcccagtcaaggttcagtcggcagtggatcgtgggactagtatttcactctcaccatcaccagcctgcggtcctgaagtagttttgactaactttattactagtcaaactaatttaacttcttatccgcttctacgtttcgggcggtacggaccaagggtgagacgtacgaaacgtactggtcggtctcgccacctactctcgtcttntaccg

SEQ ID NO: 118768 - DNA, 675 bp, Homo sapiens
  misc_feature: GYAE6OF02G4WE1.39.87.H10.1.454.CMB.1.raw
  modified_base (198)..(198): a, c, t, g, unknown or other
  misc_feature (198)..(198): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtagganacagagtcaccatcacttcgccggcaagtcgagggctaattaaaaatgtatttagcctggtatcagacaagaaaccgaaggaaacctaccgtaaggtcctagactctatgtactcgacctcgtagttaggaaacgtcgggtacccatacgaaggttcagcggacgagtaggatcggtagggactagttacgtttccacgttctaccaacctactacccaccgaacgtcccgtcgggcccggtaccgtaggtaaagttacgtttttacaccgttaaacttttaacttacgtacgttaacctaaactttaaattttaacgttacctttaactcccgttacttaccgttaaccgttttccgggacgggtaacggttaaaccgtaagggtgggtaacgtaacgtaacgaaaaccggtacgttcgggtacggaccttacggaacctaccgtaagtttccgttacgttacctttactaacccg

SEQ ID NO: 118769 - DNA, 512 bp, Homo sapiens
  misc_feature: GYAE6OF02IJ4DY.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaacggtaacagtggtctcgaactaaattatgacacgaagtaagtttcagggcagggtcaccatgaccagggacacgtcatcaatacagacctacataggaactgacgcgaggctagagatctggacgacgacgccgtgtatttagtgtgcgagagagtgagttactcttactactagttacggg

SEQ ID NO: 118770 - DNA, 523 bp, Homo sapiens
  misc_feature: GYAE6OF02G9NEN.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcaggcattaaaaatgattagcctggtatcagcagaaaccagggaaaactcctaagtcctagatctatgatgcctcagttggaaagtgggtccatcaaggtcagcggcaggtggactcgtggacagtacttcactctcacctatccaccagcctgcgtcctagaagtatttgactaatttagttactgtactaaacttaatttaattcttactccgtcttactacgtttcggacggaggaaccgtaaggtgagtaactacgaaacgtactaggtcgactgacacctatctgtcttctac

SEQ ID NO: 118771 - DNA, 529 bp, Homo sapiens
  misc_feature: GYAE6OF02GX4WW.39.87.H10.1.454.CMB.1.raw
tcagtcgcactagtcacgaccggtgctcgatttagcagtactgcgttgggtttgggtgagcatcacccagcaaccacatctgtcctctagagaatcccctgagagctccgttcctcaccatggactggacctggaggatcctcttcttggtggcagcagccacaggaacccactcccaggtgcagctggtgcagtccgggactgaggtgaagaagcctggggcctcagtgaaggtctctgcaaggcttctggaatcacctcaccgacgtctatatgcactggttgcgacacggcccctggacaaggctgagtggatgggatggatcaacggtaacaggtggtctacgactaaattatgacacagagtttcagggcaggtcacatagacgaggacacgtaccatacaattacacgacctacagtaggactagagacgaggctagagtatcgtagacgacgaaccggccggttagtaacgtttagtggtgacggtagaggtataggtaacgtactctttactagttacggg

SEQ ID NO: 118772 - DNA, 543 bp, Homo sapiens
  misc_feature: GYAE6OF02FJLFR.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcagaaaccagggaaactcctaaggtcctgatctatgatcgcctcagtttggaaagtcgggtacccatctaaggttcaggcggcaggtggatcgtagggacagtatttcactctacacatcaccagcctgccgctgaatatttgactaacttattactagtactaaataatttattacttatccgtacttactacgtttcggacggtaggtacctaagggtggactaagtaccgaaacgtacgtaggtcggactagaccactacgttcgttcgttaccttctac

SEQ ID NO: 118773 - DNA, 557 bp, Homo sapiens
  misc_feature: GYAE6OF02IENTN.39.87.H10.1.454.CMB.1.raw
  modified_base (294)..(294): a, c, t, g, unknown or other
  misc_feature (294)..(294): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggcaattaaaaatgatttagcctggtatcagcaagaaaccaggaaactcctaaggtcctgatctangatcgcctcgtaggtttaggaaacggttcgggtaccctagtacgtaaggttcgaggcggcaggtgagtcgtagggacagtattcactctcacatcacngctgcgcagatntttgactaacttatactgtactaaactaatttattcttatccgtcttactacgtttcggacggaacggacgtaagggtgacgtacgtacgaaacggtaacgtggtacggtactacgacctaacctacgttaccgtacgtttccttacctaccg

SEQ ID NO: 118774 - DNA, 521 bp, Homo sapiens
  misc_feature: GYAE6OF02IDP57.39.87.H10.1.454.CMB.1.raw
  modified_base (355)..(355): a, c, t, g, unknown or other
  misc_feature (355)..(355): n is a, c, g, or t
  modified_base (400)..(400): a, c, t, g, unknown or other
  misc_feature (400)..(400): n is a, c, g, or t
  modified_base (445)..(445): a, c, t, g, unknown or other
  misc_feature (445)..(445): n is a, c, g, or t
  modified_base (518)..(518): a, c, t, g, unknown or other
  misc_feature (518)..(518): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgatttagcctggtatcagcaagaaaccagggaaaactcctaaggtcctagatctatgatgcctctagtttaggaaagtgggtccatacgaaggttcagcggcaggtggatcgngggacagtatttcactctcaccatcaccagcctgcgcctgaagtnttttgacttaacttattactgtacaactaatttattcttactccncttctacgtttcggacggaggaccaagggtgagatacgaaacgtactggtcgctgacactattctgttccttntac

SEQ ID NO: 118775 - DNA, 614 bp, Homo sapiens
  misc_feature: GYAE6OF02F9A9R.39.87.H10.1.454.CMB.1.raw
  modified_base (313)..(313): a, c, t, g, unknown or other
  misc_feature (313)..(313): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctcctgtctgcatctgtaggagacagagtcaccatcacttcgccgggacaagtcgagggactaattaaaaatgtatttagctggtatcgagcaagaaaccgaagggaaacctaccgtaaggtcctagatctatgactncctctagtttaggaaaggtcgggtacccagtcgaaggttcacgcggctaggtgatcggtaggactagtactttcactccacaccatacccaaccacgtcccgtaggtccgggtaccttaagggtaacgttattttcgaaccttaaacgttttactttacgtagtacctaaaactttaattttaactttacttactccgtacttcgtacgtttcgggacggtaacggaaccgtaaggtgacgtataccggtaaacgtacgtggtacggctagaccgtacctattcgttcgttccttagtacc

SEQ ID NO: 118776 - DNA, 552 bp, Homo sapiens
  misc_feature: GYAE6OF02GA0Z1.39.87.H10.1.454.CMB.1.raw
  modified_base (352)..(352): a, c, t, g, unknown or other
  misc_feature (352)..(352): n is a, c, g, or t
  modified_base (428)..(428): a, c, t, g, unknown or other
  misc_feature (428)..(428): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccatcccaggtgcagctggtgcagtccgggactgagtgaagaagcctggggcctcagtgaaggtctcctgcaaggcttctggaatcaccctcaccgacgtctatatcgcactggttcgcgacaggcccctggacaaggcttgagtggatgggatggatcaacggtacagtggtctcactaaattntcgcacgagtaagtttcgagggcagggtcacatcgacaggacacgtcatcaactcagcctagactaggactgacgngaggtctgagacgtcgtcgacggacacggtaccgttagtactttacgttggtacggtacggtaaggtacgtaacgttacggtacgttaaccgttcgttttacgtaccgttaggtttaccggggg

SEQ ID NO: 118777 - DNA, 659 bp, Homo sapiens
  misc_feature: GYAE6OF02IL8XP.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggggcaaggtcgaggactaattaaaatgtattacgccgtaggtatcagacaagaaaccgaaggaaactacgtaaggtcctagatctatgatcgcctacgtagttaggaaggtcgggtaccatacgaggttcgacggcggtcaggtagtacgtcggtagggaactaagttactttaccactcctaccaacctactacccaaccgtacgtcccgtacggtccggtacctaagggtaacgtttacgttttacgaccttaacgttttaacttacgtacgttaacctaaactttaaattttactttaccttaacgttcctacttaccgttacggtttcgggacgggtaacggtaaccgtagggtacggacgttaacaaccggaaacgtacggtggtaccggtctaccggaccttaaccgtattccggttacgttacctacgtaccg

SEQ ID NO: 118778 - DNA, 557 bp, Homo sapiens
  misc_feature: GYAE6OF02FPJ7E.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcactgccgggcaagtcagggcattaaaatgattagcctggtatcagcagaaaccagggaaactcctaaggtcctgatctatgatcgcctcagtttggaagtggggtccatcaaggtcagcggcaggtggatcgtagggacagatttcactctcacctatccaccagcctggccggtcctaggaacgtacttttaggccttaaactttatttactacgttacaaacttaattttaacttacttacttccgtacttactacgttttccggcgggtaacggaacctaagggtggagtactaacgaaacgtaactggtaggctagacctaccattcctgttaccttcgtac

SEQ ID NO: 118779 - DNA, 645 bp, Homo sapiens
  misc_feature: GYAE6OF02JOE3C.39.87.H10.1.454.CMB.1.raw
  modified_base (212)..(212): a, c, t, g, unknown or other
  misc_feature (212)..(212): n is a, c, g, or t
tcagtcgcactagtcacgaccggtgctcgatttagcagtactgcgttgggtttgggggtaggtcgagacccactcaggacacagcatggacatgagggtccccgcgtcagctcctgggcttctgctgctctggctcccaggtgccagatgtgccatcccagttgacccagtctccatcctccctgtctgcatctgtaggagacagagtcacntcattgccggcaagtcagggcaagttaaaaatgatttaagcctggtatctagcagaaaccagggaaactctaaggtcctagatacgtatgatgcctctagtttaggaaagtcggggtaccagtcgaaacggttcacggtcggacgacggttagggactcggtgggaactaggtaatttcacgtactacgacccaataccacctacgacctcggtccgccgtacgaaggttactttacggtactaacctttataaccttcgtaactaacctaaattttaactttacctttacgttaccgttacttaccttaccgttttacgggaccggtacggaaccgttaacgggtaggtacggtaacgttacgtaaaaccggtaagttacggtcgggtacttacggacgtaccgtacttactcggttactttccgttaaccg

SEQ ID NO: 118780 - DNA, 526 bp, Homo sapiens
  misc_feature: GYAE6OF02HL00V.39.87.H10.1.454.CMB.1.raw
  modified_base (489)..(489): a, c, t, g, unknown or other
  misc_feature (489)..(489): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcgaacggtaacaggtcggtctacactaaattatgacacagtaagtttcgagggcagggtcaccatcgaccagggacacgtcatacaatacacgcctaacagtacggaactggacgcgaggtctagaagactacacggacgacgacggcgtagttattagttgngacgagagagtgacgtactcttactactagttacggg

SEQ ID NO: 118781 - DNA, 667 bp, Homo sapiens
  misc_feature: GYAE6OF02IFWUC.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccgggcaagtcagggctaattaaaatgtatttagcctggtatcagcaagaaaccagggaaactccgtaaggtcctagatctatgatcgcctcgtagtttaggaaggttgggtacccagtcgaaggttcaggcgcgagtggatcgtagggactagtactttcactctaccacctagtaccaacccgagtccctggacccggtaccgtaggtaaacgttacgttttagaacctttaaactttatttaaccgttacgttaaactaaacttaaattttaacttacctttaacgtcccgtacttaccgttaccggttttccggggaaccgggtaacggggtaaaccgtaaggggttacggaacgttaacgtaaacccgtaaacggtaaccgttcgggtaacggtaccgttacgaccgtacccgtacgttaccgttacggtttcccttactacccg

SEQ ID NO: 118782 - DNA, 662 bp, Homo sapiens
  misc_feature: GYAE6OF02IX9YT.39.87.H10.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
  modified_base (339)..(339): a, c, t, g, unknown or other
  misc_feature (339)..(339): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaganacagagtcaccatcacttcggccgggcaagtcagggacaattaaaaatgaatttagcctggtatcagcaacgaaacagggaaaactctaaggtcctgatntatgatgcctctagttaggaagtgggtccatcaagttcagcgnagtgatcgtggactagtacttcactcctacaccactaccaaccagtccgtggccggtacctaggtaagttacgttttcgaaccttaaactttatttaccgttacgtaaaccttaaacttaaattttaactttacctttaacttacccgtaccttacccgtttaacgtttaccggggtaacgggtaaccgggtaacccggtaaacgggttaggggaacgtaacgttaaccggaaaaccggttaaccggttacgggttacggtaccgttacggtacccgaacccgttagttacccgtttacggtttaccctttacggttaacccc

SEQ ID NO: 118783 - DNA, 577 bp, Homo sapiens
  misc_feature: GYAE6OF02FS31A.39.87.H10.1.454.CMB.1.raw
  modified_base (251)..(251): a, c, t, g, unknown or other
  misc_feature (251)..(251): n is a, c, g, or t
  modified_base (365)..(365): a, c, t, g, unknown or other
  misc_feature (365)..(365): n is a, c, g, or t
  modified_base (521)..(521): a, c, t, g, unknown or other
  misc_feature (521)..(521): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcgagtgaaggtctcctgcaaggcttnggactcaccctcaccgacgtctatatgcacttggttcgcgacacggcccctggacgaagggcttggagtggatgggatggatcgaaacggtacaggtggtctacaactaaattngcaacgagtaacgttcgagggacgagggtacacgatcgaaccgagggacacgtaccatacaatacgacgacctaacgacgtaggaactggaagcgacggcgtagacgtacttcgagaaccggaacgaccgggtaccgttaggttaacttagttggnggtacgaggtagtagtacgtacgttaccgttacttacgttacgtaggttacggggg

SEQ ID NO: 118784 - DNA, 564 bp, Homo sapiens
  misc_feature: GYAE6OF02I9Z20.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggttgcgacacggcccctaggaccgaagggcttgagtggatgggatggatcgaacggtaacaggtggtactcaactaaattatgcacagtaagtttcgagggcaggggtaccacgagtacgaccgagggactacgtacagtacaacttacgacgccctaacgtagtacggaactacggaacgtcgaaggcgtagaagtatccgtagaccgacgaccggtccgttagttattagttgtggacgtaagagtagtagtacgtacttcttacgttactagtttacgggg

SEQ ID NO: 118785 - DNA, 580 bp, Homo sapiens
  misc_feature: GYAE6OF02IW8YR.39.87.H10.1.454.CMB.1.raw
  modified_base (291)..(291): a, c, t, g, unknown or other
  misc_feature (291)..(291): n is a, c, g, or t
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaccctcaccgacgtctatatgcactggttgcgacncggcccctggacaagggcttggacgtggatgggatggatcgaacggtaacngtaggtctacgaactaaatttacgngtacaacaaggtaaagtttccgagggtacgagggtaccactagtacgaaccgagggacacgttaccaactacgaaatacacggtacctaacagtagaacgtgacgacgaggacgtagaagactcgtaggacgaccgacggtccgtagtaattagttcgtagcgtaagacgtagtacgaggttaccttagtttaccgtacttaggttaacgggg

SEQ ID NO: 118786 - DNA, 588 bp, Homo sapiens
  misc_feature: GYAE6OF02HBRNA.39.87.H10.1.454.CMB.1.raw
  modified_base (445)..(445): a, c, t, g, unknown or other
  misc_feature (445)..(445): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccttgggcctcagtgaaggtctcctgcaaggcttctggaatcaccctcaccgacgtctatatgcactggttgcgacaggcccctggacaagggcttgagtggagtgggatggatcgaaacggtaacagtggtctacgaacaaattagtgacaacgagtaaagttttcgaaggggtcaagggtcaacctagtagaccgagggacacgtccaatcgaaattacagccctaanacgtacggaactggaagacgaggacctaggaacgtactcgtagaaccgacgtaccggaccgttaggttaacgtttaagttggtacggtacggtaagaaggtacgtaggtaaggttaccttcgtttacgttaactttaacgggg

SEQ ID NO: 118787 - DNA, 600 bp, Homo sapiens
  misc_feature: GYAE6OF02IRNKU.39.87.H10.1.454.CMB.1.raw
  modified_base (419)..(419): a, c, t, g, unknown or other
  misc_feature (419)..(419): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgattagcctggtatcagcagaaaccagggaaactcctaaggtcctgatctatgatgcctctaggtttaggaaaggtcggggtacccagtacgaaggttcaggcggctaggtggatcgtaggggacagtactttcacttctacacctatccacctagccctggccgcctagaacgttntttacgacttaactttattacttgtactaaactaatttaacttcttactccgtcttactaccgttttcgggacgggtagggaccgtaaggggtacggtagaacgtaccgaaaacggtaaccgtagggttacggacttacggacctaacccgtacgttaccgttcggttaccttcctaaccg

SEQ ID NO: 118788 - DNA, 775 bp, Homo sapiens
  misc_feature: GYAE6OF02G811S.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcgttcttggtggcagcagccacaggagcccactcccaggtgcagctggtgcagtccgggactgaggtgaagaagcctggggcctcagtgaaggtctctgcaaggcttctggaatcaccctcaccgacgtctatatgcatggttgcgacaggcccctggacaagggcttgagtggatgggataggatcgaaacggtaacaggtaggtactcaataaattagtacgacgaacctaaggtaaaggtttcgaaggggtaccgtaaggggtaccctaacccgtaagttccggaaacccgaacggggggaacctaaccgggttaccaaacgttacccgaaaagttaaccggaaccggtaacccgttaaaccaaacggttaacggggtaaaaccgttaggtaaccgggacccggtaacgggtcccgttaaggggaaaccgttaaccggttacgttaaacgggtaacccggtaaacccgggtaacccggggttacccgggttaaggttttaacggttttaacggtttaacgggttaccgggtaaacgggtaaccgggttaaagggtaacgttaacggggaacggttttaacccgtttaacccgttttaaccggtttaaccgttaagggttttaaccggggggg

SEQ ID NO: 118789 - DNA, 658 bp, Homo sapiens
  misc_feature: GYAE6OF02JYJ1T.39.87.H10.1.454.CMB.1.raw
  modified_base (191)..(191): a, c, t, g, unknown or other
  misc_feature (191)..(191): n is a, c, g, or t
  modified_base (252)..(252): a, c, t, g, unknown or other
  misc_feature (252)..(252): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtncagtccgggactgaggtgaagaagccgtgggcctcgagtgaaggtctcgtgcaaggcttcnggaatcaccctcaccgacgtcgtatatgcactggttcgcgactacggcccctggaacaagggcttcgagtggattgggatggatacgaacggtacaggtggtactacgataaattntcgacanacgtagtttacgagggctagggcaccatacggaccgaggacctacggtaccagttacaaagttaacacggtacccttaacaacgttacggaaaccgttggaacgaccgtaagggtcccgtaaggtaacgggtaaccttcgtaaaccggacgtaacccgacccggggtaccgttaaggttaaccggttttaaagtttggaaaccgggttcccgaaaggggtaacgtacggttaacgtaacccgggtttaacttacccgtttaccggttaacgtttaacccgggg

SEQ ID NO: 118790 - DNA, 636 bp, Homo sapiens
  misc_feature: GYAE6OF02F52MX.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccgggacaagtcgagggacaattaaaaatgtatttagcctggtatcagcaagaaaccaagggaaacctacctaaggtcctagatctatgatcgcctcgtagtttaggaaaggtcgggtacccagtacgaaggttcaggcggctaggtggatcgtggactagtactttcactctacacctactaccaccacgcctggccggtactaggtaacgttattttacgacttaactttacttacgttagtaactaaactttaacttttaactttaccttacttcccgtaccttaccgttaaccgttttccgggaacgggtacggtaaaccgtaaggggtacggatacgtaaccgtaaacggtaacgttcgggtacggtacgtacgacctaaccgttacgttacgttacgttacctttcgtaaccc

SEQ ID NO: 118791 - DNA, 534 bp, Homo sapiens
  misc_feature: GYAE6OF02HPEZS.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatccaccctcaccgacgtctatatgcactggttgcgacacggccccgtggaccgaagggcttggaggtggagtgggatggatacgaacggtaacaggtggtctacgaactaaattatgacaacgtaagtaagtttcgagggcgagggtcaccgatcgaccgagggacacgtaccatacaatacacgacctacacgagaactggagcgaggctagagactcgtagacgacacgcgtgtattagtgtgcgagtagatgtagtactcttacgttactagttcggg

SEQ ID NO: 118792 - DNA, 642 bp, Homo sapiens
  misc_feature: GYAE6OF02GP69C.39.87.H10.1.454.CMB.1.raw
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacacggcccctaggacaagggcttggagtggagtgggatggactacgaaacggtaacgaggttggtactacgaacaaaatttagtacgacaacaaggtaagttttcgaggggtcgtacgggtaccaaccgtagtacggaccgaacgggacgaccggtaccaagtacctaaacgttaccgaacgtacccttaacacgtacggtaaccgttaggaacggaccgaacggtacgtacggaacgtacgtaccgtacggaaccgtaccggaccggtaccgttacgttagtttagttacggtagtaaccggtaaggtaacgagttaggtaacgttactttccgttacgttagttaacggg

SEQ ID NO: 118793 - DNA, 608 bp, Homo sapiens
  misc_feature: GYAE6OF02GPRU4.39.87.H10.1.454.CMB.1.raw
  modified_base (604)..(604): a, c, t, g, unknown or other
  misc_feature (604)..(604): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaatgatttagcctggtatcagcaagaaaccgagggaaacctcgtaaggtcctgatctatgatgcctccgtagtttaggaagtcggggtacccagtcgaacggttcagcggcaggtggtatcgtgggacagtatttacgacttcctaccaccataccacccgagtcccgtcggcccggtctaggtaaacgttagtttacggacttaaactttatttaaccgttagttaccaaacttaatttttaacttactttacgtacccgtacttccgtaaccgttttcgggaccggtaacgggtaaccgagggttacgagtactaccggtaaacgtaacgtggtacgctcgacctacctagtcctgttaccttntacc

SEQ ID NO: 118794 - DNA, 521 bp, Homo sapiens
  misc_feature: GYAE6OF02FSX3O.39.87.H10.1.454.CMB.1.raw
  modified_base (466)..(466): a, c, t, g, unknown or other
  misc_feature (466)..(466): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcattaaaaatgattagcctggtatcagcagaaaccagggaaaactcctaaggtcctgatctatgatgcctcagttggaaagtgggtcccatcaaggttcagcggcagtgatcgtgggacagatttcactctcaccatcacagctgcgcctagaagtatttgactaacttattactgtacaactaatttaattcttatccgcttctacgtttcggacgtaggacctaaggtcgganatacgaaacgaacgttgtacggcttagacctaccattccgtagttcctacgtacc

SEQ ID NO: 118795 - DNA, 543 bp, Homo sapiens
  misc_feature: GYAE6OF02IWFUB.39.87.H10.1.454.CMB.1.raw
  modified_base (367)..(367): a, c, t, g, unknown or other
  misc_feature (367)..(367): n is a, c, g, or t
  modified_base (504)..(504): a, c, t, g, unknown or other
  misc_feature (504)..(504): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtccgggactggaggtgaagagcctggggcctcagtgaaggtctcctgcaggcttctggaatcaccctcaccgacgtctatatgcacgttggtgcgacgacggcccctggacaagggcttgaggtggagtgggatggatcgaaacggtaacgaggtgtctacaactaaattangacacgaagtagtttcgacgggcacgggtcacagtacgacgaggaccacgtccatacaactacacgtacctaacagtacggaactgagacgtaggctagagactcgtagacgaccgacggtccgtagttatgttagnggtacgagtagagtagtacgtacttcgttactattaggg

SEQ ID NO: 118796 - DNA, 565 bp, Homo sapiens
  misc_feature: GYAE6OF02F75IQ.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctctgcaaggcttctggaatcacctcaccgacgtctatatgctactggttgcgacacggcccctggacaagggcttgagtggatgggatggatcaacggtaacaggtggtctacgaactaaattactgacaacgaaggtaaagtttcgaggggtacacggggttccaaccgtagtacggaacccgtaaggggacctaaccgtaccgaatacgaacttaacgagaccctaacagtaggaactggacgcaggctagagatcagacgacgacgcgtagtacttagttgtcgacgtagaggtatcgtacgtaccttcttacgtacttggttacggg

SEQ ID NO: 118797 - DNA, 549 bp, Homo sapiens
  misc_feature: GYAE6OF02IG42N.39.87.H10.1.454.CMB.1.raw
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (386)..(386): a, c, t, g, unknown or other
  misc_feature (386)..(386): n is a, c, g, or t
  modified_base (430)..(430): a, c, t, g, unknown or other
  misc_feature (430)..(430): n is a, c, g, or t
  modified_base (440)..(440): a, c, t, g, unknown or other
  misc_feature (440)..(440): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcagtgaaggtctctgcaggcttctggaatcaccctcaccgacgtctatatgcactggttgcgacaggccctggacaagggtcttgagtggatgggatggatcgaaacggtacagtggtctcacaaattangcanagtaagtttcgagggcagggtcactangacaggacacgtcatacaatacacgactacagtaggtacagganccgagggtcnggaagtacttcgtacgacgtacgacgtcgttagttaactttagttggcgcggtaaggtaagtagtacggtaacgttaccgttactttacgttacgttaggtttacgggg

SEQ ID NO: 118798 - DNA, 572 bp, Homo sapiens
  misc_feature: GYAE6OF02JECB5.39.87.H10.1.454.CMB.1.raw
  modified_base (356)..(356): a, c, t, g, unknown or other
  misc_feature (356)..(356): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagagcctggggcctcagtgaaggtctcctgcaaggcttctggaatcaccctcaccgacgtctatatgcactggttgcgacacggcccctggacaagggcttggagtggatgggatggatcgaacggtaacagtggtctcaacaaattntgacaacagtaagtttcgagggcagggtcacatcgaccgagggaccacgtccatacaatacgacgcctaacagtcggaacctaggacgacgacggtacgtagaacggtactacgtacggaccgaaccgaccgggtccgttagttacttagttggtacggacgtaaggagtagtacgtacggttaaccttcgtttacgttacgttagtttacggggg

SEQ ID NO: 118799 - DNA, 589 bp, Homo sapiens
  misc_feature: GYAE6OF02GVAKK.39.87.H10.1.454.CMB.1.raw
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
  modified_base (466)..(466): a, c, t, g, unknown or other
  misc_feature (466)..(466): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtccaccatcacttgccgggcaagtcagggcaattaaaaatgatttagcctggtatcagcagaaaccagggaaaactcctaaggtcctagatactatgatcgccttcgagtttggaaagttcggggtcccagtcgaaggttcagcggcaggtggaatcgtagggacaggtctttacacttctcaaccataccaaccngtccctgccggtctagaagtntttgactaactttnttactgtactaactatttaatcttactccgtntaccgtacgtttccgggacggtacggaaccgtagggtacggtagtactacggtaaaacggtaacgttacggtcggtaccgtagacccgtaccgttacttccgttacgtttccttacgtacccg

SEQ ID NO: 118800 - DNA, 762 bp, Homo sapiens
  misc_feature: GYAE6OF02JG6P7.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctgggcttctgctgctctggctcccaggtgccagatgtgccatcagttgacccagtctccatcctcctgtctgctatctgtaggagacagacgtacaccatctacgttcggaccggacaaggtcgagggtactaattaaaaacgtgtaatttacgccttaggtactacgagtacaagaaaaccgaagggtaaaaccttaccgttaacggtcccgtagtaacttacgtaatggaacttcggacctttacggtaaggttttacggaaacggttcgggtacccctaacggtcgtaacggttaccgaggtacgggtacgtaacggtacggtacgtacggttagggtaacctaagggtaacctttcgaaccttctaaccgtacctacgtaccctaccgaacggtcccgtacgggtacccggttacctaaggtacgtttaacgtttttacggaacctttaaaaccgtttacgtttaacgttaccgttaaacccttaaatttaaacgtttttaactaccgtttacgttacccgtacttactttaccgggtttaacggaccgggtaacgtaaccgtaagggtagtaacgtactaccggtaaacgtacgttggtaccggacgttacaaccggttactacgttacgttcgtaccttactaccg

SEQ ID NO: 118801 - DNA, 672 bp, Homo sapiens
  misc_feature: GYAE6OF02HBK7I.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaagtctcctgcaaggcttctggaatccaccctcaccgacgtctagtatgcactggttgcgacacggcccctaggacgaagggcttggagtggatgggatggatacgaacggtaacaggtggtactacaactaaagttataggacaagtaacggtaaagtttccggaacgggtacgtaaggggtacccaacccgtaagttaccggaaaccaacggggggtaacctaaccggttacccaagttaacccgtaaagttaaaccgtaacgtacccgttaaacgaacgtaacgggtaaacctaggaacgacgaacgggtcttacggaagtacgttacgtaaggaccgaaaccgaccggtaccgttagttaacgttagtttaaggtcggacggaaggtacgtagtaggtaacgttaccgttacgtttacgtaaccgtttaggttaacgggg

SEQ ID NO: 118802 - DNA, 579 bp, Homo sapiens
  misc_feature: GYAE6OF02HDBY4.39.87.H10.1.454.CMB.1.raw
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
  modified_base (363)..(363): a, c, t, g, unknown or other
  misc_feature (363)..(363): n is a, c, g, or t
  modified_base (456)..(456): a, c, t, g, unknown or other
  misc_feature (456)..(456): n is a, c, g, or t
  modified_base (538)..(538): a, c, t, g, unknown or other
  misc_feature (538)..(538): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcagtgaaggtctcctgcaggtcttcnggaactcaccctcaccgacgtctatatgcacgtggttncgacacggcccctggacgaggcttgagtggagtgggatggatcgaaacggtacagtcggtctacaactaaattntcggacaacgtaaggtaacgtttcggagggtcgacgggtacaccgtagtacgaaccggagggaccacgtcaactacaataccacgtacctaanagtacgactgacggcgaaggtcgtagacgtactcgagacgacgaccggtccgttagttattacgtcggtcgacggtagagtntacggtacttaccttccgttacttacggtaggttacggggg

SEQ ID NO: 118803 - DNA, 598 bp, Homo sapiens
  misc_feature: GYAE6OF02H0MZQ.39.87.H10.1.454.CMB.1.raw
  modified_base (225)..(225): a, c, t, g, unknown or other
  misc_feature (225)..(225): n is a, c, g, or t
  modified_base (360)..(360): a, c, t, g, unknown or other
  misc_feature (360)..(360): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcaggtccgggactgaggtgaagaagcctggggcctnagtgaaggtctctgcaggctctggatcacctcaccgacgtctatatgcacgtggttgcgactacggccccgtaggacgaacgggtctaggtacgtggacgtgggtatggatacgaacggtaacagtcggtactanaactaaattatacgacatagtaacgtttcgacgggtacgacgggtacaccagtcgaccgtagggactacgtaccatacgaatacacgtacctacagtaggaactggacgacgaacggcgtaggagtactacgtacgacgacgtaccggtaccgttagtaacttacgttaggttaccggaggtaaggtacgtagtacggtacgttaccgttacgtttacgttacgttaggtttacgggg

SEQ ID NO: 118804 - DNA, 721 bp, Homo sapiens
  misc_feature: GYAE6OF02J2JWO.39.87.H10.1.454.CMB.1.raw
tcagtcgcactagtcacgaccggtgctcgatttagcagtactgcgttgggtttgggggcgatcacccagcaaccacatctgtcctctagagaatcccctgagagctccgttcctcaccatggactggacctggaggatcctcttcttggtggcagcagccacaggagccactcccaggtgcagctggtgcagtccgggactgaggtgagaagcctgggcctcagtgaaggtctcctgcaaggcttctggatcgacctcacgacgtctatatgcactggttcgcgacacggcccctggacaagggtccttgacgtggacgtgggatgggatacgaaacgggtaacgtagttcggggtaccttacaaccgtaaagttacgtagtaccgaactacggtaaacgttttccggaacggggtcgtaacggggtacaacccgtagtacggaaccggtacggggaacctaacccggtaccgaacgttaccgaaacttaaccgaacggtaacccgttaacgtacggttaacgggtaaacgttaggaaccggacggtaaccgggtacgttagggaaacggtacgtttaaccgtaccgggaaacgtaaccggtaaccgggttacccggttacgttaacggttttaacggttcggttacggacggtaaccggtaaggtacttacgggttacgtaaccgttttaccttaccgttacgttaggtttaaccggggg

SEQ ID NO: 118805 - DNA, 637 bp, Homo sapiens
  misc_feature: GYAE6OF02HJQL3.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttcgacccagtcctccactccctccctgtctgcatctgtaggagacagagtcaccatcacgttcggccgggacaagtcgagggactaattaaaaatgtaatttacgccgtaggtatacgacgacaacgaaaaccgaaggaaacctaccgtaacggtcctagactcgtatgactcgtcctacgtaggtttaggaaggttccgggtaccctaagtacgtaaggttcaggacggcgtaggtggtacgtcggtacggacgtaagttactttccactctactacctactaccgaccacggtcctcggccggtactacgtaacgttagttttacgacttaaccgtttattacgttactactaaactacttttaacttctacttccgtcttaccgttacgttcgggacggtacggacgtaggtagacgtactacgaaacgtcgtcggtacgtcgtacgacctacgtacttcgtcttacttcgtaccg

SEQ ID NO: 118806 - DNA, 557 bp, Homo sapiens
  misc_feature: GYAE6OF02GUH9G.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctcctgcaaggcttctggaatcaccctcaccgacgtctatatgcactggttgcgacacggcccctggacaagggcttggagtggagtgggatggatcgagcgacttacaagtcggtacaacaactaaacgtatacgaccacaacgaaccctcgagggacagactaccacatacgaccacgagaaccacactaccacgacgcacgacctacacgtaggacctggaacggacgccgtgaacgtactacgtacgacgaccgacggccgtagttacttacggtgtacgacgtagacggtacgtacgggtaattacgtttagtaccgg

SEQ ID NO: 118807 - DNA, 533 bp, Homo sapiens
  misc_feature: GYAE6OF02GHAMV.39.87.H10.1.454.CMB.1.raw
  modified_base (419)..(419): a, c, t, g, unknown or other
  misc_feature (419)..(419): n is a, c, g, or t
  modified_base (493)..(493): a, c, t, g, unknown or other
  misc_feature (493)..(493): n is a, c, g, or t
  modified_base (509)..(509): a, c, t, g, unknown or other
  misc_feature (509)..(509): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctcctgtctgcatctgtaggagacagagtcaccatcacttcgccgggcaagtcagggcaattaaaatgattagctggtatcagcagaaaccaggaaactcgtaaggtcctagatctatgatgcctacgtaggtttaggaaaggtcgggtaccccaagtcgtaacgggttcaaggcggacgtaggtggatcgtagggaactaggtactttcactctacacctatcaccagcctgccgctagaagtntttgactaatttattactagtactaataatttaactcttatcctctctacgttcggacggtacggacaggtganatacgaaacgactggnacgtgactactatctgtctagtcc

SEQ ID NO: 118808 - DNA, 522 bp, Homo sapiens
  misc_feature: GYAE6OF02FZ4X6.39.87.H10.1.454.CMB.1.raw
  modified_base (450)..(450): a, c, t, g, unknown or other
  misc_feature (450)..(450): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatacgaacggtaacagtggtctcactaaattatagcacagaagtttcgagggcgaggtcacgatgaccaggacacgtcatcaatacagactacagtacgaactagacgacagcgtagacgtatntacgagaccgacggccgtagtatttagtgttcgaggtacgagagtggtaacgttactacgttctattacggg

SEQ ID NO: 118809 - DNA, 746 bp, Homo sapiens
  misc_feature: GYAE6OF02IU97F.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtgggcctcagtgaaggtctcctgcaagtcttcgtggactcaccctcaccgacgtactatatgcacgtggttcgcgacacggccccgtggacgaagggtcttaggaggtggagtgggagtggagtacaacggtaactaggtggttacctcgaaactaaagtttagtacggtactaacgtaaggttaaacgttttaccgggaacgggtacggtacggggtacctaaacccgtagaccggttaaacggaacgggtaacccaccggttacccaaagtaccctaaacgtccgtaaacggtacccttaacgtacgtacggggtaacgtacgggaaggaccggtaaggtcgtaaggtaacggtacgttccgttaaacggaacccggtaaccgggtcccgggttaaccggttaggtttaacgtttttacggttaagggtttaccggtacgggtaacggtaacggttaggttaacgggttaaccgtttaccgtttaacggttttaccctttaagggttaaccggttttaaccggggggggg

SEQ ID NO: 118810 - DNA, 686 bp, Homo sapiens
  misc_feature: GYAE6OF02IUPME.39.87.H10.1.454.CMB.1.raw
  modified_base (266)..(266): a, c, t, g, unknown or other
  misc_feature (266)..(266): n is a, c, g, or t
tcagtcgcactagtcacgaccggtgctcgatttagcagtactgcgttgggtttgggggaggtcagacccactcaggacacagcatggacatgagggtccccgctcagctcctgggcttctgctgctctggctcccaggtgccagatgtgccatccagttgacccagtctccatccctccctgtctgctatctgtaggagacagagtcaaccatctactggccggcaagtcgagggacaattaaaatgtagttagcctagtatcagnaagaaccgaaggaaactacgtaacgtactagatactatacatcgacctcgtagttacggaagttcgggtaccaagtacgtaaggtcacggacgacgtaggtacgtagtacgtacgggacgtaagttagtttaccaacgttcctaaccgtacctaacgtaccaaccgtaccggtcctcgggtacggacccgttaggtaacgttacgttttacgaaccgtttaaactttacgttacttaggtacctaaactttaacgttttaactttaccttaacgttacccgttacttaaccgtttaccgtttacgggtaccgggtaacggtaaaccggaagggtttacgggaactaacggtaacgtaaaccggtacgttaggttaccggactacgaccgtactagtacctttacggtccttagttacccg

SEQ ID NO: 118811 - DNA, 627 bp, Homo sapiens
  misc_feature: GYAE6OF02G3NC2.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatccctccctgtctgcatctgtaggagacagagtcaccatcacttgccggcaagtcagggcaattaaaaatgtatttagcctggtatcagacagaaaccgaagggtaaacctctaaggtcctgatctatgatcgcctccgtagtttaggaaagtcgggtacccatcgaaggttcaggtcggcagtggtatcgtagggactagtatttccactcctacacctactccaccacgtcctggcccggtacctaggtaagttactttcgaaccttaacgttttactttaccgtagttacctaaaacttactttttaactacctttaacgtcccgtactttaccgtaccgtttccgggacgggtaaccggaaccgtaaggggtcgaagtactaaccggaaacgtaacgttcggacggtcgtacgtacccaccgtacttcgttacggttccttaccgtacccg

SEQ ID NO: 118812 - DNA, 616 bp, Homo sapiens
  misc_feature: GYAE6OF02JJOBK.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagaagcctggggcctcagtgaaggtctcctgcaaggcttcgtggaatcaccctcaccgacgtctatatgcacgtggttgcgacacggcccctggacaagggcttgagtggagtgggatgggatacgaacggtaacaggtcgtctacaactaaattatgacacgagtaacgtttcgagggctacgggtcactagtacgaccgacgggacacggtcagtacaagtaccagcctaacagtacggtaacctgaacgcgtacggtactaggacgtacgttcgtacggtaaccgaccgaaccgggtccgttagttaacgttacggtttacggtacggtaacggtaggtaacggtaacgttacggtaacgtttacccgttaccgtttaccggttaacgttacggtttaacgggggg

SEQ ID NO: 118813 - DNA, 668 bp, Homo sapiens
  misc_feature: GYAE6OF02GJHFU.39.87.H10.1.454.CMB.1.raw
  modified_base (206)..(206): a, c, t, g, unknown or other
  misc_feature (206)..(206): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgccagctggtgcagtccggctgaggtnaagaagcctggggcctgagtgaaggtctcctgcaaggctctggaataccaccctcgaccgacgtcctagtactgacctacttggttcgcggaccgacggtccccctgggaaccgaaggggcctttggacggtgggtaacgtggggaatcgggatacgaaacggttaacgaggttcggtacttacgaacgtaaaattacgtacgtacaactaaggtaacgttttcgaaggggtccacggggtccaaccgtagtacgaaccgaacgggacgtaccgtaccgaacgtaccgaacgtaaccgtacgacccttaacgtacgtaacggaacttcggaacgtccggaacggttacggacggtaacggtaccgtacgtaacgtacggaacgtaccggaccgttagtactacgggttcaggtaacgtcgagtacgtacgtacgttacctacgttcttacgtagttaccggg

SEQ ID NO: 118814 - DNA, 907 bp, Homo sapiens
  misc_feature: GYAE6OF02H7MV7.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggcaattaaaatgaatttagcctggtatacagcaagaaaccgaggaaaactccgtaaaggtcctagacttctatgtatcgcctaccgtaggtttacgggaaaacggttcgggtacccagtacgtaaacggttaccgaacgggtccggacgtaagggttacggaacgtttccggtaacggggtaccgtaagttaaaccgtttttccgtaaacccgtttacccgtttaaccctaacccttaacgttacccgaaacccccggtaaccgggttccccgtttaccgggaccccggggttacccgttaacggttaaaacggtttacgtttttttaccggaaaccccgtttaaaacgttttttaaccgtttttaaacccgttaccggttttaaaccctttaaaaaccgtttaaaaccgtttttttaaacctttttaacccgtttttaaaccgttacccccggtttaacccgttttacccgtttaacccggttttttacccgggggaacccggggttaaacgggggaaacccccggtttaaaagggggttacgggtaaacgttaccgtttaaaccggaaaaccggttaaaccggttacggggtacccgggttaccgtaccggttaccctaaccccggttacgttttacccgttaccggttttaccccgtttaccttttaacccccgg

SEQ ID NO: 118815 - DNA, 832 bp, Homo sapiens
  misc_feature: GYAE6OF02HSTSS.39.87.H10.1.454.CMB.1.raw
tcagtcgcactagtcacgaccggtgctcgatttagcagtactgcgttgggtttgggggcatcacccagcaaccacatctgtcctctagagaactcccctgagagctccgttcctcaccatggactggacctggagcacttccttttcgttgggtcggcagacaaacaacgaggtcgccccacctcccgtaggttcagcgttaggtaccaggtcgtagggagcgtaggagatggaacgaacggcccggtcggggccctacgacggtaggaacggttcctccgtgacgaaggtcttcgttaggttacctaccctttaaccaactagttacggtattacgtaggttgggtcgaccgacggtaccggccccgtagggaacgtaacggggtcttagggtaggtacgggagtggggacgtgggatccgaggaccgttacgtaagtaacgtcggtacctaaaccgaaaccttaaacgtacgtacgaaccaacgtaaaccgtaaccccgtcgggaacggggtactaacggggtaactaccccgaaacccgtacgtaacccggaaaaccaaccgaaacggtaaaccacccgaacctacccggaaaccggaacggttaccccggaacccgtacccgtttaaaccgacggttaccggtaacccggtagggaaccggggtacccgttaccggtagtaaacgtacgttaccggcgggaaaccgacccgggttaccgggtcttacggttacgttaccggtggtaacggacggtacggtaacggtacgggggtttaaaggttaactttttacggtaacggccggttttacccgtacccgttttacgg

SEQ ID NO: 118816 - DNA, 580 bp, Homo sapiens
  misc_feature: GYAE6OF02HS05F.39.87.H10.1.454.CMB.1.raw
  modified_base (373)..(373): a, c, t, g, unknown or other
  misc_feature (373)..(373): n is a, c, g, or t
  modified_base (483)..(483): a, c, t, g, unknown or other
  misc_feature (483)..(483): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtgggcctcagtgaaggtctcctgcaaggcttctggaactcaaccctcaccgacgtctactatgctactggttcgcgacacggcccctaggacgaacggtcttggagtggagtgggatggataccgaaacggtaacacggtggtctacactaaattncgactacagtagttacgagggtacgtacgggtcacgagtacggaaccgacgggactacgtccatccgaaatacgacgtaccgtacgagtacgaacgtgacgtacgaggtnacgagtactcgagacgacgtacggtcttagttagttagtcggtagtacgtaagtagtagtacgtaacgtcgttaccgttacttagtacgttacgggg

SEQ ID NO: 118817 - DNA, 588 bp, Homo sapiens
  misc_feature: GYAE6OF02HNPAU.39.87.H10.1.454.CMB.1.raw
  modified_base (304)..(304): a, c, t, g, unknown or other
  misc_feature (304)..(304): n is a, c, g, or t
  modified_base (387)..(387): a, c, t, g, unknown or other
  misc_feature (387)..(387): n is a, c, g, or t
  modified_base (469)..(469): a, c, t, g, unknown or other
  misc_feature (469)..(469): n is a, c, g, or t
  modified_base (497)..(497): a, c, t, g, unknown or other
  misc_feature (497)..(497): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactggaggtgaagaagccgtggggcctcgagtgaaggtctccgtgcaaggcttcgtggaactccaccctcaccgacgtctatatgctacgttggttcgaccggacnccgggtcccccgtagggaccgaagggtcttggaggtggagtgggatggatacgtaacggtaatggtgtactacaactaattangacaagaagtaagttcgagggtcgtacgggtacacgtagtcggaccgagggacctacgtaccatacaagtacacgtcctaanagtacgacgtgacgacgaggtatagganacgtcgtacggaccgtaacgtacggtcgttagtactttaggtggacgagaagtagtagtagtacgttactcttactagttaggttacgggg

SEQ ID NO: 118818 - DNA, 560 bp, Homo sapiens
  misc_feature: GYAE6OF02GE746.39.87.H10.1.454.CMB.1.raw
  modified_base (345)..(345): a, c, t, g, unknown or other
  misc_feature (345)..(345): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccgggcaagtcagggcaattaaaaatgtatttagcctggtatcagcaagaaaccagggaaacctccgtaaggtcctgatctatgatcgcctctagtttaggaagtcgggtaccatcaaggttcagcggnagtggatcgtagggacagtattcactctacacataccaccagcctgccgtctagaacgtatttagacttaactttacttactgtactaaacttaattttaacttcttactccgtcttacgtacgtttacgggacggtacgggacgtaagggtaggatacgtacgaaacggtacgttggtcgtactacgacaccgtattcgtacttcttactaccg

SEQ ID NO: 118819 - DNA, 635 bp, Homo sapiens
  misc_feature: GYAE6OF02H74Y5.39.87.H10.1.454.CMB.1.raw
  modified_base (408)..(408): a, c, t, g, unknown or other
  misc_feature (408)..(408): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccgaggtgcagctggtgcaggtccgggactggaggtagaagaacgccgtcggggcctcgaggtggaacggtctccgtgcaaggtcttcgtaggaactcaccctacgaccgtacgtactactatcgactacgtggttcgacgacgacggcccgtaggaacgaggtcttgaggtgagtggagtggatacgaacggtaacgagtggtactacaataaagttagagcgtaaaaaaaagngtaaacgtttcggacgggacgtacggtaccgactagtacggaacggacgggtacgaccgtacgtaactacgaacgtacgaacgtacctacgtaagtacgtaactacgaacgacgagacgtacgagagtcgtacgaccgacgtacgtaccgtagttagttacgtggtacgacggtaggtaggtagtagtaacgttacttaccgtttacgtacgttaggtttaacgggg

SEQ ID NO: 118820 - DNA, 750 bp, Homo sapiens
  misc_feature: GYAE6OF02IMYTF.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccataccacttgccggcaagtcgagggacaattaaaatgtatttacgcctaggtactcgagacgaacgaaaccaagggtaaaacctccgtaacggttacctgtaattactacgtagtaactcggtaccctacgtaggttttaaccgggaaaggtttccggggtaccccgtaagtaccgtaacgggttccgtaggacggtaccgtagtagggtacgtacggttacgggaacgtaagtacttttaccacttccgtacctacctctaacccgtaccgaccggtcccgtggtacccgggactttaacggtaagttacgtttttcgaccctttaaaagttttactttaaccggtcgttaacctaaacttttaaagttttacctttacctttacggtacccctagttccccttaacgggttttaccgggaacgggtaaccgggtaaccgtaagggttacggacgtaaccgttaaccgaaaccggttaacgtggttaccggaccgttagtacccaacggtccgttaacgttccgttactcccgttaacccg

SEQ ID NO: 118821 - DNA, 725 bp, Homo sapiens
  misc_feature: GYAE6OF02GUI8U.39.87.H10.1.454.CMB.1.raw
  modified_base (374)..(374): a, c, t, g, unknown or other
  misc_feature (374)..(374): n is a, c, g, or t
tcagtcgcactagtcacgaccggtgctcgatttagcagtactgcgttgggtttgggggcgatcacccagcaaccacatctgtcctctagagaatcccctgagagctccgttcctcaccatggactggacctggaggatcctcttcttggtggcagcagccacaggacgcccactcccaggtgcagctggtgcacgtccgggactgagggtgaagaagccgtggggcctcgagtaggaaggtcctctggacgaacggcttcgtaggaatccaccctcaccgacgtctatatgcactggttgcgacgacggccccgtaggaccgaagggcgttggaggtaggagtgggacgtagggactacggaaacggtaaacgngggttacggtctaaccgaactaaaacgtttgtacgacgaacgttaaacgggttaacggtttacggaacggggtacgtacggggtaccctaaacgtgtacggaaacccggacgggtaaccgtaaccgtaccctaagttaacgaaccgttaaacgaccgtaaccgtaccgtaaagtaccgggtaaactacgggaacgaccggtaagggtacgttacgaaagttaccgtaccgttacgaaaccggtaccggaccggggttacccgttagttaagtttaccggttggtaccgggacgaagggtaacgtagtaggttaccgttaccgtactttacgttacgtacggtttaacgggg

SEQ ID NO: 118822 - DNA, 606 bp, Homo sapiens
  misc_feature: GYAE6OF02HZR2I.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactccccaggtgcagctggtgcagtccgggactgaggtgaagaagccgtggggcctcagtgaaggtctctgcaaggcttctggaactcaccctcaccgacgtctatatgcacgtggttgcgacacggcccctggacgaaggcttgaggtggagtgggatggatacgaacggtaacaggttcggtacctacaacgtaaaatttagtacgacaacgtaaaggtaacggtttacgaggggacgtaggggtaccaaccgagtcggaaccgacgggactaccgtacatacaaataccacgtacctacgactaggaactagggacacgacggtcgtagaacgagttccgaggaccgaaccgacgggtaccttaggtattacgtggtggacggaagtagtagtcggaagtttccgttacgtttacttacgttaggtttacgggg

SEQ ID NO: 118823 - DNA, 574 bp, Homo sapiens
  misc_feature: GYAE6OF02JZ7BJ.39.87.H10.1.454.CMB.1.raw
  modified_base (228)..(228): a, c, t, g, unknown or other
  misc_feature (228)..(228): n is a, c, g, or t
  modified_base (341)..(341): a, c, t, g, unknown or other
  misc_feature (341)..(341): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
tcagtcgcactagtcacgaccggtgctcgatttagcagtactgcgttgggtttgggggcgatcacccagcaaccacatctgtcctctagagaatcccctgacgagctccgttcctcaccatggactggacctggaggatcctcttcttggtggcagcagccacaggagccccactcccaggtcgcagctggtgccagtccgggatgaggtgaagagcctggggccctnagtgaggtctcctgcagctctggatcgacctcaccgacgtctagtatgcactggttagcgacgacgccctggacgaaggcttggagtggatgggactggactcgaacggtacngtagctacgataatntgcanagtaagttcgaagggctagggtcacgctacgacgaggaccacgtccgaataccaagtacgacgtaccgtaagtacgtaccggaaacttcggaacgtcgaacgggtaccaggtaaacgacgttaccgtacggaaccaaccggacgtacggtgttaagttacggtgtacggtacaacgtagataggtacgtacttcgtacctagtagttacgggg

SEQ ID NO: 118824 - DNA, 793 bp, Homo sapiens
  misc_feature: GYAE6OF02JWYPP.39.87.H10.1.454.CMB.1.raw
  modified_base (170)..(170): a, c, t, g, unknown or other
  misc_feature (170)..(170): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttcgacccagtcnccatcctccctgtctgcatctgtaggagacagacgtcaccatctaccttggacccgggcaacgtcggagggactaaattaaaaagttcgtaatttacggcgttagtattacgaacgacaaacgaaaccgaagggtaaaacctaccgttaaggtacctgaacttctaatacgattcgcccgttagttaaggttacggtaaacgggttcgggtacccaatttaccggtaacggttaccggaggtaccggggtaccgtaggttacgggtacgttacggtacgggaactttaccgtaatttttcccaaaccggtttccctaacctacccgtaaccgtaccctaaccctaccggtacccggttacgggtaccggtacccggttaacgggttaacgtttaggttttaacgttaccgttaaacgtttaactttacgttaaccgttaaaccttaaactttaaccgttttaaactttaacgtttaccgttaccgttaccttaaccgttaccggtttaccgggtaccgggtaacggtaacggtaacggtagtacgtacgtaacgtaacggtacgttagacgttttttacgaccgtacgtaccgtaccgttacgtacgttacgttacttacccg

SEQ ID NO: 118825 - DNA, 740 bp, Homo sapiens
  misc_feature: GYAE6OF02HBAK1.39.87.H10.1.454.CMB.1.raw
  modified_base (180)..(180): a, c, t, g, unknown or other
  misc_feature (180)..(180): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtnccagctggtgcagtccgggactgaggtgaagaagcctggggcctcagtgaaggtctcctgcaaggcttctggaactcaccctcaccgacgtctatatgccactcggttgacgtacgacggcccccgtggtaccgaagggtccttggagtacggattgggatgggacttcgaaacgggtaacaggtcggtacttaccgaactaaaagtttacgtagtaccgaactaaggtaaaggttttccgaacgggggtaccctaaaggggggttccctaaacccgtacggtaacgggtaaccccggtaacggggtaaaccctaaccggttacccgaattaccctaaaacgttaacctaaacggtacccttaaacgtaagttaccgggtaaaacttcggaacgtaccggaacgggtacccgttagggaacgttacgttaccgtacggtaaccgtaaccggaccgggttacccgtacggttaacgttttaccgtttgggtaacggtacggtaacgtaagtagttacggtacgttaaccgtttacgttaccgtttacgtagtttacggggg

SEQ ID NO: 118826 - DNA, 730 bp, Homo sapiens
  misc_feature: GYAE6OF02IAGRW.39.87.H10.1.454.CMB.1.raw
  modified_base (296)..(296): a, c, t, g, unknown or other
  misc_feature (296)..(296): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcgagggctaattaaaatgtatttagcctggtatcagacaagaaacaggaaactcctaagtcctagatctangatcgctctagttaggaagtcgggtaccagtacgaacggttcgaacggtcggacgaggtacggtacgtcggtagggacctaagtatttccgactacgtaccctaaccacttacccgaacccgacgtacccgtcggacccggtcctaacggtaaagttacgttttttagaaccgtttaaacttttacgtttacgttacgttaacctaaacgtttaaactttttaacttttaccttaaccgttacccgtacctttacccgtttaccggttttaacccggggtaccggggtaaacgggtaaacccggttaaggggtacggtaaacggttaaccgttaaccggaaaaaccggttaccgttaagggttaccggttacccgtacggtaaccctacccgttaagtttcccgtttaacgtttcccgtttaccgttaaccccg

SEQ ID NO: 118827 - DNA, 745 bp, Homo sapiens
  misc_feature: GYAE6OF02JX5BW.39.87.H10.1.454.CMB.1.raw
  modified_base (192)..(192): a, c, t, g, unknown or other
  misc_feature (192)..(192): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtgcagctgggtncagtccgggactggaggtgaagaagccgtggggcctcgagtggaaggtctccgngacagcttcgnggaactcaccctcaccgtacgtctatactgactacgttggtcgcgacgacggccccgtggaacgacgggtcttaggaaggttcggagtacgggtagtggtataccgaaacggtaacagggtttcggtacctaaccgtaaacgttaaaatttacggtacgtaaccgaaacggttaacggttaaaacgtttccgggaacgggttaccggaaccggggtttaaccgaacccgtaacggttaaccggaacccggtaaacgggtaacccgtaaaccggtacccgtaacgtaaccgtaaacgttaacgaaccgtaccgtaaaccgtaagttaaccggtaacgtacgggtacggtacgtacgggtaccgttaggtaaccggtaacgtacgtacggaaacggacccgtacggttcgggttactttaaggtacggttagtacggtacggtacgtaaggttagtacgtaacgttacttacgttacgtacgtttacggg

SEQ ID NO: 118828 - DNA, 548 bp, Homo sapiens
  misc_feature: GYAE6OF02F39YL.39.87.H10.1.454.CMB.1.raw
  modified_base (360)..(360): a, c, t, g, unknown or other
  misc_feature (360)..(360): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatccaccctcaccgacgtctatatgcacgtggttgcgacgacggcccctggacaagggcttgagtggatgggatggatcgaacggtacagtggtctacaacaaattangacaacagtaagtttcgagggcagggtcaccgagtagaccgagggacacgtccatacaatacagacctacatggaactgagcgaggctagagtatcgtacgacgacgacggtacgtagtattagttggtacggacggtagaagtagtcggtaacgttaccgttcgtttacgtacgttaggttacgggg

SEQ ID NO: 118829 - DNA, 895 bp, Homo sapiens
  misc_feature: GYAE6OF02JTQ2Q.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctgggcttctgctgctctggctcccaggtgccagatgtgccatccagttcgacccagtctccatcctccctgtctgcatctgtaggagacagagtcaccatcacttgccggcagtcagggacaattaaaatgtatttacgccttggtaatcagacaacggaaaccgaacgggaaaactaccgtaaacggtcccgtagtattctaacgtagaagtcgacccgttcgtaaggttttacggaaacggttccgggttaaccccgtaagttaaccgtaacgggttaccgtaacggtaccgggtacgtaacgggttacgggtacgtacggttacggggtaaccgtaacgttaacgtttttacccgaaaccgtttcccggttaaccgaaacccctttaaccgtaaccctaaacccggttaaaccggccccccgttaacgggggttacccccgggttaacccgtttaagggtaaaaccggtttttaacgtttttaccgggtaaccctttaaaaacccggttttaagtttaacccgtttaaccggtaacctttaaaaccggttttaaaacttttttaacccgtttaccttttaaccggttaccccgtaaccgttttaacccggttaaccggttttcccggggaaaacccggggtaaggttaacccggttaaaaggggtcgttaaacgtaaccgtaaccgttaaaaaccgggttaaccggttggttaaccggtaccgttaaccggtaacttaacccggttattacccggtttaacggttccctttagtaacccccg

SEQ ID NO: 118830 - DNA, 579 bp, Homo sapiens
  misc_feature: GYAE6OF02GYB3D.39.87.H10.1.454.CMB.1.raw
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (395)..(395): a, c, t, g, unknown or other
  misc_feature (395)..(395): n is a, c, g, or t
  modified_base (573)..(573): a, c, t, g, unknown or other
  misc_feature (573)..(573): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacttgccggcaagtcagggcaattaaaatgtatttagccgtaggtatacgagacaagaaaccgaagggaaaacctccgtaacggtcctagactctatgatcgcctcgtaggttaggaagtcgggtacccagtacgtaaggttcaggcgacgagtgatcgnggacagtnttacactctacaccanccaccacgcctcgcggtactagtaagttatttacgacttaaactttacttactacgttactaaacttaatttaacttccttacgtacctcttacgtacgtttcgggaccggacggaaccgtaggtagacgtactaacgaacgtatggtgtactacgaccacgttatacgttcgttacnctaccg

SEQ ID NO: 118831 - DNA, 687 bp, Homo sapiens
  misc_feature: GYAE6OF02HNTWA.39.87.H10.1.454.CMB.1.raw
  modified_base (601)..(601): a, c, t, g, unknown or other
  misc_feature (601)..(601): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccacctcccaggtgcagctgatgcgagtccgggactggaggtgaagaagccgtggggcctcgagtagagtctccgtgcgaggcttcgtaggaactccacccctccgaaccgtaccgtcgtaatacgtcgactaccgtggttcggaccgacgaccgggcccccgtgggaaccgtaagggccttggagtcggagtagggagtggtataccggaaacggtaacgtaggtcggtctacgaactaaagttagtacgacaacgtaagttaacgttacggacgggtaccgtacggggtacccacgtaagtaccgggaaccgaacggggtaacctaacccggttaccaactacgtaaacgttaaccgacgtacccgtaacgtatacggtaaccgtgggaacggaccgtacggtctaggtacggataccggacgacggaacnccggtcgttaagttacgtttggtacggtcgtaagggtagaaggtcggtttaacgaagttaccttacttacgggttaacttacgggg

SEQ ID NO: 118832 - DNA, 514 bp, Homo sapiens
  misc_feature: GYAE6OF02FFVO2.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcacctcaccgacgtctatatgcactggttgcgacaggcccctggacaaagggcttgacgtggatgggatggatcaacggtacagtggtctcacaaattatgacacagaacgtttcgagggcagggtcacgatgaccgagggacacgtcccagtacaataccagcctaacatggaactgagcaggctgagtatctgacgacgaccggtccgtgtattagttcgtgacgagtagatgacgttactcttactactattcgggg

SEQ ID NO: 118833 - DNA, 617 bp, Homo sapiens
  misc_feature: GYAE6OF02G8P6H.39.87.H10.1.454.CMB.1.raw
tcagtcgcactagtcacgaccggtgctcgatttagcagtactgcgttgggtttgggggagtcagacccactcaggacacagcatggacatgagggtccccgctcagctccgtggggcttctgctgctctggctcccaggtgccagatgtgccatccagttgacccagtctccatccctccctgtctgcatctgtaggagacagacgtcacctatcacttcggccgggcaagtcgagggactaagttaaaatgtatttagccttaggtatacagacaacgaaaccgaagggaaacctccgtaacggtcctagattctagtgatcgtcctacgtaggttaggaaaggttcggggtacctagtacgtaaggtcaggacggcgtaggtgtagtcgtagggactagtacttcgacttccactacctactaccacacgccctaggccgactagtattacgtttcgacttaacttatactgtaactaacttaatttatacgttactcgtacttctacgtttccgggacggtacggtacgtaaggtacgtacgtacgtaacgaacggttagtacggtaggtacccgtagaccgtaactcgttacgttcttacgtaccttaacccg

SEQ ID NO: 118834 - DNA, 578 bp, Homo sapiens
  misc_feature: GYAE6OF02HVWPK.39.87.H10.1.454.CMB.1.raw
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctctgcaaggcttctggaatcaccctcaccgacgtctatatgcacgtgttgcgtacacggtcccctggacaagggtcttaggagtggatgggatggatacgaacggtaacnggttcggtctacactaaattanggacaacgagtaagtttccgaagggcctaagggtaccaccgaagtcgaacgacgggacacgtaccataccaagtaccacgtacctaacgatacggaacctggaacgccgaggacgtagagtactcgtacgacgacgcggtacgtgttagttacgtggtagaccggtagacgtagtggtaacgttaccttcgttaacttacgtagttacgggg

SEQ ID NO: 118835 - DNA, 611 bp, Homo sapiens
  misc_feature: GYAE6OF02JXEX9.39.87.H10.1.454.CMB.1.raw
  modified_base (367)..(367): a, c, t, g, unknown or other
  misc_feature (367)..(367): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagccccactccccaggtgcagctggtgcagtccgggactgaggtgaagagcctggggcctcagtgaaggtctcctgcaaggcttctggaatcaccctcaccgacgtcatatgcactggttgcgacgacggccccgtggacaagggtcttaggagtggagtgggatggatcgaaacggtacaggtcgtctacaactaaattagngacaacgagtaagtttacgagggtcgacgggtacacgtagtcgaacgagggacaccggtaccagtacaagtacgacgtacccgtaacgtagtacggtaacctggaacgacgacgggtcgtaggaacgtacgttccgacggaacggaccgtaccgggaccgtttagtacgttagttcggagtaccggtaagtaggtacgtacggtaacgttacgttaccgttacgttacgttaggttaaccgggg

SEQ ID NO: 118836 - DNA, 850 bp, Homo sapiens
  misc_feature: GYAE6OF02G4MSG.39.87.H10.1.454.CMB.1.raw
  modified_base (165)..(165): a, c, t, g, unknown or other
  misc_feature (165)..(165): n is a, c, g, or t
  modified_base (187)..(187): a, c, t, g, unknown or other
  misc_feature (187)..(187): n is a, c, g, or t
  modified_base (210)..(210): a, c, t, g, unknown or other
  misc_feature (210)..(210): n is a, c, g, or t
tcagtcgcactagtcacgaccggtgctcgatttagcagtactgcgttgggtttgggggcgatcacccagcaaccacatctgtcctctagagaatccctgagagctccgttctcaccatggactggacctggaggatcctcttcttggtggcagcagccacgaggngcccactccaggtgcagctggngcagtccgggactgaggtggaanagccgtggggcctgagtgaaggtctccgtgaccgaaggtcttcgtagggaactccaacccgttccgaaccggtaccgttactacttaacgttcgtaccgtaacgttcggggtttacgacccggtaaccgtaaccggggcccccgttagggaacccgtaaacggggtccgtttaggtagggtacgggtagttaggggtacgtgggaacgtaccgtaaaacgggtaactagggttacggttacgtaccgtaaacgtaaacgtttaacgttacgaccgtaacgtaacgggtaacgttttaccggaaggggaccggttaaccggggtaccgtaaacccggtacgtccggttaaaccccgggaacggggtaccctaaccgggtaacccgtaaccggttaacctaaaccgttaaccgtaaaccgggtaccccgttaaacgtaaccggtaacggtaaccttagggaacgtcggaacggtcggtagacggtaacgtccgttaacggaacgtaaccggttaaccgggaccgtttacggtaagttttacggttacggtcgggtaaccgggtaacggtaacgttacgggttaacggtaacggtttaccgttaccggtttaccgtttaggttaaccgggttttaacgggggg

SEQ ID NO: 118837 - DNA, 681 bp, Homo sapiens
  misc_feature: GYAE6OF02IJPDQ.39.87.H10.1.454.CMB.1.raw
  modified_base (435)..(435): a, c, t, g, unknown or other
  misc_feature (435)..(435): n is a, c, g, or t
  modified_base (566)..(566): a, c, t, g, unknown or other
  misc_feature (566)..(566): n is a, c, g, or t
tcagtcgcactagtcacgaccggtgctcgatttagcagtactgcgttggggtttgggggcatcacccagcaaccacatctgtcctctagagaatcccctgagagctccgttcctcaccatggactggacctggaggatcctcttcttgggtggcagcagccacaggacgcccactcccaggtgcagctggtgcaggtccgggactgaggtgaagaagccgtggggcctgaggtgaaggtctcctgcaaggtcttcgtaggaactccaccctcgacccgtacgtctaatcgtcgaccgtacgttggtcgccggaaccggaccgggtccccgtagggaaccgtaacggggtccttggacggtacggaggtggggtatacgggtagtaccggaaacggtaaccgtagggttacggtactaccgtaaacttaaacgttntacggtactaacgtaagttaacggttacgggacgggtacggtacgggtccaaccgtaggtaccggaacggtacggtaacaccgtacaagtacgaaacgtacctacgtaccctaagacgtaggtacgtacgngtacgaggtctagactagtacgtaacggacgtaacgtccgggtattagttagtagtcggtcggtagagttagtagtacggttgttaccttcgtttacttacggtggttaacgggg

SEQ ID NO: 118838 - DNA, 653 bp, Homo sapiens
  misc_feature: GYAE6OF02GK1ZW.39.87.H10.1.454.CMB.1.raw
  modified_base (229)..(229): a, c, t, g, unknown or other
  misc_feature (229)..(229): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
tcagtcgcactagtcacgaccggtgctcgatttagcagtactgcgttgggtttgggggcgatcacccagcaaccacatctgtcctctagagaatcccctgagagctccgttcctcaccatggactggacctggagatcctcttcttggtggcagcagccacaggagcccacgtcccaggtcgcagcctggtgcaggtccggactggaggtgaagaacgcgtggggcctnacgtagagtctctaggcaaggcttgtgaatccacctcacgactnatgtnctacgtggttcgactaaccgcggcccctaggaacgaagggtccttggaacggtggaacgttgggacttgggaacttcggaaacgttaacgtaggtcgtactaacgaactaaagttacgtcgacaacgtaaggttaacgtttcgacgggactacggggtacaacccgtagttacgaaccggacggactaaccggtaactagtaacaacgtacgacacttaacgagtacggaatacgagtacaggtacgtagagtacgtcgtaacgtacgaccgtacggggtaccttacggttaagtaccggttggttaccggaacggtagtaacggtaactcggggtaatttcccgatttaaccgtttacgtacggtttacggggg

SEQ ID NO: 118839 - DNA, 691 bp, Homo sapiens
  misc_feature: GYAE6OF02GD9VZ.39.87.H10.1.454.CMB.1.raw
tcagtcgcactagtcacgaccggtgctcgatttagcagtactgcgttgggtttgggggagtcagacccactcaggacacagcatggacatgaggggtccccgctcagctccgtggggcttctgctgctctggctcccaggtgccagatgtgccatccagttgacccagtctccactcctccctgtctgcatcgtgtaggagacagacgtccaccactcacgttcggccgggacaacggtcgagggactaaattaaaagtgtaattacgccgtaggtactacgagacaaacgaaaccggaagggtaaacctccgtaacggtcctagtaacttactagtgtatcgtacctacgtaaggtttacgggaacggttcgggtacctagtacgtaaggttcgacggtacggagtaggtaggacgtcggtagggaactacggttacttttaccgacttacctaccaaccgtactaccgaccgtagcccgtcggacccggttactaggtaacgttcgttagaaccttaagtttaacttacgttattaactaaactttaattttacttaccgttacgttccgtacttaccgttacggttaccggggacgtaacggaacgtagggtagaacgaacgtaacggtaaacgtacgtcggtacgtccgtaagaccctacgtacttcgttacgtttaccctagtccc

SEQ ID NO: 118840 - DNA, 756 bp, Homo sapiens
  misc_feature: GYAE6OF02J1AID.39.87.H10.1.454.CMB.1.raw
  modified_base (708)..(708): a, c, t, g, unknown or other
  misc_feature (708)..(708): n is a, c, g, or t
  modified_base (748)..(748): a, c, t, g, unknown or other
  misc_feature (748)..(748): n is a, c, g, or t
tcagtcgcactagtcacgaccggtgctcgatttagcagtactgcgttgggtttgggggagtcagacccactcaggacacagcatggacatggacgggtccccgctcagctccgtggggtcttctgctgctcgtggctcccgaggtgccagatgtcgccatcctagttcgacccagtcctccactccctccctgtctgcatcgtaggtaggagacgagtacgtacaccatcgtacgtcggccgggactacgtacgagggactaaattaaaagtgttaatttagcgttaggtactacgagacgaacgaaacgaacggtaactacgtaagtctagactacgtatgactcgtaccgttcgtaggttacggaacgggtcggtacctaggtacgtaggttacgacggcggacgtaggtacggacgttacggtacggagtagttacgttactacctcctaacctaaccgtcgaacctacccgtcggtacccgtacgggtccggtaaaccgtttacggtaaacgtttacgtttacgtaaccgtttaaaaccgttttacgtttaaccgttaccttaaaacccgttaatttttaaaacctttttaacgtttaccctaaccgttcccgttacgtttacccgtttaaccgggtttaccgggaaccgggtaaacgggtaccgttaaggggtacgacgttaaacgaccgttaaacggttcgngggttaccgctaccggactaacgtccttagcctttaccgngtttaccc

SEQ ID NO: 118841 - DNA, 614 bp, Homo sapiens
  misc_feature: GYAE6OF02GT5BJ.39.87.H10.1.454.CMB.1.raw
  modified_base (222)..(222): a, c, t, g, unknown or other
  misc_feature (222)..(222): n is a, c, g, or t
  modified_base (300)..(300): a, c, t, g, unknown or other
  misc_feature (300)..(300): n is a, c, g, or t
  modified_base (376)..(376): a, c, t, g, unknown or other
  misc_feature (376)..(376): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactgaggtgaagagccgtgggcctnagtgacggtctccgtgcaaggtcttcgtaggaatccaccctcaccgtacgttctatactgcctacgtggttcgcgacncggcccctaggacgaaggtcttggagtggagtgggtatggactacgaacgttacgaggtagtctacaataaattancgacaacaggtaacgttacgagggtactacgggtacaacgtagtacgaaccggaggacaccggtactacgtacaactacgactaccgtaactagtacggtaactagacgtacgaacggtcgtacggaacgtacgtctaacggaccgtaacgaccgggtacttgttaacgttacgtcggtaggacgacgtacgtagttacgtagttaccgttcgttaacgtaccgttaggttaccgggg

SEQ ID NO: 118842 - DNA, 760 bp, Homo sapiens
  misc_feature: GYAE6OF02J1AKN.39.87.H10.1.454.CMB.1.raw
  modified_base (394)..(394): a, c, t, g, unknown or other
  misc_feature (394)..(394): n is a, c, g, or t
  modified_base (454)..(454): a, c, t, g, unknown or other
  misc_feature (454)..(454): n is a, c, g, or t
  modified_base (692)..(692): a, c, t, g, unknown or other
  misc_feature (692)..(692): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtcgccagatgtcgccatcccgtagttcgaccctagtcctaccatccctccctgtctgacatctggtaaggagacaggtatccaaccgatctaaccgttcggacccggggtactaaacggtccgaaggggtaacctaaaatttaaaaaacgttgttaagtttaacggccttagggtaactacgacggtaccgaaacggaaaacccgtaaaaggggtaaaacctaccgtaaaggttaccctaggtaactacctttagngtaactcgtcctaccgtaaggtttagggaacggttacgggtacccagtacgtaacggtanaacggcggtactggtacggtatcggtaggactaagtacgttcctacgtcctactaacacaccgtaccgacgtacccgtggaccggtacgtacgtaaagttcttacgaccttaaacgtttaacttacgtacgtaactaaacttttaatttaacgtttaccttaacgttacccgtacgttttaacctaaccggttttaccggaaacgggtaaaccggtaaccgtaaggggttaaccgtanaacggtaactaaaccgtacgtagggttacgacgtaacgcttaaccagttactacgtactaccgtaacc

SEQ ID NO: 118843 - DNA, 665 bp, Homo sapiens
  misc_feature: GYAE6OF02HEGD5.39.87.H10.1.454.CMB.1.raw
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (315)..(315): a, c, t, g, unknown or other
  misc_feature (315)..(315): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagtccactcccaggtgcagctggtgcagtccgggactggaggtgaagaagccgtggggcctgagtgaagtctctgcaaggcttctggaatcaccctcaccgacgtctatatncagtgttcgcgacncgccccgtggacgaaggtcttaggngtggagtgggagtggactacggtaaacggtaacgtaggttcggttactacaaacgttaaattacgtagactaacgtaaggttaacgtttacggaagggaccgtacgggtacctacctagtacgaaccgacggggtaacctacggtacccaagtaccaacgttaacgactaccgtaacagttacgaacgtggtaacgaccggtaaggcgtaaggacgtaagtccgttacggaaacggaccgttacgggaccgttacgttaagttcgtttaggtacggtaacgggtacgtaaggtaacgtcggttaaccgttaccgtttacgttaccgtttaaggtacggttttaacggggg

SEQ ID NO: 118844 - DNA, 637 bp, Homo sapiens
  misc_feature: GYAE6OF02HGGDJ.39.87.H10.1.454.CMB.1.raw
  modified_base (301)..(301): a, c, t, g, unknown or other
  misc_feature (301)..(301): n is a, c, g, or t
  modified_base (335)..(335): a, c, t, g, unknown or other
  misc_feature (335)..(335): n is a, c, g, or t
  modified_base (377)..(377): a, c, t, g, unknown or other
  misc_feature (377)..(377): n is a, c, g, or t
  modified_base (449)..(449): a, c, t, g, unknown or other
  misc_feature (449)..(449): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccaggtgcagctggtgcagtccgggactggacggtgaagaagccgtggggcctcagtgaaggtctcctgcaaggtcttcgtggaactcaccctcgaccgacgtactatatgctacgtggttgcgacncggccccgtggacagggtctggagtggagtgggntaggatacgaacggtaacgaggtcggtctacaactaaattancgtacaagacgtaaggttcgggacgtacggtacacgagtacgaccgaaggactacgtacactacgaactacncgtaacctacagtacggacagacgcgacggtcgagagtaactcgtacgaaccggacggtaccgggtacgttagtttacgttaggtttacggtaacggaccggtaaagggtaaccgttaggtaccggttaacggtttacccttacggttttacctacggtttaacggggttggggttttaaaccggggg

SEQ ID NO: 118845 - DNA, 837 bp, Homo sapiens
  misc_feature: GYAE6OF02HXAWR.39.87.H10.1.454.CMB.1.raw
  modified_base (363)..(363): a, c, t, g, unknown or other
  misc_feature (363)..(363): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagccgtggggcctcagtgaaggtctccgtgcaaggcttcgtggaatccaccctcaccgtacgtctatatgactacgtggttcgcgacgacggccccgtaggaaccgaagggtcttggaggtggagtgggagtaggactacgaaacggtaacnggtcggtctacaactaaattagtcgacaacgtaaggtaacgtttacggacgggtcgtaaggggttaccaaccgtaagtaccgggaaacccggaaacggggtaaccgtaaccggttaccctaaacgttaaccggtaaaacgttaaacccgtaacggttacccccttaaaccggtaaacggttttaacccgggaaaaccggttacgggtaaaccgggtaacccggtaaccggggtaacccggtttaaaggggaaaccggttaaccgtttaccgggttaaaccggggtaaacccggaaaccccgggttaacccggggttaccccggttttaagggtttaacgtttttaaccgggtttacgggttaaccgggaaccgggttaaacggtaaccgggttaagttaaccgggttaaccggttttaacccgtttacccggttttaaaccgtttaacccggttaacgggttttaaccgggggg

SEQ ID NO: 118846 - DNA, 783 bp, Homo sapiens
  misc_feature: GYAE6OF02JW69C.39.87.H10.1.454.CMB.1.raw
  modified_base (163)..(163): a, c, t, g, unknown or other
  misc_feature (163)..(163): n is a, c, g, or t
  modified_base (273)..(273): a, c, t, g, unknown or other
  misc_feature (273)..(273): n is a, c, g, or t
  modified_base (752)..(752): a, c, t, g, unknown or other
  misc_feature (752)..(752): n is a, c, g, or t
tcagtcgcactagtcacgaccggtgctcgatttagcagtactgcgttgggtttgggggagtcagacccactcaggacacagcatggacatgagggtccccgctcagctcctgggcttctgctgctctggctcccaggtgccagatgtgcatccagttgacccngtctccatcctccctgtctgcatctgtaggtagactagatcaccatccactcgaccggcaagtcgagggcaaagtttaaaacgtagtacgtttagccgttagggtactanacgactaagaaaaccaacggggtaaaacctcctaaaccgggttccctagtacttaccgtaatggaattcggccccttaccgtaagggttttaacgggaaaggttccgggggtacccctaagtaccgttaaacgggtaccgttaacgggtcccggggtaagtaacggttaccgggaaggtttccccggttaaggggaacctaacgggtttacttaacccggtaacttcgtaaccaccttctaacctacccaaccgggtcccgtcgtaccgggtccgttaacgaaacggttttcgtttaaccggtaaccttaaaccgttttaacccgttaacgttacgttaacccgtaaactttaaactttaacgtttcgtttactacccgttcttaccgttaacgttttaccggcgggttaacggtaacccgagttacgggtactaaccggtaacgaaacggttaacctgggtaacgtccgtgttaaccncgaacccgttgttaccttccgttacgtaccc

SEQ ID NO: 118847 - DNA, 719 bp, Homo sapiens
  misc_feature: GYAE6OF02FL2YL.39.87.H10.1.454.CMB.1.raw
  modified_base (163)..(163): a, c, t, g, unknown or other
  misc_feature (163)..(163): n is a, c, g, or t
  modified_base (450)..(450): a, c, t, g, unknown or other
  misc_feature (450)..(450): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccanaggagcccactcccaggtgcagctggtgcagtccgggactgaggtgaagaacgccgtggggcctcgagtgaacggttctccgtgacacggtcttcgtaggaacttccaaccccgttccgaacccgtacgttcgtaattacgtacggcctaacgttgggttcgaccggtaccgaaccgggtcccccgttaggaaccgaacggggtcctttaggaacggttggaacgttcggggagttcgggattaccggtaaacggtaaactaggtggtacctacaacgtaaaatttncgacacgtaagtacgttacgagggtcgtacggtaccaactagtacgaaccggacgggtaacctacggtaccctaagtacctaaagacctacggtaccctaactacgtacgaacgtgtaacggtcggaacggtacttagggaacgtacgttactaacggaacccgtacgtaccggggtccgttaacgttacgtttaacgtcgggtaaggtaccggaaggttaaccggagttacgtaccggttaacttccggttagttacggttaacgggg

SEQ ID NO: 118848 - DNA, 656 bp, Homo sapiens
  misc_feature: GYAE6OF02FZNVP.39.87.H10.1.454.CMB.1.raw
  modified_base (367)..(367): a, c, t, g, unknown or other
  misc_feature (367)..(367): n is a, c, g, or t
  modified_base (390)..(390): a, c, t, g, unknown or other
  misc_feature (390)..(390): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgccagcgtggtgcagtccgggactggaggtgaagaacgccgtggggcctacgagtgaacggtctccgtgcgaaggtcttcgtggaactccaccctcgaccgacgtactatatgctacgtggtcacgcgacggccccgtagggactaagggcttaggaggtgggagtgggatggatacgtaacggtaanagttggtactactaactaaattntacgactagaggtaagtttcggacgggcgtagggtaccaccgtaagtcgaaccggaggtaccgtaccgaccgttaatacgtaaacgtaccgacgtaccttaagacgtacgtaatggacgtacgaggtcgtagagtacgttcgacggtaaccgacgtacccggggttacttacgtttaacggttatttccgggtacggtacggtaacgtagtagttacggtacgtttaccgttaccgtttacgtttaccggttaggtttaacggggg

SEQ ID NO: 118849 - DNA, 708 bp, Homo sapiens
  misc_feature: GYAE6OF02G45PA.39.87.H10.1.454.CMB.1.raw
  modified_base (205)..(205): a, c, t, g, unknown or other
  misc_feature (205)..(205): n is a, c, g, or t
  modified_base (334)..(334): a, c, t, g, unknown or other
  misc_feature (334)..(334): n is a, c, g, or t
  modified_base (343)..(343): a, c, t, g, unknown or other
  misc_feature (343)..(343): n is a, c, g, or t
  modified_base (627)..(627): a, c, t, g, unknown or other
  misc_feature (627)..(627): n is a, c, g, or t
tcagtcgcactagtcacgaccggtgctcgatttagcagtactgcgttgggtttgggggagtcgagacccactcaggacacagcatggacatgagggtcccgctcagctcctggggcttctgctgctcgtggctcccaggtcgccagatgtcgccatccagttcgacccagtcctccactcctccctgtctgacatctggtagganacagacgtcaccatccagttcggaccgggactaaggtccgaagggctaaaagttaaaaatgtaattacgcgtaggtatcagacgaacgaaaccgtaaggaaactacgtaacgtacagtaactctaagtnaacgtcacncgttagtttaaggaacggttcggtacctaagttacgtaacggttcgagtaccggtgaaggttaggacgttacgagggaactagttaacttccgatcctacacctacgtacaccgaacggtcctcggaccgtaccgttaggaaacgtttacgtttaccgacttaaacgtttactttaacgacgtaacttaaacgttaaattttaaccgttcttaaccggttccctacggttaccgttaacgtttcgggaacccgggttaacgtaaccggtaaagtccgggttaanacgttaaaccgaaacggtacgttacggtaacggtcctacggtaccttaccgtagttaccttcggtttacctacggttaccc

SEQ ID NO: 118850 - DNA, 716 bp, Homo sapiens
  misc_feature: GYAE6OF02F4DGZ.39.87.H10.1.454.CMB.1.raw
  modified_base (134)..(134): a, c, t, g, unknown or other
  misc_feature (134)..(134): n is a, c, g, or t
tcagtcgcactagtcacgaccggtgctcgatttagcagtactgcgttgggtttgggggagtcagacccactcaggacacagcatggacatgagggtccccgctcagctcctgggcttctgctgctctggctccngtgccagatgtgccatccagttgaccctagtcctccatcctccctgtctgctatctgtaaggagacagacgtcacatctacttcggccgggactaagtcgtaagggactaattaaaagtcgttattagccgttaggttaatcgaagacaacggaaaaccaagggtaaaacctcgttaaacggttcctacggaactacttagtagtacgtaaccgttcctaaccgttaggttacgggtaaacgttcgggtacccgtagttaacgtaacggtttccgaaggtcacggtacgtagggtacctaggtcggaactagttacttcgaccgttataccaactacgtaccaacctggaccctggtacccggagttaccgtaagttccgtttacgtaacgttaacttacgttacttaccgtaactaacctttaagtttacctttacgttacttcctacgttactaccggtttacggacggtaacggtaaccgtaggtacggtataacggtaacgttaaacgaaccggtttggtaaaccgtccgtagccccgttaaacggtcgttaccggttacctttccgtacttacccgg

SEQ ID NO: 118851 - DNA, 669 bp, Homo sapiens
  misc_feature: GYAE6OF02F6Q7K.39.87.H10.1.454.CMB.1.raw
  modified_base (432)..(432): a, c, t, g, unknown or other
  misc_feature (432)..(432): n is a, c, g, or t
  modified_base (544)..(544): a, c, t, g, unknown or other
  misc_feature (544)..(544): n is a, c, g, or t
  modified_base (626)..(626): a, c, t, g, unknown or other
  misc_feature (626)..(626): n is a, c, g, or t
tcagtcgcactagtcacgaccggtgctcgatttagcagtactgcgttgggtttgggggagcatcacccaggaaccacatctgtcctctagagaatcccctgagagctccgttcctcaccatggactggacctggaggatcctcttcttggtggcagcagccacaggacgcccactcccaggtgcagcgtggtgcagtccggactgaggtgaagagccgtggggcctcgagtaggaaggtcctccgtgaccgaaggtccgttcgtaggtaactcccacccgtccacccggtacgttcctaatactcgtactacgttgggttcgacggaaccgtaccgggccccgttagggaaccggtaggggtcttggacgtggaggttggggagtagggatacgtaaacggtactagggttcgtactacaaataagttacgngacaacgtaaggttacgttacggagggtacggacggttaccgaccgtacgtaccgggaccgaacgggaccctaacgtacctaagtaacaaacgtaccggacgtacccttaanaaccggtagtaaaccgtggaacgcgtaacggtcgtaggattacgcgtacgacggacgtccggtattcgtagttcgttgacgnggtagtgtatgttacctcttactcgttacgtaggtttacgggg

SEQ ID NO: 118852 - DNA, 797 bp, Homo sapiens
  misc_feature: GYAE6OF02I8MJW.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttccctcaccatggactggacctggagatcctcttcttggtggcagcagccacaggacgccccacgtcccaggtgccagtcgtggtcgcctacggcccgggatgaggtagaaggaacgccgtggggcctcgagtgaacggtctccctggccgtaaggtcttcgtcggacttcccaccccgttccgaccgtaccgtacttaagtgtacggacgtacgttggttcgcccgtaaccggtaccggtcccccggtaggaaccgggtaacgggtccgtttagggaccggttagggaagggtttcggggtacgtaaggtacgtaccggtaaaacgggttaccgtagggtcgtttacctacggtaaacttaaattacgtcgacgaacgaacggtttaacggttcggacgggtacgtacggtaccgaactacggaggtacccggaagggtaaccctccgtaccgtactaacccgtaagtaccgacgtaccctaacgttacgaaacggttaccggacgtaacggtaccggtacgggtacgtaacggtaagttaccggtacccggggtaaactccccgtaaacgggtcccggttaaccggagttttaacgttccgggtttagaccggtaacgtaacgggtaaaccttggtacggtttacctaacggtttaccttacggtttacgttaagggttacggggg

SEQ ID NO: 118853 - DNA, 771 bp, Homo sapiens
  misc_feature: GYAE6OF02I62HM.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccggttcctcaccatggacttggacctggaggatcctcttcgttggtggcagcagccacaggacgcccactcccaggtgcagctgggtgcacggtccgggactcggaggtggaagaacggtccgtgggggcccttacgaggtaggaacggtcctcccgtaggcgtaacggtcttacgtacgggaactccaaccccttccgaaccggacgttctagtctacgctacgtaggttcgaccgacggtaccggcccctggaacgtaagggtcttacggacgttgggacgtcgggatacgggaacttacgaacggtaactggtaggtccttaccgaaacgtaaagttcgtgaaccgtaacgaagttacggttacgaacgggtcgtaacgggtacaccggtacgtaggaacccgtaggggacctaacgtcgaaactaccgtaaataccggacctccgtaacttacgggaacgtacgtacggaaggtacctacggggccgttaacggaaccggtaccttacgggtaacctaaccgggtacccgttaccggggtccgtaagttttaacgttcgggttaccccggtagaaccggggtaacgtaccgggttaagggttaccggttaccgttaaccgttacccggtttaacgttaccggttacccgggtttaacgggg

SEQ ID NO: 118854 - DNA, 770 bp, Homo sapiens
  misc_feature: GYAE6OF02GNJ9S.39.87.H10.1.454.CMB.1.raw
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcacatcacttgccggcaagtcagggcaattaaaatgtatttagcctggtatcagtcaagaaaccgagggaaactccgtaaggtcctagactctagtgtactcggccttccgaggttttagggaaacggttcggggtaccccagttaccgaaacgggtttcgaaggtcgggacgtaaggttcgggtagttccggtacggggtaacgtaggttacttttacgaccgttaccgtacccaacccgtaactacccgtaacctaaccgggtccccgttacggggacccgtacccggttaacggttaaacggttacgttttttcggaacccgtttaaaacttttacgtttaaccgttacggttaacctaaaacctttaaacttttttaactttaacccgttttaacttaccccggttacctttacccgttaaccggtttttaccggggaccggggtaacgggtaaaccgtaacggggtcggtacggtaacttaacggaaaaccggttaacgttcgggtaacggtcgttaccggaccgtaaccgtacttcgttaccgtttacgttcttaacccg

SEQ ID NO: 118855 - DNA, 669 bp, Homo sapiens
  misc_feature: GYAE6OF02HPGLA.39.87.H10.1.454.CMB.1.raw
  modified_base (193)..(193): a, c, t, g, unknown or other
  misc_feature (193)..(193): n is a, c, g, or t
tcagtcgcactagtcacgaccggtgctcgatttagcagtactgcgttggggtttgggggagcatcacccagcaaccacatctgtcctctagagaatcccctgagagctccgttcctcaccatggactggacctggaggatcctcttcttggtggcagcagccacaggagcccactcccaggtgccagctggtncagtccgggactgaggtgaagagccgtgggcctcagtgaaggtctcctgccaaggtcttcgtggaatccacctcaccgacgtactatatgacacgttggtcgaccggacgacggcccctaggacaacgggtcttaggaggtcggagtggacgtggatacgaaacggtactaggtcgttacactaactaaatacgtagacaacaagtagtttacggacgggtactacgggtacaaccgtagtacgaaccggtaagggaacctaaccggtacctaaacgtacgtaaacgtaacctaacggacccttaacgaactaacgggaaacttacgggacgtaacggacggtctaacggtacgtaacgtttaccgacgaaacccggtacgaaccggggttacccgtaaggtttaacctttaggttaccggtagaccggtaagtagtacgtaggaacgtttaccgtacttacggtacttaacgggg

SEQ ID NO: 118856 - DNA, 708 bp, Homo sapiens
  misc_feature: GYAE6OF02GH54U.39.87.H10.1.454.CMB.1.raw
  modified_base (375)..(375): a, c, t, g, unknown or other
  misc_feature (375)..(375): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtcgcagctggtgcgaggtccgggactgaggtgaagaagccgtggggcctacgagtgaaggtctccgtgacaaggtcttcgaggaactccaccctacaccgtacgttactatatcgactacgttggtcgacgacgacggccccgtaggacgtaagggtcttaggacggtgagtgggataggactacgaacggttaacnggtacgtactacgaaataagttacgtcgaacgtacgtaagtaacggttaggaacgggtacgtacggggtaccaaccgtagtacggaacccggacgggaaccgtaccgtaacgtaactaacccgtaaacgtaaccgtaacgtacccgtaaacgtacggtaacggtaaccgtaggaacggtacgaacgggtcgtaacgtagtaaccgttacgtaaccgaccggaaccgggtacgggtacccgtttaggttactttacggttcgtacggtaacgaacggtacggtacttacggttacgttaccgtttaacgtacggtttacgtagggttaccgggg

SEQ ID NO: 118857 - DNA, 678 bp, Homo sapiens
  misc_feature: GYAE6OF02IQ142.39.87.H10.1.454.CMB.1.raw
  modified_base (268)..(268): a, c, t, g, unknown or other
  misc_feature (268)..(268): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggacgtggacctgggaggatcctcttcgttggtggcagcagccacgaggacgcccacctcccgaggtgcgagcgtggtgcaggtccggactggaggtagaagacgccgtgggcctcgagtgacgtcctccgtgacgagtcttgagtacncctacccacaccgtacgtctatatcgctacgttggtcgacgaccgaccggcccgtaggaacgtaacgggtcgttaggacggtaggtaggtgggtagtacggacgtacgaacggtactaaggtcgtactacgaaacttaagttagtacgtactaacgaaggttaacggttacggacggggtacgtacgggtaccaacgtaacgtcgggaaccgagggtaccaccgtacgtaactaccgtaaataccgacgtaccttaagacgtaacggtaacacgagtcgtagtacgacgacgtacgtacgtaaacggacgtaaccgtcggtaaccgttagttaagttcgttaggaccaggtagtaacgtagttacggtaacgttaccttacggttaacgttacggtttagggttaacggg

SEQ ID NO: 118858 - DNA, 691 bp, Homo sapiens
  misc_feature: GYAE6OF02HXVRP.39.87.H10.1.454.CMB.1.raw
  modified_base (654)..(654): a, c, t, g, unknown or other
  misc_feature (654)..(654): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggactcctcttcttggtggcagcagccacgaggacgcccactcccgaggtgcagcgtggtgcacggtccgggactggaggtagaagacgccggtggggcctgagtgaagtcctccgtagcgaggtcttcgtaggaactccgtacccgtacaccgtacgtctactagtcgctacggttggttgaccgacgaccggtccccgtaggaaccggtaaggtctaggaggtggagtagggtagtaggtacgtaacggtaacggtaacgtaggtccgggtaactaccgaaacgttaaagttacgacggacaaccgttaagttaaccggttcggagggtaacccgtacgggtaccaaccgtaagtccgggaaaccgtaacgggtactaaccggacctacgtacaaagtaccaacgtacctaagacgttaacgagtacggagacggtagcgtagacgtacgtcgaacggacgaccgtaccgttgttagttacgttggtacgtacggtaggagttaaggagttcgttaacnccgtttaaccggttacgttacgttacggggttaaggg

SEQ ID NO: 118859 - DNA, 728 bp, Homo sapiens
  misc_feature: GYAE6OF02HJH5B.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttgggtggcagcagccacaggagcccactcccaggtgcagcgtggtgcaggtccgggactggaggtgaaagaagccgtcggggcctagaggtgaaggtctcctgacgacggtcttcgtggaatccgaccctcgaaccgtacgtctactatgctacgtggttgacgaccgaccggtccccgtaggaaccggtaaggggtccttagggaggtacgggtaggttacggggtaggttacgggaacgttaaccggaaaacggggtaaccgtaggggttacggttacctaacgaaacgttaaaagttcgaggaacctaagtaacggttaaggtttaccgaacggggtcggtaaccgggtacctaaccggtacggtacggaaaccggtacgggaacctaccgtaactaacgtaactaacgtaaccgacgtacctaacgtacgtacgtaacgtcggaacgcggacggtactgggaactacgtcgaacggaccgtacggacgttccggtagttacgtttgttcggtacggtagtaagtaacgtagttacggttactaccgtttacgttacggttacggttaaccggttagggg

SEQ ID NO: 118860 - DNA, 714 bp, Homo sapiens
  misc_feature: GYAE6OF02FGAA9.39.87.H10.1.454.CMB.1.raw
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
tcagtcgcactagtcacgaccggtgctcgatttagcagtactgcgttgggtttgggggagtcagacccactcaggacacagcatggacatgacgggtcccgctcagctcctgggcttctgctgctctcggctcccgaggtcgccagatgtcgccatccgagttcgacccgagtcctccactccctcctgtctcgacacttcgtaggtaggacgacacgccgtacaccgtactaccgtacggttcggccggtaactaacggtccggaacgggtaacttaaaacgttaaaacgtcgttaacgttacgccgttcggtanacgaacgaccgtaaacggaaaccgtaacggaaccttctacggtactnactcgtatgactcgttaccgtacggtaggtaacggtaaccgtcgggtaacctagtacggtaacggtcgaacggtccggaagttcgacggtacgtacggtacggtactacgttacctacaccgttaccacaaccgtcctaccgaccgttcgccgtacgggtctaacgtagttacttacgtactacttaactcttacgactactacttacttacttcgcgtcctagtcggtacgtacggcgttaaacgcgggtacgtaaccgacgtaaacgtacccggtaaaacgtccggtacgtacccggtctaccggaacccttcgttaccggtcttacccgttcggtaccttaaccccgg

SEQ ID NO: 118861 - DNA, 920 bp, Homo sapiens
  misc_feature: GYAE6OF02JQ75Q.39.87.H10.1.454.CMB.1.raw
  modified_base (182)..(182): a, c, t, g, unknown or other
  misc_feature (182)..(182): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacaggagcccactcccaggtncagctggtcgcagtccggactgaggtcgaaagacgccgttacgggggcccttcgaacggttacggaacggttccgttacccgtaggacctaaacggggtcctttaccggttagggaaaccttcccgtaacccccgttaccgaaccccggttacccggttaccttaagttaacttaccgggaccgttaaaccgtttcggggtttaccggacccggtaaccggtaacccggggtccccccgttaagggaaacccggttaaacggggtcctttaaggggaacggttacgggtagggtacggggttaagtaccggggtaacgttaacccggtaaacgggttaaccgtaaggggtttaccgggtaccttaaaccgggtaaactttaaacgtttacgtaccggttaaacccaaaccggttaaacccgggtaaccccgttacgggtaacggggacctaacgggttaacgtacccttaaaccgggactaaacccggaccgtaaacctaaccggaaccctaacgttaacccgaccgaacggtaacgttacccggaacccgggttaactacggtaacgtaccgtaaccggtaggtaccgggtaacgtccggttaaaccgagttaacccttacggtacggaaccgtaccgtacggttaccggttacgttaacgtaccggtagggttacccaggtaacgtaagggtacggttaaccgaaggtttttcttaccggtaccggtttacccggg

SEQ ID NO: 118862 - DNA, 685 bp, Homo sapiens
  misc_feature: GYAE6OF02GP11H.39.87.H10.1.454.CMB.1.raw
  modified_base (126)..(126): a, c, t, g, unknown or other
  misc_feature (126)..(126): n is a, c, g, or t
  modified_base (137)..(137): a, c, t, g, unknown or other
  misc_feature (137)..(137): n is a, c, g, or t
  modified_base (142)..(142): a, c, t, g, unknown or other
  misc_feature (142)..(142): n is a, c, g, or t
  modified_base (197)..(197): a, c, t, g, unknown or other
  misc_feature (197)..(197): n is a, c, g, or t
  modified_base (619)..(619): a, c, t, g, unknown or other
  misc_feature (619)..(619): n is a, c, g, or t
tcagtcgcactagtcacgaccggtgctcgatttagcagtactgcgttgggtttgggggagtcagacccactcaggacacagcatggacatgagggtccccgctcagctcctgggcttctgctgctntgctccaggtnccagntgtgccatccagtcgaccagtctccatcctccctgtctgctatcgtggtacgganacgaggactccacctatcctacgttcggccgggtataacggtcgaagggactaaaagttaaaagtcgtatttacgccgttaggttactacgacgacgaaacggtaaaacccgaacggggtaaaccttacccgttaaacggttcccgttaggtaacttaccttaagtagtactccgtaccttaccgttaggttaacgggtaaacggttcgggtaccctagtaaccgtaaggttccgaacggtcggtaccgtaggttacggtagtcggtagggtactaacggttacttacaccgtactaccgactactacgacctcgacgtcggacgtcgtagtaagttcttacgacttaacttacgttactcgtaactaactaactttactactactccgtaatcgtacgtagacgtaggaacgtaggcgtanaacgacgtaaacgtcgtaggtccgtacgtcgaccgtacgtacgttacctacgtcctttactacccg

SEQ ID NO: 118863 - DNA, 704 bp, Homo sapiens
  misc_feature: GYAE6OF02HR10X.39.87.H10.1.454.CMB.1.raw
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (639)..(639): a, c, t, g, unknown or other
  misc_feature (639)..(639): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatccctctttcttggtcggcagcagccaacaggagcccactcccgaggtgcagcgtggtgacgacgttccgggactggaggtgaagaagccgtgggcctacgagtggaacggtcctcctgctaacggtctttcgtgttaaccacctttaacaactntaggtatcgtaggttgggngaccgtaacgccgggtaccccgtggtaaccgaacggtcgttaggagttggaaggttcggggtaagtcggaactacggtacgccggttaccttaagtaacgttaggtaccaacaactaaaccgtgtacgacaaacgtaaccgaacccgtacggacgggtacgaacggtacggtaccaaccgtagtaaccgaaccacacgtaacaaccgtctacccgacgacgaccgtaccggacctacgacgaccgaccgtaggacggaccgtcgtagacgtacgtcgttaacggtaaccgacggtaccgggtaccgttagttacttacggtcgtacggnggtaacgtaaggaggtaacgggttaactttcggtttaaggttaccgttaccggttacctttacgg

SEQ ID NO: 118864 - DNA, 829 bp, Homo sapiens
  misc_feature: GYAE6OF02IBAWM.39.87.H10.1.454.CMB.1.raw
  modified_base (162)..(162): a, c, t, g, unknown or other
  misc_feature (162)..(162): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctgggaggatcctcttcttggtggcagcagccanaggacgcccacctcccgaggtgctgccgtggtgcgacggtccgggactggaggtgaaaggacgtccgtcggggcctacgaggtaggtaacgggtctccgtgacgaagggtcttcgtacgggtaactacccggaaccccttccgaacccggtacgtactactaagtcgacctacggttcggttcgacgtaaccgccggtaccccgttacgggaacgtaacgggtccgttaggtaacgggtggtaaggtgggtagtggtaacgtacggtaaaccgggttaactacgggttcggttacctaaccggtaaacttaaaacgttaacgttacggacgtaaaccgttaaacggttaaacggttttaccggaggggtaacccgtacgggggtttaacccaaccgtaacgggttaacgggaaaccccggaacgggtacctaaaccggttaacgtaaacgtaaccgttaaacgttaaccggaaccgttaacccgtaaacgttacggtaaacttacggaacggttacggaacggacggttaacggacggtaacttccgacggttaacgacccggaacgttccgggtaacgttagttagttaacggttcggacgtcgaaaggtcgtaggttaccgtagggttaaccctttaggtaccttagggtacgttttaacggggg

SEQ ID NO: 118865 - DNA, 668 bp, Homo sapiens
  misc_feature: GYAE6OF02H8MB7.39.87.H10.1.454.CMB.1.raw
  modified_base (374)..(374): a, c, t, g, unknown or other
  misc_feature (374)..(374): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaggcttcgtggaatcaccctcgaccgacgttctaatatcgacacttggttcgcgacacggtccccgtggaacgtaagggcttggagtggagtgggagtggatcgaaacgtaacaggtgtcacaacgtaaattgngacaatagtacgtttaggagggtacgtacgggtcaactagtacggacgacgggacaacggtccaatacctaaagtaaccgacgtaacctaactaacggtacggtaaaccgtagaacggaccggtaacggtcgttaacgggacgttacgttacgtacgggaaaccgaccggaaccgggttccggttaggtttaccggtttaagttcgggttaacggacgggtaaggtaacgttaggtagttaacggtttacccttaccgttttaacgttacggtttagggttttaaccggggggg

SEQ ID NO: 118866 - DNA, 579 bp, Homo sapiens
  misc_feature: GYAE6OF02GLDML.39.87.H10.1.454.CMB.1.raw
  modified_base (294)..(294): a, c, t, g, unknown or other
  misc_feature (294)..(294): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggttcagctggtacagtctggagctgagatgacgaagccgtggggcctcagtgaaggtctcctgcaggtcttcgtggtacctacctttaccaactagtgtatcaggttgggtgcgacncggcccctggacgaagggcttggaggtggagtgggagtggatcgagcgtacttaagatggtacaacaacaaactagcgacaacacgaaccctcggaggcagcaccaccatcgaccacacgaacacactaccgacgacgacgaccgacctacacgtacgacgtgacggacgacgtagagtcgtacgtacgaaccgaccgaccggtaccgttagttacgttacgtggtacggacggtagacggtacggttacgggtaaatttacggtttacgtaccgtcgtttaccc

SEQ ID NO: 118867 - DNA, 844 bp, Homo sapiens
  misc_feature: GYAE6OF02I9BXS.39.87.H10.1.454.CMB.1.raw
  modified_base (245)..(245): a, c, t, g, unknown or other
  misc_feature (245)..(245): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggctgaggtgaacgagccgtggggcctcgagtggaacggtccttacccgngaccgaagggtcctttcgtagggtaactccctaaccccgttccgaccgtaccgttactacgttacgttacggacctacgttagggtttcgaccgacgtaccgggtcccccttggggaaaccgaacggggtcttacgggtagggtacgggacgttaggggaagtttcgggaccgttacgaaaccggttacgacgggttacggttaccttaccgaaaccgaaagtttaccgagtaacctaagtaggttaaccgtttacggaagggtacccgtaagggttacccgtaaccgttaagtacggaacccggtaaggggtaacccctaccgggttacccgtaaggtaaccctaagtaacccgtaacggtaaccccttaaccgaaagttaacggggtaaacctcggtaaacgggacccgttaagggtaaccgtacggtaacggtaacggttaccggtaaccgtacccggtaaccggaccgggttaccgtttagggttaaccgttttggttaacggttaaccgggacggtaacggtaaggttaagtacgggtaactttacccggtttaccgtttaaccggttttaaccgttcgggttttaaacggggg

SEQ ID NO: 118868 - DNA, 658 bp, Homo sapiens
  misc_feature: GYAE6OF02FG8WY.39.87.H10.1.454.CMB.1.raw
  modified_base (272)..(272): a, c, t, g, unknown or other
  misc_feature (272)..(272): n is a, c, g, or t
  modified_base (358)..(358): a, c, t, g, unknown or other
  misc_feature (358)..(358): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccgggactgaggtgagaagcctggggcctcagtgaggtctcctgcaaggcttctggatccgacctcaccgacgtctatntgcacgtgttgcgacacgcccctggacaagggcttgacgtggagtgggatggatacgaacggtaacgagtcggtctacacaagttntagcacgagtaacgtttcgagggcgagggttccaacagttcgaccggtagggaccctacgtccctaactacgaaacgtaccgaacgcccttaacgacgtacgggtaacgttggaacgtcgaacgggtcgtagtaacgtaaccgttagtaccgtaaaccggaaccgtaccccggggtaccgttttacggtacttttaacggttacgggtacggtaacccgggtaaggtaacggtaagttacggtaaaccggttacccttttaccgttaccgtttaacgttaccgggtttttaccggggggg

SEQ ID NO: 118869 - DNA, 721 bp, Homo sapiens
  misc_feature: GYAE6OF02JYZ4U.39.87.H10.1.454.CMB.1.raw
  modified_base (280)..(280): a, c, t, g, unknown or other
  misc_feature (280)..(280): n is a, c, g, or t
  modified_base (356)..(356): a, c, t, g, unknown or other
  misc_feature (356)..(356): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgccccactcccgaggtcgcagcgtggtgcgacggtccgggactgaggtgaagagcctgggctcagtgagtctcgtgcgagctcgtaggatccgaccgtcaccgtacgtctactntcgctacgtggtgaccgacgcggcccgtggacgacggtcttggagtaggcgtggagtggatacggtaacggtacgngtggtactacgactaaattcgtagacctagtacgttaacggtttgacgggtacgtaggtaccgaaccgacgtacggaacggacgggtaaccaccggttaaccaacgtaccgtaaacgtccgaacggtacccgtaacgtagtaaacgggtaacctagggtacgaacgtaccggtaacggtacgaacggtaacggttcccgtaaacggtacccggaaccggttaacccgggttaccggttaacggtttaacggtttaacgttacggggttaccgtaaccgggtaacgggtaacggtttaacggtacgttttaaacgttacccgttaccggtttaaaccggtttaaccgtttacgggtttaacggggg

SEQ ID NO: 118870 - DNA, 626 bp, Homo sapiens
  misc_feature: GYAE6OF02GX7C6.39.87.H10.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
  modified_base (410)..(410): a, c, t, g, unknown or other
  misc_feature (410)..(410): n is a, c, g, or t
  modified_base (475)..(475): a, c, t, g, unknown or other
  misc_feature (475)..(475): n is a, c, g, or t
tcagtcgcactagtcacgaccggtgctcgatttagcagtactgcgttgggtttgggggagtcagacccactcaggacacagcatggacatgagggtccccgntcagctcctggggcttctgctgctctggctcccaggtgccagatgtgccatccagttgacccagtctccatcctccctgtctgcatctgtagganacagagtcaccatcacttgccggcaagtcagggcaattaaaatgtatttagcctggtatacagcaacgaaaccagggtaaactccgtaaggtcctgattctatgtatcgtcctctaggtttggaaggtcggggtacccattacgaacggttcgaggcggactaggtagagtcggtaggactagtacttacacctctaccaccgtatccaaccngtcccgtcggaccggtaccgtaggtaaacgttcgttttacgaaccttaaactttacgtttacctnttaactaaactttaattttacttacttacttcccgtacttacgttaccgtttcgggaccgggtacggtaaccgagggtaggagtacgtaccgaaacgtacgttgggtacgttcgtacgaccgtactaccgttacgtcgttccttactaccg

SEQ ID NO: 118871 - DNA, 686 bp, Homo sapiens
  misc_feature: GYAE6OF02JB457.39.87.H10.1.454.CMB.1.raw
  modified_base (140)..(140): a, c, t, g, unknown or other
  misc_feature (140)..(140): n is a, c, g, or t
  modified_base (158)..(158): a, c, t, g, unknown or other
  misc_feature (158)..(158): n is a, c, g, or t
  modified_base (171)..(171): a, c, t, g, unknown or other
  misc_feature (171)..(171): n is a, c, g, or t
  modified_base (195)..(195): a, c, t, g, unknown or other
  misc_feature (195)..(195): n is a, c, g, or t
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (273)..(273): a, c, t, g, unknown or other
  misc_feature (273)..(273): n is a, c, g, or t
  modified_base (305)..(305): a, c, t, g, unknown or other
  misc_feature (305)..(305): n is a, c, g, or t
  modified_base (448)..(448): a, c, t, g, unknown or other
  misc_feature (448)..(448): n is a, c, g, or t
  modified_base (563)..(563): a, c, t, g, unknown or other
  misc_feature (563)..(563): n is a, c, g, or t
  modified_base (580)..(580): a, c, t, g, unknown or other
  misc_feature (580)..(580): n is a, c, g, or t
  modified_base (610)..(610): a, c, t, g, unknown or other
  misc_feature (610)..(610): n is a, c, g, or t
tcagtcgcactagtcacgaccggtgctcgatttagcagtactgcgttgggtttgggggcatcacccagcaaccacatctcgtcctctagagaactcccctgagagcttccgttcctcaccagtggactggacctggacgntcctcttcgtggtgcagnacgccagaggacncccatcccaggtgcagtctgggtncgacggtccggagtggaggtcgaaggagtccgaggcctacgngacgacgttcnccgtagacgtagcttcgacgtaacnccctacctaccgaccgtaccgtatacgtaccncggtactcgggttcacgtaccgaaccggccggttaacccgaagggaaccgaacgggtgtagggttaaggaggacggttagggagtacggtaacgtaaccgtaaagggttcaagggttcttacaacggtaaacttaagtacganaaccgtagtaacgttacggtacggacggtaaaccgttcggacaacggtaacgtacgacgtaacgaccgtacaactacgaacgtaactacggacctacaacgaggttacgaacgtnaacgagtacgagtacgnttacgggattaaccgaacggtcctaacgtntttacgtaattacggtcgaacggataaggtgttaacgttacgtccgttagttcacggtttaccgtagggttaaggg

SEQ ID NO: 118872 - DNA, 877 bp, Homo sapiens
  misc_feature: GYAE6OF02IXIUS.39.87.H10.1.454.CMB.1.raw
  modified_base (786)..(786): a, c, t, g, unknown or other
  misc_feature (786)..(786): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacgaggacgccctactcccgaggtgcagtcgtggtcgcgacggtccgggactggaggtagaacggacgccgtcgggcctcgagtacggacggtcctcgtgacgacggtcttcggtaggtaacctccgaacccgtaccgaaccggtacgtacgttaacgttaacgtcgtaccgtacggttcggttcgacccgtaacggaccggtaccccggtaggaaccggtaacgggtcgtacggtagggtacgggtaggtacgggtacgtacggtaacgtaaccggttaaacggtacggtcggttacgtaccgtaaccggtaacgtttaaagttcggtacgtaacgtaaacgttacggttaacggtttacgggacgggtaacggtacggttaccgaacggtttacgaaccgggaccggaaccgggtacctaccggttaaccgaacgttaaccggtaacctaaacggtccgggtaaaccctaaggtttaccggaaaccggtttaacgtcgggaaacccgcggggtttaaccgtcggttaaaaggaaccgtttacggtaaccggaaccgggttaaacccgaaccggggtttaccgggtacgttttaacgtaccggttttaccgggaaggttaacccgngggttaaagtcccggttttaaacgccgggttttaccttaacccgggtttaccggtttaaggtttaacccgggttaggggtttaaccggggg

SEQ ID NO: 118873 - DNA, 779 bp, Homo sapiens
  misc_feature: GYAE6OF02IC01K.39.87.H10.1.454.CMB.1.raw
  modified_base (175)..(175): a, c, t, g, unknown or other
  misc_feature (175)..(175): n is a, c, g, or t
  modified_base (734)..(734): a, c, t, g, unknown or other
  misc_feature (734)..(734): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctgggaggactcctcttcgttggtggcagacacgccacgaggacncccactccgaggtcgcacgcgtggtcgtcacggtaccgggactagggtaggtaggaaagaacggtcccgggtcggggcctacgtaggtacggtaaacggtcctccgtagaccgaggtcttagtacggactacccacctccgaccgtacgttacctataacgcgtacctacgttcgggtcgacccgtaaccgggtacccggtcccggtaacggaacggtaaccgggttgttacggagggttagggacggtaagggcttaagggtaacgttaacggtaaaccggtaggtaagggttccgtaaccgttaaacctaaacgttaaaacgttacgtacgaaccgtaaacgttaacgggttaaacggttaccgggaacggggttacggaaccggtaacgtacccgttaacgggaaccggaaacccgggtacggggttaaacccaccgtttaacccgaaacgtaccgtaaacgtaaccgtaccgttaccgtaagtcggtaaacggttacgacggacgtaacggcgtacgagtatcgctaacggcctagtaaccgtcgtagttggtanaggtgaagtagacgtgtactaacttcgtattaccgttaggtacgg

SEQ ID NO: 118874 - DNA, 939 bp, Homo sapiens
  misc_feature: GYAE6OF02JXS1D.39.87.H10.1.454.CMB.1.raw
  modified_base (165)..(165): a, c, t, g, unknown or other
  misc_feature (165)..(165): n is a, c, g, or t
  modified_base (611)..(611): a, c, t, g, unknown or other
  misc_feature (611)..(611): n is a, c, g, or t
tcagtcgcactagtcacgaccggtgctcgatttagcagtactgcgttgggtttgggggagtcagacccactcaggacacagcatggacatgagggtccccgctcagctcctgggcttctgctgctctggctcccaggtgccagatgtgccatccagttcgacccngtctccatcctccctgtctgccataccgtgtacggagacgagtacgtcgaaccactcgacgttcggacccgggactaacgggtcgtaacggggctaaaattaaaagtcgtaagttttacggccgttaggtactcaacggacgtaaacggtaaaccgaaacggggtaaaaccttacccggtaaacggttaccgtaacgtacgttacgttaacgtaggtactccggtacccttaaccggtaacggttttaagggtaaaaccgggggttccggttaaccccggtaacctttaaccggtaaacggggtttacccggtacggggtaccggggtacgggttaacgggtacggttaaccggttaccggtaaccgggggtaaaacttaggtttaaacccgttttaccgttaaacccgttccccgggtaaccttaacccgacccgtttaaacccncccggttaaacggtcccccgggttaaccgggtaaccccggttaccgggttaaaccgttaaacgtttaccggtttttaacgaaaccctttaacgtttttaaccgttaaacggttaccgttaaacctttaaacgttttaaacctttttaaacgttacccgttttaaacgtacccccgttcgtttaaacccggttcggttttaccggggtaaccggtaaacggggttaaccctaaggggtaacgtacggtacgttaaccggaacggtaccgttagggtcgtaccgtacgaccgttacgtaacgttccgttactttaccggtacttaccccg

SEQ ID NO: 118875 - DNA, 659 bp, Homo sapiens
  misc_feature: GYAE6OF02GJY9D.39.87.H10.1.454.CMB.1.raw
  modified_base (366)..(366): a, c, t, g, unknown or other
  misc_feature (366)..(366): n is a, c, g, or t
  modified_base (388)..(388): a, c, t, g, unknown or other
  misc_feature (388)..(388): n is a, c, g, or t
tcagtcgcactagtcacgaccggtgctcgatttagcagtactgcgttgggtttgggggagcatcacccagcaaccacatctgtcctctagagaatcccctgagacgctccgttcctcaccatggactggacctggaggatcctcttcttggtggcagtcagccacaggagccactcccaggtgcagctggtcgcgagtccgggactggaggttggaagaagccgtggggcctcgagtgaacggtctcctgctaaggcttcgtggaatcacctcaccgtacgtctatatgctacttgggttcgcgaacgtcggcccctaggaccgaagggtccttggagtcggagtggactgactacgaagtaacgnggtacggtctacaactaacttnacgtctaacgagtagtttcgagggacgtacggtaccaactagtcggaccgaacgggacctaccggtacacgtaccgaaattacgaaccgtacctaacgtaagtacggaacgttacgaggtaccaagggtctaggaactaacgtccgtaacggaccggtaactaccggggtaccgttagtttaacgttacggttagggtccggtacggaaacggtacgtaacgggttacgtaaacggtttaacccttcggtttaacctacggtttaacgggg

SEQ ID NO: 118876 - DNA, 870 bp, Homo sapiens
  misc_feature: GYAE6OF02FLE5I.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggagatcctctcttggtgctagcagccacaggacgccccacctccccaggtcgactagcgttggtagcgtaggtccgggactggagtagaaggacgtccggtacggggtccttacgaggtagacggtcctccgtgacgtaaggtctcgtagtactccaccctaccgaccgacttcctatacgtacgtcgtagttacggtcgaccgaccgaccggtaccccgtaggtacggaaccgggtcttacggtacggtaggtaacggttcggtagtcggtaacgtaccggtaacgtaacgtagggtacgtacgtaacctaacgttaaagtcgtaacgtcgaaacgttacgtaaaccggtttacgggagtaccgggtaacgggtacccgtaacgtacggttaacccgggaccggtaaccgggtaaccgtaaccggtacccgtaattaaacccggtaacgtaccggaaccgttaacccggtaccctaaacggggtttaacccgaacgttaaccgggtacggtaaccggtaccgggttaaccgttacgggaaaccgggtttaccggtaaccgttaaacccgggtaaaccggtacccggggttacccgggttaacccgggtttacgtttaaggtttaccgggtaaccggttaacggggttaacgtaacgggtaccgttacggttaacggttaccttttaaacccggtacggtttttaaccggttacgggtttacgggtttaaacccggggg

SEQ ID NO: 118877 - DNA, 738 bp, Homo sapiens
  misc_feature: GYAE6OF02JE417.39.87.H10.1.454.CMB.1.raw
  modified_base (576)..(576): a, c, t, g, unknown or other
  misc_feature (576)..(576): n is a, c, g, or t
tcagtcgcactagtcacgaccggtgctcgatttagcagtactgcgttgggtttgggggagcatcacccagcaaccacatctgtcctctagagaatcccctgagagctccgttcctcaccatggactggacctggaggatcctcttcttggtggcagcagccacgaggagccccacctcccgaggtcgccgaggtcgtgggtcgacgacggtcccggggactaggacgggtagaaacggaacggtccggtcgggggtaccctcgtagggtacgtaacggttcctccgtagacgtaacggtcgtttcgaggtactccaccctacgaccgtaacgtctatagtacgctacgtggtcgacgaccgtccggtacccgtggaaccgaagggtctaggaggtacggtagtagggtatacggacgtaaccgtaaacggtacgtaaggttcgacctaacgaacttaagttcgcgtaactaacgtaggttaacggttagggagggtaccggacgtaccgaacgtaggtaccgtacggtaacggaccgtacgtacgtacgacgtaacggtaaccacgttaccgtaanacgtacggatacgtacggaacgacggtaggtaggtaacgttcgtaccgtacgggaaacccggtacgggtaccggttacgttagttacggtttaggtacggtacggaaggtaacggtaagtcgtaaggttaccgttacgttaccggttaacgtcgttaacggg

SEQ ID NO: 118878 - DNA, 896 bp, Homo sapiens
  misc_feature: GYAE6OF02JH105.39.87.H10.1.454.CMB.1.raw
  modified_base (193)..(193): a, c, t, g, unknown or other
  misc_feature (193)..(193): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (308)..(308): a, c, t, g, unknown or other
  misc_feature (308)..(308): n is a, c, g, or t
tcagtcgcactagtcacgaccggtgctcgatttagcagtactgcgttgggttggggcatcacccagtcaaccacatctgtcctctacgagaactccccgtgacgacgccttccgttcctacacctagtggactcggaacctgggaggtactccgttcttcgttggtcgggaccagacaaacgaacgtaggtcnccccacttacccgaggttaccgngtacgtcggtaaccngtacgtcggacncgttaggaacgctacggaaccgaacggtccgtcggggacctacggaggttacggaacgtcctcgngtacgtagtctttacgacgttcctaccttaaccagtacgtaggtactcgtacggtggtacgacgtacgccgtaccgaggtacgaagggttctaggtaggacgttgggagtcgtaggtacgtcgtacggtctacttaaacggtacggtcgaaacctacggtaaccttaaactcggtctaacccgtaaacgttccgaaacccggtacggtacccggtaataacccgggtaccgtaaccgtacggttaaccgtaacggtaacctacgtaacgaacgtacgaaccgttaccgtaaaccggcgtaaccgtacccgacttaaccggtaacgtccggtaaaccgggtgtaaccggtaccgtaccgggtacgttaacccggtcgttaaccccgttccgggtaaacccgtaaaccggggttccgtttaaccggtttcggttaacccggttttaaccggggtttccgaaacccgggggttaacggttaaccggtaaacccgggttttaaccggggttaaaccccgttttaaagggggtttccgttttaaaccccggggaaccggtttttacccggggttaccctttttaaacccgggg

SEQ ID NO: 118879 - DNA, 886 bp, Homo sapiens
  misc_feature: GYAE6OF02JLKRD.39.87.H10.1.454.CMB.1.raw
  modified_base (189)..(189): a, c, t, g, unknown or other
  misc_feature (189)..(189): n is a, c, g, or t
tcagtcgcactagtcacgaccggtgctcgatttagcagtactgcgttgggtttgggggcatcacccagcaaccacatctgtcctctagacgaaatcccctgagagctccgttcctcaccatggactggacctggaggatcctcttcttggtggctagcagccacgaaggcgcccactcccgaggtcgcncgtctgggtcgctaacggtccgggaactggtaggtcgaaaggaacgtccgtcggggtcccttacgaggtacggtaacggtccgtccgtaggaccgtaaaggttccttcgtaaggtaaaccgttcccggaacccttccgaaccgttacgttacctaagtacgttcgggacctaacggtttcggtaccgaccggtaaccgtaccgggtccccgttaggaaccggtaaacgggtccttagggtaacggtacgggacgttacgggagttaccggacgtaccgggtacggtaccggttaacctttacggtaacggtaccgggttaacccaaacgtaaaccgttaaacggttcgtaacgtaaacccgaacggaaaacccgtaacccggttacggaacggggtaaccgtaacggtaaccgtaccggaaaacccctttcggaaaccgggtaacccctaaaggacgtaaaaccgtcccgttacaaaacccgggtaacgtaacccgggacccggtaaacccgtaacctacggtaacgtaaccggtaaccgtacggggtaacgaccgggttacctaacgggtaaaccggttctaacggggtaacccgtaacccggtacggtaacgttccgggtaaacgtttcgttaacgggacgtacggtaaccgtaacggtacggtacgttaacgggtaactttcggttacggtacg

SEQ ID NO: 118880 - DNA, 993 bp, Homo sapiens
  misc_feature: GYAE6OF02FQWU0.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggatccccttctggtggcagccagccacaggacgcccactcccgaggtgcacgctggtgcacggtccggactgaggtagaagaacgccgtgggtcctcgacggtagaacggtcctccgtagcgtaaggcttcgaggaactcccacccctacgaacccggtactaccttaacgtacgtcggtacctacggttcgggttaacggcccggaaacgtaccccgggtcccccgtagggaaccgtaacggggttcctttaagggacgggttacgggagttagggggtacgtacgggtaaaccgttaccggtaaaaaccgggtaccgttaaccgggtttaggttaccccgttaaacccgtaaaacggttaaaacgtttttaaccggtacggacccgtaaaaaccggttaaagggtttaaaccggggttttacccgggaacgggggttacccggtaaaccgggttacccaaaccgttacgggttaaccggaaacccgggtaaacggggtaacccctaaacccgggtaacccttaaaccgttaaaacccgtaaacggttaccccgtaacggtttaaaccccgtaacggttaaccgggttaaacccgggtaaccggtaacgggttaaaccgggtaacccggtacgggtaaacccgtttaacgggaaacggtttaccctacccgggttaaagggtaacccccgtaaaccggggtaccggtttacccgggttttaaagttacccggtttaacgggtttacgggtaaccgggtaaacggttaaacggtaggttaaccccgtttagggtaacctttacccgggttttaccgttacgtaacggggtttacccggtttagggggtttaaaacccgg

SEQ ID NO: 118881 - DNA, 599 bp, Homo sapiens
  misc_feature: GYAE6OF02HJH6G.39.87.H10.1.454.CMB.1.raw
  modified_base (286)..(286): a, c, t, g, unknown or other
  misc_feature (286)..(286): n is a, c, g, or t
  modified_base (302)..(302): a, c, t, g, unknown or other
  misc_feature (302)..(302): n is a, c, g, or t
  modified_base (387)..(387): a, c, t, g, unknown or other
  misc_feature (387)..(387): n is a, c, g, or t
  modified_base (491)..(491): a, c, t, g, unknown or other
  misc_feature (491)..(491): n is a, c, g, or t
  modified_base (516)..(516): a, c, t, g, unknown or other
  misc_feature (516)..(516): n is a, c, g, or t
  modified_base (531)..(531): a, c, t, g, unknown or other
  misc_feature (531)..(531): n is a, c, g, or t
  modified_base (552)..(552): a, c, t, g, unknown or other
  misc_feature (552)..(552): n is a, c, g, or t
tcagtcgcactagtcacgaccggtgctcgatttagcagtactgcgttgggtttgggggcatcacccagctaaccacatctgtcctctagagaatcccctgagagctccgttcctcaccatggactggacctggaggatcctcttcttggtgcagcagccacagagcccacgtcccaggtgccagtcgtgtgcagtccgggactgacggtgaagacgctgggacctcgagtagaacggtcgtcctggccaaggtcttcgtagaatcacctcgaaccgcgtcgtatangtcagtcgttgcgtanacggtccccctaggaccaacggcttacggagtaggagttgggagttcgacttacggaaccgtagacgtggttacacaacgttaanacgtttgaacacgtaacgtagtttacgacgggtacgacgtaccgacccttagacgaccggtaaacggacgtccgtaacgtacctacgaaactaacttggaaccnctagacgtacagacttcgaagccanacgtctcacggtacnctacggtctgttaagttccgngtacgacgaccgtagactagtacgtatcgttatacgttcttaagggg

SEQ ID NO: 118882 - DNA, 745 bp, Homo sapiens
  misc_feature: GYAE6OF02JT4PZ.39.87.H10.1.454.CMB.1.raw
  modified_base (723)..(723): a, c, t, g, unknown or other
  misc_feature (723)..(723): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggacgcccactcccgaggtgcagctggtcgcacggtccgggacttggagggtaggaaacgaacggtcccggttcggggccttacgaggtacggtaacggttcctccgtgaccgtaacgtccgtttacggtaggtaacctccctacccgtaccgaacccggtaccgttacttaactaacgtcggtaccgtaacgttcggttacggaccggacggacccggttaccccgtacgggtaacggaaggggttccttagggtacgggtggtaggtacgggagtacggtaacgtaccggtaaacggtacgtaggtcgtaccgtaacaacgtttaacttacgtagactaacgtaaggttacggttacggacggtacggtacggtactacgtacgtaccgaacggaacggtacctagtacctacgtacgaactacgaacgactaacggtacgtagtacgtacgacgacgtacgtacgaagtacgacgttaccggaacgaccggtaccgtaggtccgttagttagtttacgtcggagtacggaagtacggtaagaccggttcttaccgttnttacggtacttgggttaacggg

SEQ ID NO: 118883 - DNA, 761 bp, Homo sapiens
  misc_feature: GYAE6OF02JC8N8.39.87.H10.1.454.CMB.1.raw
  modified_base (181)..(181): a, c, t, g, unknown or other
  misc_feature (181)..(181): n is a, c, g, or t
tcagtcgcactagtcacgaccggtgctcgatttagcagtactgcgttgggtttggggggcatcacccagcaaccacatctgtcctctagagaatcccctgagagctccgttcctcaccatggactggacctggaggatcctcttctggtggcagcacgccacaggagcccactcccaggtncagctggtcgcacggtccgggactggaggtagaacggaagccggtcgggcctcgagtcggaagtcctctgacgtaacggtcttacgtaggtaactccacccgtaccgaccggtactactactatacgtctacgttggttacggacgtacgccggacccggtaggaacggtaacgggtccgtaggtacggtacggtaggtcgggtagtacggtacgtaacgtaaacgggtacgtacggtcggtactaaccaagttaattaagtccgacgtaaacgtacgttaacgtttacggacggggtacgtacgggtaaccaacgttaacgtaccggaaaccgacgggacttaacccgcttaacgaacctaacgaccgacggtaaccctacgtaacggtaacggttacgaacggtagaccggtaacgacggtacggtaactaccggtacgtaaccggtaaacgaacccgggtacgggttacccttaggtttaacccgttgggttaacggtaaccggagtaaccggtagtaacggttagttaacccggttaacctttcgttaacggttaccgttaaggggtttaacgggg

SEQ ID NO: 118884 - DNA, 721 bp, Homo sapiens
  misc_feature: GYAE6OF02HF61Y.39.87.H10.1.454.CMB.1.raw
  modified_base (507)..(507): a, c, t, g, unknown or other
  misc_feature (507)..(507): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttcgaccctagtcctccatccctccctgtctgccattcgtaggtaggacgacagacgtccacctatctacgttcggaccgggactaacgtacgagggaactaaaagttaaaagtgttaacgtttacgtccgttaggtactacgaacgtaccgaaacggaaaacccggtaacgggtaaaaccttacccgttaaacggtccctagacttactatgacgtccgtacctacgttaggttagggtaacgggtccgggtacctagtaccgtaaggttacgcggacgtcgtaggtacgtagtacggagggactagttcttctactcctcactacctcaccgcgccgtcgggaccgtnaaggttagtacgttacaactttaataccttacgtataacttaatttaactttacttacttaccgtccttacgttacgttaccgggttaccgggaacggtacggtaacgttagggtaccggacgtaacggtaaccgtaaacgggtcgttacgggtaccgtacggttacccaaccgttccgttacgttacccgtttagttacctttacctacccgg

SEQ ID NO: 118885 - DNA, 674 bp, Homo sapiens
  misc_feature: GYAE6OF02JLUZ6.39.87.H10.1.454.CMB.1.raw
  modified_base (274)..(274): a, c, t, g, unknown or other
  misc_feature (274)..(274): n is a, c, g, or t
  modified_base (401)..(401): a, c, t, g, unknown or other
  misc_feature (401)..(401): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggagatcctcttcttggtggcagcagccacgaggacgcccactcccgaggtgcagcgtggtgcaggtccgggactggaggtagaagagccgtggggcctcagtgaaggtctccgtgacagcttcaggactccaccgtcaaccgngtctaatagtgctgttggtgcgaccgtacgccgtacgacggaggtcttggacgtaggtacgttgggaattcggtaacgtacggtaaaccggtaacgtagggttcgtactacgtaaacctaagttacnggaccaacgtacggtagtttacggacgggtcgtacgggtacacctaagtccgaaacggtaacggacctacgtaaccgtaagtaccgaaataaccgacgtaacccgtaaggtaccggtcgtaaacgcggtaacggcgtaagtcgtaaccgaacggtaccgtacgacgtaaccggacgtaccgtccgttacgttagttacggtacggttaggacgtacgggtaagtaccggtacgttaacgttccttacttacggttagttaccgggttaagggg

SEQ ID NO: 118886 - DNA, 716 bp, Homo sapiens
  misc_feature: GYAE6OF02ICUEP.39.87.H10.1.454.CMB.1.raw
  modified_base (425)..(425): a, c, t, g, unknown or other
  misc_feature (425)..(425): n is a, c, g, or t
tcagtcgcactagtcacgaccggtgctcgatttagcagtactgcgttgggtttgggggcatcacccagcaaccacatctgtcctctagagaatcccctgagagctccgttcctcaccatggactggacctggaggatcctcttcttggtggcagcagccacaggagcccactcccaggtgcagctggtgcagtccggactggaggtgaagtaagccgtggggacctcgaggttagaacggtcctccgtgacgtaacggtcttcgtaggaactcctaccccgttcgacccggtacgttactagttatcgcctaagttcggttgaccgacgccggtaccccgtaggaacgagggtccttggacggtaggagtgggtagtggtacgtaacgtaacggtaactgggttactacgtactaaactaattcncgtacaacgtaggttacgttgacgggtcgtaccgggtcaacgtagaccgggaacgtaacggtaccctaaccgtacccaaagtaccctaaagtaaccgtccgaacccttagtaggtacgtaacggtacgagtaccgtaggtacgtacggatacgtcggtaaccgacgggtaacccacggggttaccttaggtttaacttacgggtttcgacggtaacggtacgttaacgttagttaccgttaacgttttaccgttaccgttttaacgttaaccggtttagggtttacggggg

SEQ ID NO: 118887 - DNA, 927 bp, Homo sapiens
  misc_feature: GYAE6OF02HZJHN.39.87.H10.1.454.CMB.1.raw
  modified_base (225)..(225): a, c, t, g, unknown or other
  misc_feature (225)..(225): n is a, c, g, or t
tcagtcgcactagtcacgaccggtgctcgatttagcagtactgcgttgggtttggggggagtcagacccactcaggacacagcatggacatggagggtccccgctcagctcctggggcttctgctgctcgtggctcccgaggtcgcctaggtatggtcgcctagttccgagttcgacctagtcctccactccctcctgtctgctagtcgtaggtacggagtacgngtacgtccaccgatccgtacgttcgggaccgggactaaacggtccggaacgggtaacttaaaagttaaaaacgttcggtaaacgttttacggaccggttaggttaactaccgacggtaaccgtaaacggtaaaaccggtaaacgggtaaaaccttaaccggttaacggttaccccgtaaggttaacgttaaccgttaacgttaggtaaaccgttccgtaccggtttaccgtttaaagggtttaacggggtaaaaccgggttccgggtaaccgtaggttaacggtaaacgggttaccgacggggtaccggtacggttaacggttacggggtaacgttacggtaaacgggtaaccgtaagtttaccgtttaaccgtacctaccgtaaacccgtaacctaacggttacccgaaccgggtaaccgttccggtaccgggttaacccggtaacgttaaacggttaaacgtttaccggtttttaaccggaaaacttttacgttttaacgttaccggtaacgttaaacgttaaacttttaaaccgttttacttacccgttacgtcccgtaacccgtttccggttaaccgggtttcgaaccgggttaacgtaacgtaggttaccgaagtaccgaaacggtaacgtcggtacggttacgtaccctaacgggtacccttaacggtcttacggtctttacccacggttaacccg

SEQ ID NO: 118888 - DNA, 641 bp, Homo sapiens
  misc_feature: GYAE6OF02FNB8U.39.87.H10.1.454.CMB.1.raw
  modified_base (181)..(181): a, c, t, g, unknown or other
  misc_feature (181)..(181): n is a, c, g, or t
tcagtcgcactagtcacgaccggtgctcgatttagcagtactgcgttgggtttgggggcatcacccagcaaccacatctgtcctctagagaatcccctgacgagctccggttcctctaccatggactggacctggaggatcctctcttgtggcagcagccacaggagcccactcccaggtncagctggtgcagtccgggactgaggtgaagacgccgtgggcctcagtgaggtctctgcaaggctctgatcacctcacgcgtctatatgcactgtgcgacacgccctggacaggcttgagtcggatgggatggatcgaaacggtactaggtggtctcgaactaattatcgacacgagtaacgtttcgaaggcacgggtactaccatacgaaccgaacgggtacctaaccgtccgtaaactactaaaagttacccgaagtaccccgttaacgtaacgtacgggtaaacctttcggaacgttccgaaggggtacctacggtaacgtaagttaccgtaacgtaccgggaaccgtaccgggtacccggttagttacgtttaggttacggttagggaccgttaagggacgtaaggtacgttaaggttaacccgtttacgtaccgtttacgttacggtttacggggg

SEQ ID NO: 118889 - DNA, 776 bp, Homo sapiens
  misc_feature: GYAE6OF02GD1A9.39.87.H10.1.454.CMB.1.raw
  modified_base (281)..(281): a, c, t, g, unknown or other
  misc_feature (281)..(281): n is a, c, g, or t
  modified_base (329)..(329): a, c, t, g, unknown or other
  misc_feature (329)..(329): n is a, c, g, or t
tcagtcgcactagtcacgaccggtgctcgatttagcagtactgcgttgggtttgggggagtcagacccactcaggacacagcatggacatgagggtccccgctcagctccgtggggcttctgctgctcgtgctcccaggtcgccagatgtcgccatccagttcgaccctagtcctccacttccctccctcgttctcgcctatcgtggtaggagacagacgtaccacctatactacgttcggccggacagtcgaggactaattaaatgtattacgcgtgtanacagacgaacgaacgtaaggaaactccgtaacgtcctagtactctagngactccgacttcgtagtttacgggaacggtcggtaccagttacgacggttcgacgccggtagtacggtggtacttcggtaggtaactacgttacttaccgtaccgttcctaaccgacctaaccgttcccaaccggtcgttccccgtacgggtaccgtaccgttaaggtaacgtttacgttaccggtaaaccttaagtttacttaaacccgttataaaccgtttaaactttaaccgtttttaaacctttccgttaaaccgtttccccgttaacgttttaccccggttaacgggttacccgggggtaaaccggtaacgggttaaacgttacgggtaaccggtaccgttaaaccgtttaaccggtaaaacggttccggtttaggacccggttacgttacgacccgttaacggttccgttaacgtttcccgttacttacccgtaacccccg

SEQ ID NO: 118890 - DNA, 829 bp, Homo sapiens
  misc_feature: GYAE6OF02JUPPO.39.87.H10.1.454.CMB.1.raw
tcagtcgcactagtcacgaccggtgctcgatttagcagtactgcgttgggtttgggggcatcacccagcaaccacatctgtcctctagagaatcccctgagagctccgttcctcaccatggactggacctggaggtatcctcttcgttggtggcagcagccacaggacgccctactcccgaggtcgacacgcgtggtcgccgtaacggtcccgggactaggacggtacgaaggacgtccggttcggggccctagtaaggtacggttaacgggtccttcccggtagaccgtaacggggtcctttaccgtacgggaaacctccctacccccgtaccgtaacccggtaccgttacttaacgttacgtacgtaccgtaacggtttcgggttacggacccggtaaccggtcccgggtacccctaaggggaaccggtaaccgggtccgttagggtaacgggttacgggtacggtacgggtagtacgggtaacttacggtaaaccggtaacgtacggtacggtcctaaacgtaacgttaaacgtacgtacgactaacgtacgttaacggttaggaccgggtacggaggttaacccacggtacgtacggtaaaccggaacgtacccgtaacgtcctaaggtactaaaccgacgaccttaacgacgtagtaaacgtaacgtcggaacgttcggaacgtacggtaacgtacggtacgtaaccgacgggtaacgaaccgttcgggacgtttacgtacggtttaggacggtacgtacgtaacggacttaaggacgttaaccgttcgttaacgttaacggttaccggttacggttaacgggg

SEQ ID NO: 118891 - DNA, 614 bp, Homo sapiens
  misc_feature: GYAE6OF02FR032.39.87.H10.1.454.CMB.1.raw
  modified_base (368)..(368): a, c, t, g, unknown or other
  misc_feature (368)..(368): n is a, c, g, or t
  modified_base (595)..(595): a, c, t, g, unknown or other
  misc_feature (595)..(595): n is a, c, g, or t
  modified_base (602)..(602): a, c, t, g, unknown or other
  misc_feature (602)..(602): n is a, c, g, or t
tcagtcgcactagtcacgaccggtgctcgatttagcagtactgcgttgggtttgggggagtcagacccactcaggacacagcatggacatgagggtccccgctcagctcctggggcttctgctgctctggctcccaggtgccagatgtgccatccagttgacccagtctccatcctccctgtctgcatctgtaggagacagagtcaccatcacgttcgccgggacaagtcgagggactaattaaaaatgtaatttagcctggtatcagacaagaaaccgaagggaaaacctccgtaaggtcctagatactatgactgccttcgtagtttaggaacggtcgggtaccctatacgtaacggtcaggcggngaggtggactcgtagggacagtactttcactctacacctactccacctacgccgtcggccggtacctagtaacgttacttttacgacctttaaacgtttaactttacgtcgttaaacctaaatttaaacttttaactttaccttactccgtaccttcgtaccgtttcgggacggtacggtacgtaggtaggacagtacgaacgtacgtggtcgtactcgactacgtntccgttntaccgttctacc

SEQ ID NO: 118892 - DNA, 535 bp, Homo sapiens
  misc_feature: GYAE6OF01BPMI4.5.86.H09.1.454.CMB.1.raw
tcagatcagacacgcacgaccggtgctcgatttagtgctatagacttgggtttggggtgctcgatttagtgctatagacttgggtttgggatctacgttgcaggtgtaggtctgggtccctgagactctcctgtgcagcctctggattcacctttactgattttggcatgacgtgggtccgccaggctccagggaagggctggactggctctcaaatattaatggtaaaggcaatatacaagactacacagactccgtgaagggccggttcaccacctcgagagacaactccagggacacggtgtacctacacatgaacagcctgagagccgaggacacggccgtatatattgtgtgaggggaaactggggcaatttgaccgctgggccagggaaccctggtcacgtctcctcagcctcaccaagggcccatcggtcttccccctggccgccctgctccaggacgcacctccgagacgcacagcggccctgggcctggcctggtcaaggactacttcccgtgtctgatctgacgg

SEQ ID NO: 118893 - DNA, 521 bp, Homo sapiens
  misc_feature: GYAE6OF01AQEEW.5.86.H09.1.454.CMB.1.raw
  modified_base (518)..(521): a, c, t, g, unknown or other
  misc_feature (518)..(521): n is a, c, g, or t
tcagatcagacacgcacgaccggtgctcgatttagtgctatagacttgagtctggggaggcttggtacagcctgggggtccctgagactctcctgtgcagcctctggattcacctttactgattttggcatgacgtgggtccgccaggctccagggaaggggctggactggctctcaaatattaatggaaaaggcaatatacaagactacacagactccgtgaagggccggttcaccacctcgagagacaactccagggacacggtgtacctacacatgaacagcctgagagccgaggacacggccgtatattattgtgtgaggggaaactggggcaatttgaccgctggggccagggaaccctggtcaccgtctcctcagcctccaccaagggcccatcggtcttccccctggccgccctgctccaggacgcacctccgagagcacagcggccctgggctgcctggtcaaggactactcccgtgtctgatcgtgagcgggctggcaaggcgcatagnnnn

SEQ ID NO: 118894 - DNA, 505 bp, Homo sapiens
  misc_feature: GYAE6OF01BDF3E.5.86.H09.1.454.CMB.1.raw
  modified_base (422)..(422): a, c, t, g, unknown or other
  misc_feature (422)..(422): n is a, c, g, or t
tcagatcagacacgcacgaccggtgctcgatttagtgctatagacttgggtttggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttctgaggtcagtaagcggccctcaggggtccctgatcgcttctctggctccaagtctggcaacacggcctccctgacccgtctctgggctccagactgaggatgaggctgactattacngcagctcatttgcaggcagccgtatactcgttcggcggagggaccagctgaccgtctagtcagcccaaggcctcgcccctcgg

SEQ ID NO: 118895 - DNA, 509 bp, Homo sapiens
  misc_feature: GYAE6OF01BQZ6I.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgacccgtctctgggctccagactgaggatgaggctgactattactgcagctcatttgcaggcagccgtatacgtcttcggcggaggaccaagctgaccgtcctaggtcacgcccaaggctcgcccctcgg

SEQ ID NO: 118896 - DNA, 520 bp, Homo sapiens
  misc_feature: GYAE6OF01D8JGL.5.86.H09.1.454.CMB.1.raw
  modified_base (213)..(213): a, c, t, g, unknown or other
  misc_feature (213)..(213): n is a, c, g, or t
  modified_base (325)..(325): a, c, t, g, unknown or other
  misc_feature (325)..(325): n is a, c, g, or t
  modified_base (362)..(362): a, c, t, g, unknown or other
  misc_feature (362)..(362): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
tcagatcagacacgcacgaccggtgctcgatttagtgctatagacttggggtttgggggctggggtctcgaggaggcacgcggcttctcaggtacgtctaccaccatggcctgggctctgctcctcctcaccctctcacttcgagggcacagggtcctgggtcccagtctgcccttagactcagcctccctccgcgtccgggtctcctggacngtcgagtcaccatctcctggccactgggaccagccagtgacattggtcgttataactatgtctcctaggtaccaacaacatccaggcaaacgcccccaaatcgtgacttcgnggagtcagtaagcgcctgagggtccctgatcgcttcnctgctcaagtctggcaacgacggcctccngaccgtctcgnggctccagtactgaagatgagctgactatacngacagctnattgcaggcagccgttatactcgttcggcggaaggaccaagctaggccgtcgtagcacgcccaagctcgccccgtcgg

SEQ ID NO: 118897 - DNA, 516 bp, Homo sapiens
  misc_feature: GYAE6OF01ETRJK.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttctgaggtcagtaagcggccctcaggggtccctgatcgcttctctggctcaagtctggcaacacggcctcctgaccgtctctgggcctccagactgaggatgagctgactattactgcagctcatttgctaggcagccgtatacctcgttcggcggagggaccaaggtctcggacccgtccgtaggtcacgcccaaggcctcgccccctcgg

SEQ ID NO: 118898 - DNA, 509 bp, Homo sapiens
  misc_feature: GYAE6OF01DQFJN.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaaacgcccccaaatcgtgatttctgaggtcagtaagcggccctcgaggggtccctgatcgcttctctggctccaagtctggacaacacggcctccctgaccgtctctgggctccagactgaggatgagctgactattactgcagctcatttgcaggcagcctatactcgttcggcggaggaccaagctgaccgtctaggtcacgcccaaggcctcgccccgtcgg

SEQ ID NO: 118899 - DNA, 502 bp, Homo sapiens
  misc_feature: GYAE6OF01A4GD2.5.86.H09.1.454.CMB.1.raw
  modified_base (427)..(427): a, c, t, g, unknown or other
  misc_feature (427)..(427): n is a, c, g, or t
  modified_base (445)..(445): a, c, t, g, unknown or other
  misc_feature (445)..(445): n is a, c, g, or t
tcagatcagacacgcacgaccggtgctcgatttagtgctatagacttgggtttggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttctgaggtcagtaagcggccctcaggggtccctgatcgcttctctggctccaagtctggcaacacggcctccctgaccgtctctgggctccagactgaggatgagctgactattactgcagctnatttgcaggcagccgtanactcttcggcgagggaccaagctgaccgtctaggtcagcccaaggctcgcccctcgg

SEQ ID NO: 118900 - DNA, 517 bp, Homo sapiens
  misc_feature: GYAE6OF01AWZOV.5.86.H09.1.454.CMB.1.raw
  modified_base (308)..(308): a, c, t, g, unknown or other
  misc_feature (308)..(308): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaatcgtgatttcngaggtcagtaagcggccctcgacggggtccctgatcgcttctctggctccaagtctggcaacacggcctccctgacccgtctcgtcgggcctccgagactgaggatggaggctgactattactgcagctctatttgctaggcagccgtatctcgttcggcggaggaccagctcggccgtctaggtcacgcccaaggctcgccccgtcgg

SEQ ID NO: 118901 - DNA, 529 bp, Homo sapiens
  misc_feature: GYAE6OF01BO3K5.5.86.H09.1.454.CMB.1.raw
  modified_base (373)..(373): a, c, t, g, unknown or other
  misc_feature (373)..(373): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttctgaggtcagtaagcggccctcgacggggtccctgactcgcttctctggctccaagtctggcaacncggccctccctgaccgtctcgtcgggcctccgagactggaggatggaggctgacttattactgcagctctatttgcgtaggcagtccgtactactcgttcggcggacggaccagtctacgccgtacgtaggcacgcccaaggcctcgccccgtcgg

SEQ ID NO: 118902 - DNA, 578 bp, Homo sapiens
  misc_feature: GYAE6OF01C4EAP.5.86.H09.1.454.CMB.1.raw
  modified_base (445)..(445): a, c, t, g, unknown or other
  misc_feature (445)..(445): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggacaaacgcccccaaactcgtgatttctgaggtcagtaagccggcctcgacggggtccctgactcgtcttctctggcctaccgaagtctaggaccaacgaccggcctcccgtcgacccgtctcgtgggcctccagtacgtgaggatgaggctgactattacgngcacgtctctagtttcgacgtacggacacgtaccgtattaccgtcgttccgggacgggacgggaccgaacgccgtacggtacccgttaccgtacggtccgacgacccgaacggtccctccgcccccgttacgg

SEQ ID NO: 118903 - DNA, 527 bp, Homo sapiens
  misc_feature: GYAE6OF01EOSG9.5.86.H09.1.454.CMB.1.raw
  modified_base (524)..(527): a, c, t, g, unknown or other
  misc_feature (524)..(527): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaaggcaatatacaagactacacagactccgtgaagggccggttcaccacctcgagagacaactccagggacacggtgtacctacaccatgaacagcctgagagccgaggacacggcccgtatattattgtgtgaggggaaactgggggcaatttgaccgctggggccagggaaccctggtcaccgtctcctcagcctccaccaagggcccatcggtcttccccctggcgccctgctccaggacgcacctccgagacgcacagccggccctgggcctgcctggtccaaggactactcccgtgtctgatctgagcgggctggcaggcgcatagnnnn

SEQ ID NO: 118904 - DNA, 533 bp, Homo sapiens
  misc_feature: GYAE6OF01EQ3YW.5.86.H09.1.454.CMB.1.raw
  modified_base (314)..(314): a, c, t, g, unknown or other
  misc_feature (314)..(314): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
  modified_base (527)..(527): a, c, t, g, unknown or other
  misc_feature (527)..(527): n is a, c, g, or t
  modified_base (530)..(533): a, c, t, g, unknown or other
  misc_feature (530)..(533): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaaatattaaatggaaaaggcaatatacaagactacacagactccgtgaagggccggttcaccacctcgagagacaactccagggacacggtgtacctacacatgaacagcctgagagccgaggacacggccgtanatattgtgtgaggggaaactgggggcaattgaccgctggggcagggaaccctggtcacgtctcctcagcctccaccaagggcccatccggtcttccccctggccgccctgcctccaggcgcaccctccgagacgccaacagcggccctgggcctgcctggtcaacggactacttcccgtgtctgacccctntgngcgggctggcaaggcgcanagnnnn

SEQ ID NO: 118905 - DNA, 530 bp, Homo sapiens
  misc_feature: GYAE6OF01CAP0G.5.86.H09.1.454.CMB.1.raw
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttcngaggtcagtaagcggcctgagggtccctgatcgcttcntggctccaagtctggcaaacncggcctccctgaccgtctcgtgggctccagactgagatgagctgactatactgnagctnatttgactaggcagtcccgtatacctcgttccggcggaggaccgaacgtctacggcccgttaccgtaggtaccacggacccaaggccttcggccccccgttaccgg

SEQ ID NO: 118906 - DNA, 569 bp, Homo sapiens
  misc_feature: GYAE6OF01ECABD.5.86.H09.1.454.CMB.1.raw
  modified_base (487)..(487): a, c, t, g, unknown or other
  misc_feature (487)..(487): n is a, c, g, or t
tcagatcagacacgcacgaccggtgctcgatttagtgctatagacttgggtttggggtgctcgatttagtgctatagacttgggtttgggatctacgttgcaggtgtaggtctgggtccctgagactctcctgtgcagcctctggattcacctttactgattttggcatgacgtgggtccgccaggctccgagggaaggggctggactggctctcaaatattaatggtaaaaggcaatatacaagactacacagactccgtgaaggccggttcaccactcgagagacaactccagggacacggtgtacctacacatgaacagcctgagagccgaggacacggccgtatattatgtgtagaggggaaactggggacaagtttgaccgcgtggggccagggaaccctggtcaccgtctcctcgacgccctccaccaagggccccagtccggtaccttcccccgtggcccgccctcgcctcccgaggacncaccgtccgagacgcacgagccggccctggcctgcctggtaccaaggaccttaccgttcccgtgtcctagactcgtggacgg

SEQ ID NO: 118907 - DNA, 523 bp, Homo sapiens
  misc_feature: GYAE6OF01A9JWJ.5.86.H09.1.454.CMB.1.raw
  modified_base (369)..(369): a, c, t, g, unknown or other
  misc_feature (369)..(369): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttctgaggtcagtaagcggccctcgaggggtccctgactcgcttctctggctcaagtctggcaacncggccctccctgaccgtctcgtgggctccagactgaggatgaggctgactattactgcagtctctatttcgctaggcagccgtatactcgttcggcggaggaccaagctcggaccgtccgtaggtccacgacccgaaggcctcgcccccgtcgg

SEQ ID NO: 118908 - DNA, 502 bp, Homo sapiens
  misc_feature: GYAE6OF01A0XJU.5.86.H09.1.454.CMB.1.raw
  modified_base (421)..(421): a, c, t, g, unknown or other
  misc_feature (421)..(421): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagctgagatgaggctgactattacngcagctcatttgcaggcagccgtatcgtcttcggcgagggaccagctgccgtctaggcacgcccaaggcctgccccgtcgg

SEQ ID NO: 118909 - DNA, 546 bp, Homo sapiens
  misc_feature: GYAE6OF01C54UB.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaaccctggtcaccgtctcctcagccctccaccaagggccccatcggtcttccccctggccgccctgcctccgaggacgccacctccgagacgcacagccggccctgggctgcctggtcaaggctacttcccgtgtctgactctgacgg

SEQ ID NO: 118910 - DNA, 519 bp, Homo sapiens
  misc_feature: GYAE6OF01BPRJ4.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttctgaggtcagtaagcggccctcgacggggtccctgactcgcttctctggctcaagtctggcaacacggcctcctgaccgtctcgtgggctccagactgaggatgaggctgactattactgcagtctcatttgcaggcagtcgtatactcgttcggcggagggaccaagtctcggaccgtcgtaggtccacgacccaaggctcgccccgtcgg

SEQ ID NO: 118911 - DNA, 649 bp, Homo sapiens
  misc_feature: GYAE6OF01DICJL.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcaccttttactgattttggcatgacgtgggtccgccaggctccgagggaaggggctggactggctctacaaatattaaatggtaaaggcaatataacaagactacacagactccgtgaagggccggttcaccacctcgagagacaactccagggacacggtgtacctacacatgaacagcctgagagccgagacacggccgtatattatgtgtggagggaaacgtggggactaagtttggacccgcgtggggacccgaaggggtaaccctcgggtccaacccggttcctcccgtacgaccgcccttacccgaaccgaaacggggccccaacgttcccgggtccctttccccccgtgggcccgccccgtgcccgtcccgtaggacgcccacccgtccgaacgacgccacgacggccggaccccgtgggccctcggcccgtggtaccgaaaccgggaccttacccggtttccccgacgttctaggcttccgtggtaccgggg

SEQ ID NO: 118912 - DNA, 551 bp, Homo sapiens
  misc_feature: GYAE6OF01A69I4.5.86.H09.1.454.CMB.1.raw
  modified_base (471)..(471): a, c, t, g, unknown or other
  misc_feature (471)..(471): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaagggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaccctggtcaccgtctcctcacgcctccaccaacgggcccatcggtctccccctggacgccctgcctccagganccacctccgagacgccacacgcggccctgggctcggcctgggcaacgggactacgttcccgtgtcgtgactcgtgacggg

SEQ ID NO: 118913 - DNA, 576 bp, Homo sapiens
  misc_feature: GYAE6OF01C85AX.5.86.H09.1.454.CMB.1.raw
  modified_base (428)..(428): a, c, t, g, unknown or other
  misc_feature (428)..(428): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccgagggaaggggctggactggctctcaaaatattaaatggtaaaaggcaaatataacaagactacacagactccgtgaaagggccggttcaccacctcgagagacaactccaggacacggtgtacctacacatgaacagcctgagagccgaggacacggccgtatattattgtgtgaggggaaactggggcaagtttgaccgcgtggggccaagggaaccctggtccaaccgtctccncacgccctccaaccgaacgggcccatccggtccttcccccgtcggccgcccctgcctccgacggacgccacctccgagcgcacgacgccgcccgtgggctcggccgtggtccaaggtacctacttcccgtcgtctgactcgtggacgg

SEQ ID NO: 118914 - DNA, 524 bp, Homo sapiens
  misc_feature: GYAE6OF01CBT4N.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctctggtaccaacaacatccaggcaaacgccccaaactcgtgatttctgaggtcagtaagcggccctcgaggggtccctgactcgcttctctggctccaagtctggcaacacggcctccctgaccgtctcgtcgggctccagactgaggatggaggctgactattactgtcagctctatttgcgtaggcagccgtatacgtcgttcggcggaggaccgaagctaggcccgtctacggtcgacgcccaaggcctcgcccccgtcgg

SEQ ID NO: 118915 - DNA, 525 bp, Homo sapiens
  misc_feature: GYAE6OF01DULE4.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggacaaacgcccccaaactcgtgatttctgaggtcagtaagccggccctcgacggggtccctgactcgcttctctggctcaagtctggcaacacggcctccctgaccgtctcgtcgggcctccgagactgaggatgaggtctgactattactgcagtctctattgcaggcagtccgtatactcgtcggcggaggaccgagtctcggaccgtccgtagtcacgacccgaggcctcgccccgtcgg

SEQ ID NO: 118916 - DNA, 508 bp, Homo sapiens
  misc_feature: GYAE6OF01C5YUM.5.86.H09.1.454.CMB.1.raw
  modified_base (426)..(426): a, c, t, g, unknown or other
  misc_feature (426)..(426): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaaagcccccaaaatcgtgatttctgaggtcagtaagcggccctcaggggtccctggactcgcttctctggctccaagtctggcaaacacggcctcctgaccgtctctgggctcagactgaggatgagctgactattactgnagctcatttgcagcagccgtatactcttcggcggaggaccaagctagaccgtcctaggtcacgcccaaggctcgcccctcgg

SEQ ID NO: 118917 - DNA, 560 bp, Homo sapiens
  misc_feature: GYAE6OF01B6VBQ.5.86.H09.1.454.CMB.1.raw
  modified_base (307)..(307): a, c, t, g, unknown or other
  misc_feature (307)..(307): n is a, c, g, or t
  modified_base (433)..(433): a, c, t, g, unknown or other
  misc_feature (433)..(433): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaatcgtgatttcngaggtcagtaagcggccctgaggggtccctgactcgcttctctggctaccaagtctggccaacacggccctcccgtgacccgtctcgtcgggcctccagactgaggatggaggctagactattacngcagtctctatttgcgtaggcagtccgtataccgtcgttcgggaccggtagggaccctaaggccgtacggacccgttaccgtaggtaccacggaccccaagggccctccggtccccccgttaccggg

SEQ ID NO: 118918 - DNA, 557 bp, Homo sapiens
  misc_feature: GYAE6OF01C6GW0.5.86.H09.1.454.CMB.1.raw
  modified_base (313)..(313): a, c, t, g, unknown or other
  misc_feature (313)..(313): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaaacgccccccaaaactcgtgtatttcngaggtcaggtaacgcggccctcgacggggtccctggactcgtcttctctggctccaagtctggccaaacacggtccctccctgaccgtctcgtcgggcctccgagactgaggatgaggctgactattactgcagtctctatttgcaggcacgtaccgtatacgtcgttcgggccggtagggaccgtaagctcggacccgttacccgtaggtccacggcccaaggtccctccggtcccccgtcgg

SEQ ID NO: 118919 - DNA, 649 bp, Homo sapiens
  misc_feature: GYAE6OF01BSIWU.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtcctcgtgtaccaacaacactccgagacaaaccgaccccaaacgtcgtagtactttcgtaggacggtcaaggtaacggcccggtacccctcggaccggggttccctaggacgttccggtcctttctcgtcggtcctaccgaacggtcgtacggaccaaaccgccggtcccctcccgtacgtacccgtctcgtcggtcctccgacgtactaggacggtagtacggacggtctacgtaacttacttacgtcgtcgacgtctactagtttcgacgtacgcgtacgtccgttactacgttcgtacgggtacggaccgggaacgtacgtacgtaccggtaccggttccgtacggtaccgtacggtacccgaacggtcctcccgtccccgtacccgg

SEQ ID NO: 118920 - DNA, 520 bp, Homo sapiens
  misc_feature: GYAE6OF01C80WY.5.86.H09.1.454.CMB.1.raw
  modified_base (388)..(388): a, c, t, g, unknown or other
  misc_feature (388)..(388): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaaactcgtgtattctgaggtcagtaagcggcctcaggggtccctgatcgcttctctggctccaagtctggcaacacggcctccctgaccgtctcngggctcagctgaggatgagctgactattactgcagctctatttgcaggcagtccgtatacttcgttcggcgggaggaccgaagtctacggaccgtccgtagtccacggtcccaaggcctcgccccgtaccgg

SEQ ID NO: 118921 - DNA, 520 bp, Homo sapiens
  misc_feature: GYAE6OF01AQ06C.5.86.H09.1.454.CMB.1.raw
  modified_base (309)..(309): a, c, t, g, unknown or other
  misc_feature (309)..(309): n is a, c, g, or t
  modified_base (424)..(424): a, c, t, g, unknown or other
  misc_feature (424)..(424): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttcngaggtcagtaagcggcctcgaggggtccctgatcgcttctctggctcaagtctggcaacgacggcctcctgaccgtctcgtgggcctccagactgaggatgagctgactattacngcagctctagtttcgctaggcagccgtatacgtcgttcggcggaggaccagctaggacccgtcgtaggtcacgacccaaggcctcgccccgttcgg

SEQ ID NO: 118922 - DNA, 514 bp, Homo sapiens
  misc_feature: GYAE6OF01BIRFV.5.86.H09.1.454.CMB.1.raw
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttcngaggtcagtaagcgcctnagggtccctgatcgcttctctggctccaagtctggacaacacggcctccctgaccgtctctcgggctccagactgacggatggagctgactattactgcagtctctatttcgcaggcagccgtatactcgttcggcggacgggaccagctcggacccgtcgtaggcacgccaaggcctcgccccgtcgg

SEQ ID NO: 118923 - DNA, 542 bp, Homo sapiens
  misc_feature: GYAE6OF01C3ZKQ.5.86.H09.1.454.CMB.1.raw
  modified_base (305)..(305): a, c, t, g, unknown or other
  misc_feature (305)..(305): n is a, c, g, or t
  modified_base (377)..(377): a, c, t, g, unknown or other
  misc_feature (377)..(377): n is a, c, g, or t
tcagatcagacacgcacgaccggtgctcgatttagtgctatagactttgggtttgggggactggggtctcaggaggcagcgctctcaggacgtcaccaccatggcctgggctctgctcctcctcaccctctcactcaggcacagggtcctgggcccagtctgccctgactcagcctccctccgcgtccgggtctcctggacagtcagtcaccatctcctgcactgggaccagcagtgacattggtcttaatactatgtctctggtaccaacacatccaggcaaacgcccccaaatcgtgatttcngaggtcagtaacgcggtcctcgacggggtccctgactcgacttctctggctcaagtctgcaacacggctccngaccgtctcgtggctcagactgaggatggagctacgactacttacgtgcagtctactatttcggctacggcacgtccgtattacttcgttcggcgggtacggaccgaagcgtacgaccgtccttaggtcgtacgacccgaaggtccctcgggtcccccttacggg

SEQ ID NO: 118924 - DNA, 608 bp, Homo sapiens
  misc_feature: GYAE6OF01BUYX5.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctctggtaccaacacatccaggcaaacgcccccaaactcgtgtatttctgaggtcagtaagccggccctcgacggggtccctgactcgcttctcgtggcctccaagtctggcaaccacggccctcccgtgacccgtctcgtcgggcctccgacgtactggaaggtatggacgggtctggaacttagttactcggctagtcctactagtttcggactacgggcctacggtccgtacttaccgttccgttccgggaccgggaacgggtaccgaacggtccgttaccggcccgttaccgtacggtaccgtaccggaccccgaaggtcccgttcccggccccccgttacccgg

SEQ ID NO: 118925 - DNA, 643 bp, Homo sapiens
  misc_feature: GYAE6OF01DRK6Q.5.86.H09.1.454.CMB.1.raw
  modified_base (311)..(311): a, c, t, g, unknown or other
  misc_feature (311)..(311): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgactagttggtacgttataactatgtctcctggtaccaacacatccaggcaaacgccccaaactcgtgtattcngagtcagtagcgcctcgacgggtccctgactcgtcttctctggctcagtcgtggacaacgacggtccctcccgtcgacccgtcgtccgtcgggtcctccgacgtacgtaggacgggtactcggacgggtacgttacggtacctttaacgtttaacgtcgtactaacggtcttaccgtaagttttcggcgtacgggctacggtaccgttacgtaccgttccggttacgggacgggtacggaacccgaacggtccgttacggtacccgttacccgtacgggtacccgtaacggaccccgaacgggtcccgttcccggtccccccgttacccggg

SEQ ID NO: 118926 - DNA, 597 bp, Homo sapiens
  misc_feature: GYAE6OF01AZLW7.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatatattgtgtgaggggaactgggggctaagtttgaccggcgtggggcccaggggaaccctggtcaccgtctcctcacgcctccaccaacgggcccatccggtccttcccccgtggccgtcccctcgcctcccgacggacgccacccgtcccgagacgccacgacgccgggccctcgggcctcgcccgtgggtaccgaacgggaccttacccgtttcccggtacgttccgtagtactccgtggtaccggg

SEQ ID NO: 118927 - DNA, 548 bp, Homo sapiens
  misc_feature: GYAE6OF01AE254.5.86.H09.1.454.CMB.1.raw
  modified_base (439)..(439): a, c, t, g, unknown or other
  misc_feature (439)..(439): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgggaccagcagtgacattggtcgttataactatgtctcctggtaccaacaacatccaggcaaaacgccccccaaactcgtgtatttctgaggtcaagtaagcggccctcgaggggtccctgactcgtcttctctggctccaagtctggcaacacggccctccctgacccgttctctgggcctccgagactgaggatggaggtctgactattacngcagctcatttcgcacggtcacgccgtataccgttcgtccgggcggacgggaccaagtcctacggtacccgtccgtaggtcacgacccgaaggcctccgcccccgtcgg

SEQ ID NO: 118928 - DNA, 590 bp, Homo sapiens
  misc_feature: GYAE6OF01ERZ39.5.86.H09.1.454.CMB.1.raw
  modified_base (270)..(270): a, c, t, g, unknown or other
  misc_feature (270)..(270): n is a, c, g, or t
  modified_base (305)..(305): a, c, t, g, unknown or other
  misc_feature (305)..(305): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactgggaccagcagtgacattggtcgttataactatgtctctgtaccaanaacatccaggcaaacgcccccaaatcgtgatttcngaggtcagtaagcggccctcgaggggtccctgatcgcttctctggctcaagtctgcaacacggcctccgtcgaccgtctcgtgggcctccagactgaaggntggagtctagactattacgngcagtctctatttgcgtagcctagtcccgtattaccgtcgttaccgggccgggaacgggtacccgaacggtccgttaccggtaccccgttacccggttaacgggttacccgaaaccggacccccgtaaacgggtccccgtcccgtaccccccccggttcccggg

SEQ ID NO: 118929 - DNA, 548 bp, Homo sapiens
  misc_feature: GYAE6OF01DFHHG.5.86.H09.1.454.CMB.1.raw
  modified_base (309)..(309): a, c, t, g, unknown or other
  misc_feature (309)..(309): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactgggaccagcagtgacatttggtcgttataactatgtctcctggtaccaacaacatccaggcaaacgcccccaaatcgtgtatttcngaggtcagtaagccggccctcacggggtccctgactcgcttcgtctggctacaagtctggctaacgacggccctcccgtgaccgtctcgtggccttccgagtactgaggatggagctgactattactgacagtctctatttgactaggctagtaccggtataccgtcgttcggcgggtacggaccgaagtcctaggacccgttcgaggtccgacgacccgtaggcctcgcccccgtcgg

SEQ ID NO: 118930 - DNA, 706 bp, Homo sapiens
  misc_feature: GYAE6OF01EGGU7.5.86.H09.1.454.CMB.1.raw
  modified_base (309)..(309): a, c, t, g, unknown or other
  misc_feature (309)..(309): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttcngagtcagtagccgcctcgacgggtcctgactcgtcttctcgtcggtctacgaagtcgtaggaccaacgaccggtccctcccgtacgtacccgttctcggtcgggcctaccgaagtaccgtaggaaggtagtcggacggtctacggtaactttacgttaacgtcgtaccgtacgtccttacgttaacgtttcggaccggtagggtacccgtaaccggtacccgtttaacgtttacccggttacccggtttaccgggggaccggggtaaaccggggtaaacccgaacggttacccgttaccgggtaacccccggttacccggttaacgggtaccccgaacccgggtaccccggtaaacgggtccccggttaacccccggtcccccccggtttacccggg

SEQ ID NO: 118931 - DNA, 582 bp, Homo sapiens
  misc_feature: GYAE6OF01CKMIE.5.86.H09.1.454.CMB.1.raw
  modified_base (312)..(312): a, c, t, g, unknown or other
  misc_feature (312)..(312): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgactattggtcgttataactatgtctcctggtaccaacaacatccaggacaaacgcccccaaactcgtgatttcngaggtcagtagcggccctgacgggtccctagactcgtcttctcgtcggctaccaagtcgtcggacctaaaccgacggtccctccgtcgtacccgtctcgtcgggcctcgagtactggagagtgaggctagacttagttactcgcagtctctaagtttcgacgtacggtctacgtccgttataccgttccgttacggccggaacggaccgtacgcgtcggtacccgttccgtaggccgacggacccgtaggccctccggtccccgtaccgg

SEQ ID NO: 118932 - DNA, 588 bp, Homo sapiens
  misc_feature: GYAE6OF01CFEKH.5.86.H09.1.454.CMB.1.raw
  modified_base (388)..(388): a, c, t, g, unknown or other
  misc_feature (388)..(388): n is a, c, g, or t
  modified_base (467)..(467): a, c, t, g, unknown or other
  misc_feature (467)..(467): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaatatacaagactacacagactccgtgaaggccggttcaccacctcgagagacaactccagggacacggtgtacctacacatgaacagcctgagagccgaggacacggccgtatattattgtgtgaggggaaactggggactaagtttgaccgngtcggggccacggggaaccctggtccaccgtctcctcgacgccctccaccgaacgggcccagtccggtccttcccccgnggcccgtcccctgcctccgacggtacgccgaccctccgacgacgcgaccaggccgcccgtcgggctcggccctgggtacaacggaccttaccgttcccgtcgtcgtgacttcgtgtacggg

SEQ ID NO: 118933 - DNA, 695 bp, Homo sapiens
  misc_feature: GYAE6OF01DN0GC.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatctcctgcactgggaccagcagtgacattggtcgttataactatgtctcctggtaccaacaacactccaggcaaacgccccccaaaactcgtgatttctgaggtcagtaagcggccctcgacggggtccctgatcgtcttctcgtcggctaccaagtctggccaacgaccggccctcccgtcgacccgtctcgtcgggtcctccgagtactggaaggtagtcggaggtcttaggtaccttaagtttaccgtggcctaacggtccttacgttacgttttcggaccgtagggacctacggtacccgtttaacgttaacccgtttcccggtttaccggggacccggggtaacggggaacccgtaaaacgggtcccggttaccgggtaacccccggtttaccccggttaacggggtaccctaaccgggtaaccccccggtaaacggggtcccccgttaccccggtcccccccccggtttacccgggg

SEQ ID NO: 118934 - DNA, 710 bp, Homo sapiens
  misc_feature: GYAE6OF01C0GLG.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacagggtcctgggcccagtctgccctgactcacgccctccctccgcgtccgggtctccgtggacagtcagtcaccatctcctgcacgtgggaccagcagtgactagttggtacgttaataactatcgtctccgtaggtaaccaaacaacataccgaggaccaaaccgaccccctaaactcgtagtactttcgaggtacggtacaaggtaacgcccggtccctacggaccggggttccctgtactcgtcctttcgtcgtcggtcctacgtaacgtcgtcggaccaaccgaccggtcccttcccgtcgtacccgtcgtcgtcgggtcctaccgacgtacgtagaacggtagttagggacgtcgttacgtaacttacgtttacgtcgtactacgtcttcgtaacgtttcgaccggtacggtcctacggtaccgttacgttaacccgttcggttacccgggacgggtaacgggtaacccgacggtacccggttaccgggtaccccgttacggttaaccgggtacccgtaccggtaaccccggtaacggtccccgtcccgggtccccccggttacgg

SEQ ID NO: 118935 - DNA, 505 bp, Homo sapiens
  misc_feature: GYAE6OF01C631F.5.86.H09.1.454.CMB.1.raw
  modified_base (270)..(270): a, c, t, g, unknown or other
  misc_feature (270)..(270): n is a, c, g, or t
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
  modified_base (434)..(434): a, c, t, g, unknown or other
  misc_feature (434)..(434): n is a, c, g, or t
  modified_base (495)..(495): a, c, t, g, unknown or other
  misc_feature (495)..(495): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactgggaccagcagtgacattggtcgttataactatgtctctgtaccaanaacatccaggcaaaacgcccccaaatcgtgatttcngaggtcagtaagccggcctcgaggggtccctgactcgcttctctggctccaagtctggcaaacncggccctccctgacccgtctcgtgggcctccgagactgaggatgagctgactatactgcagctntattgcgagcagctatactcgtcggcggaggaccgagctcgccgtctagcacgaccagccncgccccgtcg

SEQ ID NO: 118936 - DNA, 582 bp, Homo sapiens
  misc_feature: GYAE6OF01CEL99.5.86.H09.1.454.CMB.1.raw
  modified_base (382)..(382): a, c, t, g, unknown or other
  misc_feature (382)..(382): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaagcaatatacaagactacacagactccgtgaaggccggttcaccacctcgagagacaactccagggacacggtgtacctacacatgaacagcctgagagccgaggacacggccgtatattatgtgtgagggaaactggggcaatttgaccgntcggggccagggaaccctggtcaccgtctcctcacgccctccaccaacgggcccatccggtccttcccccgtggccgccctcgcctcccgaggacgccacctccgacgacgccacacggccggcccgtgggcctcggcccgtagggtcctaacgggacccttaccgttccccggttgtacccttagctcgtggtaccggg

SEQ ID NO: 118937 - DNA, 709 bp, Homo sapiens
  misc_feature: GYAE6OF01C71OY.5.86.H09.1.454.CMB.1.raw
  modified_base (313)..(313): a, c, t, g, unknown or other
  misc_feature (313)..(313): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgacattggtcgttaataactatgtctcctggtaccaacaacatccaaggcaaacgacccccaaaatcgtgatttcngaggtcagtaagcggccctcgacggggtccctgactcgcttctcgtggtctacaagtctcggccaaacgaccggccctacccgtcgtacccgtctccgtcgggtcctccgaacgtaccgttaggaacggtagtcggacgggtctacggtaaccttactttaccgtcggacctacgtccgttaccgtaacgtttttcggaccgtacgggacgtaacggtacccgtttacctttaccgttcccgtttaccgggggaccggggtaaacggggaaccccgaaagggtacccggttaccgggtaaccccggtttaccccggttaacgggttaccccgaaccgggtaaccccccgtaaagggtcccccggttacccggttcccccccccggttaacccgggg

SEQ ID NO: 118938 - DNA, 519 bp, Homo sapiens
  misc_feature: GYAE6OF01A5XV7.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcgaggggtccctgactcgcttctctggctccaagtctggcaacacggcctccctgacccgtctcgtgggcctccgagactggaggatgaggctagactattactgcagctctatttgcaggcacgccgtatacctcgttcggcggacggaccagcgtgcccgtctaggtcagcccaaggcctcgcccctcgg

SEQ ID NO: 118939 - DNA, 516 bp, Homo sapiens
  misc_feature: GYAE6OF01EO2QZ.5.86.H09.1.454.CMB.1.raw
  modified_base (399)..(399): a, c, t, g, unknown or other
  misc_feature (399)..(399): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgactagttggtcgttataactatgtctctgtaccaacaacatccaggcaaacgccccaaatcgtgattctgagtcagtaagccggcctcgaggggtccctgactcgcttctctggctccaagtctgcacacggcctcctgacctctctcggctcagactgagntgagctgactatctgcagctctattgctagcacgccgtatactcgttcggcggaaggaccgacgtctacggcccgtacgtaggaccacgacccgaaggtcctccgtccccgttccgg

SEQ ID NO: 118940 - DNA, 535 bp, Homo sapiens
  misc_feature: GYAE6OF01DH4U6.5.86.H09.1.454.CMB.1.raw
  modified_base (305)..(305): a, c, t, g, unknown or other
  misc_feature (305)..(305): n is a, c, g, or t
  modified_base (429)..(429): a, c, t, g, unknown or other
  misc_feature (429)..(429): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacagggtcctgggcccagtctgccctgactcagcctccctccgcgtccgggtctcctggacagtcagtcaccatctcctgcactgggaccagcagtgacattggtcgttatactatgtctcctggtaccaacaacatccaggcaaagcccccaaactcgtgatttcngaggtcagtaagccggcctcgaggggtccctgactcgcttctctggctccaagtctggcaacacggcctccctgaccgtctcgtggctccagactggagatgagctgactattactgctagctnatttgctggcagccgtatactcgttcggcgggtacggacgaacgctacggtacccgtccgttagggtacccacgacccgaaggtccctccgtccccccgttaccgg

SEQ ID NO: 118941 - DNA, 589 bp, Homo sapiens
  misc_feature: GYAE6OF01ENKPG.5.86.H09.1.454.CMB.1.raw
  modified_base (450)..(450): a, c, t, g, unknown or other
  misc_feature (450)..(450): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaaactcgtgatttctggaggtcagtaagccggccctcgacggggtccctgatcgcttctctcggctccaagtctcggaccaacgaccggcccttcccgtcgtacccgtctccgtcgggcctccgagactggaggatggaggctgacttattacgngtcagtctcactttgctaggcacggccgttataccttcggttacggcgggaacgggtacccgaagtccgtacggtcccggtacccgtaggtaccctacggacccgaacgggtcccttcccgggccccccgttacccggg

SEQ ID NO: 118942 - DNA, 571 bp, Homo sapiens
  misc_feature: GYAE6OF01DIVOH.5.86.H09.1.454.CMB.1.raw
  modified_base (288)..(288): a, c, t, g, unknown or other
  misc_feature (288)..(288): n is a, c, g, or t
  modified_base (414)..(414): a, c, t, g, unknown or other
  misc_feature (414)..(414): n is a, c, g, or t
  modified_base (452)..(452): a, c, t, g, unknown or other
  misc_feature (452)..(452): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaaatattaaatggtaaaaggcaaatataacaagactacacagactccgtgaaggccggttcaccacctcganagacaactcaggacacggtgtacctacacatgaacagcctgagagccgaggacacggccgtatattatgtgtgaggggaaactggggcaatttgacgcgtgggcagggacctggtcaccgtctccncacgcctaccacgaacggcccagtccgtccttccccgnggccgcccctgcctacgaggacgccacccgtaccgagacgacacgacggccgccgcggcctcggcctggaccgaacggtaccgttacccgttccgtcgtacgtagactgtggtaccggg

SEQ ID NO: 118943 - DNA, 552 bp, Homo sapiens
  misc_feature: GYAE6OF01B41UO.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacagttggtcgttataactatgtctcctggtaccaacaacatccaggacaaacgcccccaaactcgtgatttctgaggtcagtaagcggcctcgaggggtccctgatcgcttctctggctcaagtctggcaacacggccctccgtgaccgtctcgtcgggctccagacgtgaggatggaggtctagactatactgcagctctatttcgcgtaggcagccgttatacgttccgttcgggacgggacggaaccgaacggtcgtacggtacccgttcgtaacggtccacggaccccaaggtccctcggcccccgtcgg

SEQ ID NO: 118944 - DNA, 620 bp, Homo sapiens
  misc_feature: GYAE6OF01B1A9B.5.86.H09.1.454.CMB.1.raw
  modified_base (369)..(369): a, c, t, g, unknown or other
  misc_feature (369)..(369): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacagttggtcgttataactatgtctcctggtaccaacaacatccaggcaaacgcccccaaaactcgtgactttctgaggtcagtaagcggccctcgacggggtccctgactcgcttctctggctccaagtcnggaccacgacgcctccctgaccgtctctcggctccagactggaggatgacgtctgtacttacttacgtcgcagtcttctacgttttcgacgtacggacctacggtcccgttaattacccgttccgtttaccggggaccgggtaacggggaacccctaaagggtcccgttacgggtaccccggttaccgttacggggtaccctacgggtacccccgtaaacgggtccctccggtcccccccggttacccggg

SEQ ID NO: 118945 - DNA, 637 bp, Homo sapiens
  misc_feature: GYAE6OF01A0T3L.5.86.H09.1.454.CMB.1.raw
  modified_base (309)..(309): a, c, t, g, unknown or other
  misc_feature (309)..(309): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgacattggtcgtataactatgtctctgtaccaacaacatccaggacaaacgcccccaaatcgtgtactttcnggacggtcaggtaacgccggccctcgacggggtccctgactcgcttcgtctgctccaagtccgtggaccaacgaccggtcccttcccgtacggtaccgtccgtcgtcgggacctccgagtacgtgacggagtcgaggtctagtacttattacgtcgcgtacgtacttcttacgtttgaccgtaggccgtacggtccgttaacgtaccgttccggtttacgggaccgggtaacgggaaccgtaacggtccgtacggtaccccggttaccggttacggtacccgtaacggaccccgtaacgggtcccttacccggtcccccgttaccggg

SEQ ID NO: 118946 - DNA, 661 bp, Homo sapiens
  misc_feature: GYAE6OF01DEHZU.5.86.H09.1.454.CMB.1.raw
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (321)..(321): a, c, t, g, unknown or other
  misc_feature (321)..(321): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacgagggtcctgggcccagtctcgccctgactcacgccctccctccgcgtccgggtctccgtggacagtcagtcaccatctcctgcacgtgggaccagcagtcgactnttggtcttaataactntgtctctagtaaccaanaacntaccgaggacaaaccaccccaaatcgttgtaacttcgngaggtcaggtaacgccgcccgtcgacgggtccctgactcgtcgttctcgtggcctacctaagtcgtaggaccaaacgccggtcccttcccgtcgacccgttcgtccgtcggcctaccgagactggaaggtatacggacggtctacggtacttaacttcgtcgactacgtctcttagttacggaccgaggtacccgagttacccgttacgtaccgttcggttaccgggccgggtaaccggaacccgtacgggtaccgttacccggtacccggttacccgttaacgggtacccggtaaccggacccgaaccgggtccccgtccggtacccccggttcccggg

SEQ ID NO: 118947 - DNA, 614 bp, Homo sapiens
  misc_feature: GYAE6OF01EA58W.5.86.H09.1.454.CMB.1.raw
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcacgtgggaccagcagtgacagttggtcgttataactatgtctcctaggtaccaacaacatccaggacaaacgcccccaaactcgtgtattcngagtcagtagcgcctcgacgggtcctgatcgtcttctcnggtctcgaagtcgtgaccaacgacggccctccctcgtacccgtctccgtcgggcctccgagtacgtggaggtagtcggacgtctagtaccttattaccgtgacgtagtctacgttagtttcggcgtacggacgtacgtccgttaacttccgttccgttcgggaccgggtacgggacccgtaaggtcctacggtacccggttaccgtacgggacctaccggaccccgtaacgggtcccttccccgggtcccccgttaccggg

SEQ ID NO: 118948 - DNA, 610 bp, Homo sapiens
  misc_feature: GYAE6OF01CBWC5.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactgggaccagcagtgacattggtcgttataactatgtctcctggtaccaacaacatccaggcaaacgcccccaaactcgtgtatttctgaggtcagtaacgcggccctcgacggggtccctgactcgtcttctctcggctccaagtctggacaacgcggtccctcctcgtacccgtctcgtcgggcctaccgagtaccgtggaaggtatgggacggtcttaggtaaccttacgtttacgtcgtacaagtccttacttaagtttcggacgtaaggacctacgtccgttaataccgttccggttaccggggacggaacgggacccgaaggtcctacggtacccgtaccgtacggaccgacgacccgaaggtcctcccggtcccccgttcgg

SEQ ID NO: 118949 - DNA, 589 bp, Homo sapiens
  misc_feature: GYAE6OF01AGWSQ.5.86.H09.1.454.CMB.1.raw
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacagttggtacgttataactatgtctcctggtaccaacaacatccaggcaaacgccccccaaactcgtgatttctggaggtcaagtaagccggtccctcgacggggtccctgactcgtcttctctggctccaagtcnggcaacnccggccctccctgaccgtctcgtcggcctcacgactggagatggacgctgtactattacgtgctacgctctagtttcgacgtacggacacgtaccgttataccgttccggttccgggacgggtacgggacccgtaaggccgtcggtacccgttccgtaacggtcccgaacggccccgaacggtccctcccggtcccccgttacccggg

SEQ ID NO: 118950 - DNA, 692 bp, Homo sapiens
  misc_feature: GYAE6OF01DLYJV.5.86.H09.1.454.CMB.1.raw
  modified_base (216)..(216): a, c, t, g, unknown or other
  misc_feature (216)..(216): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtctcgccctgactcagccctccctccgcgtccggtctccgtggacagtcagtcaccntctcctgcacgtcgggaccagcgagtcgactagttggtacttaataacttatcgttcctccgtagtaaccaacaacactaccgaggacaaaccgaccccctaaactcgtagtactttcgaggacggtcaaggtacgccggtaccctacggtacggggtccctagtacgtccgtcctttcgtccgtcggtacctaccgtaacgtccgtacggacccgtaaccgaccggtcccctcccgtacgtacccgttctccggtcggtccctaccgtaacggtacgtacggaacgggtagttacggaccgggtacttacggtaacctttaacgttaccgtcgacgtacgtccgttcttacgttacgccgtaaggccgtacgtaccgttactacgttccggtacgggacggaacggaccgacggtaccgtaccggtacccgtacgtacgtccgacggacccaggtccctcccggtcccgttaccg

SEQ ID NO: 118951 - DNA, 774 bp, Homo sapiens
  misc_feature: GYAE6OF01CKW9H.5.86.H09.1.454.CMB.1.raw
  modified_base (768)..(768): a, c, t, g, unknown or other
  misc_feature (768)..(768): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccgagggaagggctggactggctctcaaatattaaatggaaaaggcaatatacaagactacacagactccgtgaagggccgttacaccacctgagagacaactccgagggacacggtcgtaacctacacatagaacagcctgagagccgaggacacggcctatattattgtgtaggaagggaacgtgggggactaagtttcggaccgtcggtcggggacccgaacggggaacccgtcgggtaccgtacccggtcctacccgtccgaacggtcccccgttaccccgaaacccggaaccgggtcccccgtaacgttcccgggttccccctttaccccccggtcgggtcccccgtcccccgtcggtccccttacccggaacgggtaccgacccgtaacccccgtccgggaacgtacgacccgaccgaccggcccgggtaccccgtcggggtaccctcgggtccccggttacggggtaaccgtaaccgggttaacccgtttacccgtttaccccggttacgttcccgttacggttaccgttccgggttaacgggacgggttcccgggggtacgttccgggggaaccggaaaccgggtccggtaacctaaggaacgggtcngtcgag

SEQ ID NO: 118952 - DNA, 733 bp, Homo sapiens
  misc_feature: GYAE6OF01BL81S.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccgaggggaaggggctggactggctctacaaatattaagtaggtaaagcaatatacaagactacacagactccgtaggaacgggtccgttacaaccacctacgagagacaactcgagggacacggtctaaccgtacacagtacgaaacgacgcctagaagacggacccggaagggtaccgaacgggaccgttaataacgtttagttggtagtagggaacggggtaaacgtgggggaacttaagtttcggaaccggtcggtacggggacccgtaacggggtaaccccgttcgggtacccgtaacccgttccttacccgtaccgacgtccccctaccgaacccggaacggtcccctaaggtcccggttccccttacccccgtcgggtccccgtccccgtagcccgtaccgtacgggacacccgtaccgtccggaacgtacgaccgaccgtacggcccggaccgtcgggcctcggtccgttcgggacgtaaaccgggtccttaccccgttcccggtacggttactagtaccgttcgccggtacgggg

SEQ ID NO: 118953 - DNA, 560 bp, Homo sapiens
  misc_feature: GYAE6OF01EHL32.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctctgtaccaacaacatccaggcaaacgccccaaactcgtgatttctgaggtcagtaagccggccctcgacggggtccctgactcgcttctctggctcgaagtctggcaacgacggcctccctgtaccgtctcgtcgggcctccgagactgaggtatggacggctgacttattacgtgacagctctagtttcgcgtacggcacgtccgttacttaccgtcgttcgggcggacgggaccgaagtcgtacggacccgtccgtacggccgacggacccgtaaggcccgtccgtcccccgtccgg

SEQ ID NO: 118954 - DNA, 530 bp, Homo sapiens
  misc_feature: GYAE6OF01ASYUI.5.86.H09.1.454.CMB.1.raw
  modified_base (434)..(434): a, c, t, g, unknown or other
  misc_feature (434)..(434): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgggaccagcagtgacattggtcgttataactatgtctcctggtaccaacaacatccaggcaaacgcccccaaactcgtgattctgaggtcagtaagcggccctcgacgggtccctgatcgcttctctggctccagtctggcaacaccggccctcctgacccgttctcgtcgggctccagactgaggactgaggtctgaactatttacgngcagctctagttcgctaggcagccgtatcgtcgttcggcggacggaccagctcggaccgtccgtaggtcacgacccaaggcctcggtccccgtccg

SEQ ID NO: 118955 - DNA, 687 bp, Homo sapiens
  misc_feature: GYAE6OF01B8WJH.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgactattggtacgttataactatgtctcctacgtaccaaacaacatccgaggacaaacgacccccaaatcgtgtatttcgtagaggtcaagtaagccggtccctcgacgggtccctgactcgtcttctctcggctacctaagtcgtagaccaaacgaccggtccctcccgtgaccgtctccgtcgggcctaccgagtacgtggaacggtagtcggaagtctagtaacttacgttacgtcgactacgtcttcgtaagtttcggacgtacggtacctacggtaccgttacgttaaccgttccggtttaccggggaccgggtaacggggtaaacccgtaacgggtcccgttaaccgggtaacccccgggtttacccgttaaacgggttaccccgaacccgggtacccccgaaacggggtcccccgttaccccgggtcccccccggtttcccggg

SEQ ID NO: 118956 - DNA, 582 bp, Homo sapiens
  misc_feature: GYAE6OF01EKL3O.5.86.H09.1.454.CMB.1.raw
  modified_base (406)..(406): a, c, t, g, unknown or other
  misc_feature (406)..(406): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatccgtgatttctgaggtcagtaagcgccctgaggggtccctgatcgcttctctggctccaagtctggcaacacggccctcctgaccgtctcgtgggcctcagactgaggntgagctgacttattactgcagtctctatttcgctacggcacgtccgttaagtaccttacggttccgggaccgggtaacgggacccgtaaaggcccgttacggtaaccccgttcccgttaaggttacccgaacggacccccgaaagggtccccttccggccccccccgttacccggg

SEQ ID NO: 118957 - DNA, 802 bp, Homo sapiens
  misc_feature: GYAE6OF01EB1GZ.5.86.H09.1.454.CMB.1.raw
tcagatcagacacgcacgaccggtgctcgatttagtgctatagacttggggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatcctcctgcacgtgggaccagcaggtgactagttggtacgttaataactatgtcctccgtggtaaccaacaacactcaggacaaaccgccccaaagtcgtagtactttcgtaggacgtcgagtaacgccggtcctacgacggggtccctgacgtccgtctttctcgtcggacctaccgaagttcgtaggtacccaacgtacccggtcccttcccgtacgtacccggttcgtaccggttcgggaccttaccgaacgggtaccgtagggtaaacggtacggttaggtacgggtacgttacggttaaccgtttacgtttaaccgtcgggtaccctaacggttccttaacgttaacggttttcggaaccggtaacgggtacccgttaaccgggttacccgtttaaccgttttaccgggttacccgggttaccggggggtaccgggtaaaccgggggaaaccccgttaaaccgggttaccctacccggggttaaccccggttaacccgggttaacgggttaccccggaaacgggttaacccccggtaaaccgggtcccggtttacccccggtccccccggtttaccccgggg

SEQ ID NO: 118958 - DNA, 571 bp, Homo sapiens
  misc_feature: GYAE6OF01DY843.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaaggcaaatatacaagactacacagactccgtgaagggccggttcaccacctcgagagacaactccagggacacggtgtacctacacatgaacagcctgagagccgaggacacggccgtatattattgtgtgaggggaaacgtgggggacaagtttgaccgcgtcggggccagggaaccctggtcaaccgtcctcctcacgccctccaccgaagggccccagtccgtccttcccccgtggccgccctcgcctccgacggacgccaccctcgagacgcacgagccggccgtgggctcgccgtggacacggtacctcgttcccgtgtctgctcgtggtacggg

SEQ ID NO: 118959 - DNA, 582 bp, Homo sapiens
  misc_feature: GYAE6OF01CCFZY.5.86.H09.1.454.CMB.1.raw
  modified_base (309)..(309): a, c, t, g, unknown or other
  misc_feature (309)..(309): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacagttggtcgttataactatgtctcctgtaccaacaacatccaggacaaacgcccccaaatcgtgatttcngagtcagtacgcggccctgacgggtccctgactcgtcttctctggctccgaagtctggaccaacgacggtccctcccgtgacccgtctcgtcgggcctccgagtacgtaggaggtatggacggtcgtagtacttattacgtcgcacgtctacgtagtttcgacgtaggcacgtccgttactaccgttccgttcgggaccgggaacgggaccgacgtcgtacggtaccgtccgtacggtccgacggacccgaaggccgtccgtcccccgtacgg

SEQ ID NO: 118960 - DNA, 791 bp, Homo sapiens
  misc_feature: GYAE6OF01BVV7C.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcaccatctcctgcacgtgggaccagcagtgactagttggtacgttataactatgtcctcctggtaccaacaacatccaggacaaacgcccccaaactcgtagtactttctagtaggtcaagtaacgccggtacccctcgaacggggttcccctaggactccggtctttccgtcgtcggtccttaccgaaacgtcgtacgggacctaaaccgtaccggtccccttccccgtacggtaccccgttccgtccgtcggggtaccctacccgaacggtacccgtaggtaacgggtacgtacgggacgggtccgttaggtaaccgttaacgtttaacccgtggtaaccgtaggttcctttaccgttaacgttttacggacccgtacgggtacctaccgggtacccgttaacgttaaccccggttccggtttaccgggggaacccgggtaaccgggggtaacccgtaaacggggttccccgttaccggggtaacccccggtttacccggttaacgggttaccccgtaacccgggtaccccggtaaaccgggtccccgttccccggggtaccccccccgtttcccgggg

SEQ ID NO: 118961 - DNA, 534 bp, Homo sapiens
  misc_feature: GYAE6OF01BAOGX.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaaacgcccccaaaactcgtgatttctgaggtcagtaagcggccctcgaggggtccctgatcgcttctctggctccaagtctggcaacacggcctccctgaccgtctcgtcgggctccagactgaggatgagctgactattactgcagctcatttgcgtaggcagtccgtataccgtcgttcggcggacggaccgaagtctacggacccgtccgtaggtccacgccccgaaggtcctccgcccccgtcgg

SEQ ID NO: 118962 - DNA, 576 bp, Homo sapiens
  misc_feature: GYAE6OF01DGXLB.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccaggggaaggggctggactggctctcaaatattaatggtaaaaggcaatatacaagactacacagactccgtgaagggccggttcaccacctcgagagacaactccaggacacggtgtacctacacatgaacagcctgagagcgaggacacggcgtatattattgtgtgagggaaactggggacaatttgacgcgtggggccagggaaccctggtcaccgtctcctcacgccctccgaccgaacgggcccagtccggtccttcccccgtggcccgtccctcgccgtccacggacgccacctccgacgacgacacgacgccggcccgtgggcctcggcccgtggtccgtaaggacctaccgttcccgtcggtctgactcgtgacggg

SEQ ID NO: 118963 - DNA, 601 bp, Homo sapiens
  misc_feature: GYAE6OF01CLQTI.5.86.H09.1.454.CMB.1.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcacgtgggaccagcagtgactattggtcgttataactatgtctcctggtaaccaacaacatccaggacaaacgcccccaaactcgtgatttcngaggtcagtaagcggccctcgaggggtccctgactcgcttctcgtggctccaagtcgtcggacaacgaccggccctcccgtacgacccgtctcgtcgggcctccgacgactggaggatggagtctagacttattactgcaagtctctatttcgcgtaggctacgtaccgttataccgttccggttacgggacggtaacgggacccgtaacggtccgtaccggtacccgttaccggtacggtaccgaccgtaccccggaaggtccccgtacccggtccccccgtaccgg

SEQ ID NO: 118964 - DNA, 567 bp, Homo sapiens
  misc_feature: GYAE6OF01D0MTM.5.86.H09.1.454.CMB.1.raw
  modified_base (307)..(307): a, c, t, g, unknown or other
  misc_feature (307)..(307): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtacttataactatgtctcctgtaccaacaacatccagcaaacgcccccaaactcgtgatttcngagtcagtaagcgccctcgacggggtccctgactcgtcttctcgtggtctaccaagtcctggacaaccgacggtccctcccgtcgacccgttctcgtcgggcctccgacgtactgaggataggagctagaccttattactgcagcttacgtatttggccgtaggcacgtccgttataccgttcgttcgggcggtaacgggacctagtcgtacggtaccgtcgtacggtcgacgtacccgaaggtcctccgccccgtacgg

SEQ ID NO: 118965 - DNA, 678 bp, Homo sapiens
  misc_feature: GYAE6OF01BKTIB.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcaggcacagggtcctgggcccagtctgccctgactcagcctccctccgcgtccgggtctccgtggacagtcagtcaccatctcctgcactgggaccagtcagtgactagttggtcgttaataactatgtctctgtaccaacaacatccaggacaaacgacccccaaatcgtagtatttcgagaggtacagtaacgccggtaccctcgacggggtcccctaggactcgtcttcgtcgtcggcctaccaagtccgtacggacctaaacgtccggtcccctccgtacgtaccgtcgttccgtcgggcctcccgaagtacgtaggacggagttggacggtcttacgtaactttaagttaccgtgtactaacgtcgttactaacgttttcgacgttacggaccgtaacgttacccgttacgttaccgttaccggttaccgggaccgggtaacgggaacccgacggtaccgtaccggtaacccggttccgtaacgggtaccctaaccgggaccccgtaaagggtcccgtccccggtcccccggttaccgg

SEQ ID NO: 118966 - DNA, 703 bp, Homo sapiens
  misc_feature: GYAE6OF01D1081.5.86.H09.1.454.CMB.1.raw
  modified_base (694)..(694): a, c, t, g, unknown or other
  misc_feature (694)..(694): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcaccttttactgtattttggcatgacggtgggtccgccaggctccgaggggaagggctggactggctctacaaattattaagtagggtaaaggactaaataataacaaagacctaacacagactccggtaggaacgggtccgttcaaccaccgtacgagagaacaacctccgaagggaccacggtacgtaacctacacatacgaacacgcctagagacgaccgaggacacggacctatattagtgtgtagggaaggggtaacgtggggtactaaggtttacggaccggtacggtacggggacccgaacggggtaacccgttcgggtcctaacccggttccctcccgtacgaccgccctacccgaacccggaaccggcccctacgttcccggttaccccgttcccccgcggtacccgcccgtcgccgtccgacggacgacccgtacccgtccgaacgacgaccaccgaccggcccggccgtcggccgtcggccggtaggtaccgaacggacccttacccggtccgtcgttacgtcgtacgttccgnggtaccggg

SEQ ID NO: 118967 - DNA, 609 bp, Homo sapiens
  misc_feature: GYAE6OF01EC0EM.5.86.H09.1.454.CMB.1.raw
  modified_base (519)..(519): a, c, t, g, unknown or other
  misc_feature (519)..(519): n is a, c, g, or t
  modified_base (604)..(605): a, c, t, g, unknown or other
  misc_feature (604)..(605): n is a, c, g, or t
  modified_base (607)..(607): a, c, t, g, unknown or other
  misc_feature (607)..(607): n is a, c, g, or t
tcagatcagacacgcacgaccggtgctcgatttagtgctatagacttgagtctgggggaggcttggtacagcctggggggtccctgagactctcctgtgcagcctctggattcacctttactgtattttggcatggacgtgggtccgccaggctccgaggggaaggggctgggactggctctacaaatattaaagtaggaaaagcaaatataacaagactacacagactcgtagaagggccgttcaccactcgagagacaactccgagggacacggtgtacctacacatcgaacagcctgagagccgaggacacggccgtatattagtgtgtggaggggaaacgtgggggactaagtttcggaccgtcggtgggggacccagggggtaacccctgggtaccaccggtctacctcgacgtccctcccgaaccgaacgggccccacgttccggtcccgtttccccccgtgggcccgtccccgtgtccctaccgacggacgcccaccgtccgagacgcacgngccggcctcgggctcgccgtggtcaggtcctaccgttcccgtgtctgctccgtggccggtcgggctggccgaagggcgtcagtgnngncg

SEQ ID NO: 118968 - DNA, 642 bp, Homo sapiens
  misc_feature: GYAE6OF01CABD4.5.86.H09.1.454.CMB.1.raw
  modified_base (274)..(274): a, c, t, g, unknown or other
  misc_feature (274)..(274): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcactgggaccagcagtgacattggtacttataactatgtctcctggtaccaanaacatccaggacaaacgcccccaaatcgtgatttctgaggtcagtacgcggcctcgacgggtccctgactcgtcttctcgtcggctaccgaagtcgtacggaccaaaccgccggtaccctcccgtcgtacccgtcgtaccgtcgggcctaccgacggtactaggacggtagtcggacggtctaggtaacttacgtttacgtgtactacgtctacttacgtttacggcgtacggaccacggtacccgttagttaccttcggttaccggggaccgggaacgggtaaccctaacggtccgttacggtaccccgttacggtaacggtaccgaacggaccccgaacggtccgtcccggtccccccggttccgg

SEQ ID NO: 118969 - DNA, 755 bp, Homo sapiens
  misc_feature: GYAE6OF01D1UD0.5.86.H09.1.454.CMB.1.raw
tcagatcagacacgcacgaccggtgctcgatttagtgctatagacttggggtttgggggctgggggtctcaggaggcagcgctctcaggacgtcaccaccatggcctgggctctgctcctcctcaccctcctcactcgagggcacgagggtcctgggcccagtctcgccctgactcacgccctccctccgcggtccgggtctccgtggacagtccagtccacctatcctcctgcacgtcgggaccagcaggtcgactagtttggtacgttaataacttatcgtctccgtacggtaaccaaacaacactaccgacggacaaaaccgacccccctaaaacgttcggtacgtacttttccgtaggtacggtaccaaggttaacggcccgggtaccccgttacggtacggggttccctaggtacctccggtcctttcgtccgttcggtacctaccgtaaacggtccgtacgggaccaaccggtcccggtcccctcccggtacgtacccgttccgtccggtacggtcctacccgaggtacgtacgggaaggtagtacgggtacggtacctacggtaacttaacgttacgtcgactcgcttacttagttccgacggtacggaccgtacgttaccgtaacttccggttacgggttaccgggacgggtaaccgggaacccgtacggtccgtaccggtacccggttaccggttaacggcccgtaacgacccggaaccggtcccggtcccgccccgttacccggg

SEQ ID NO: 118970 - DNA, 544 bp, Homo sapiens
  misc_feature: GYAE6OF01DBV4A.5.86.H09.1.454.CMB.1.raw
  modified_base (437)..(437): a, c, t, g, unknown or other
  misc_feature (437)..(437): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcaggcacagggtcctgggcccagtctgccctgactcagccctccctccgcgtccgggtctccgtggacagtcagtcaccatctcctgcactgggaccagcagtgacattggtacgttatactatgtctcctggtaccaacaacatccaggcaaacgcccccaaatcgtgtatttctagagtacagtaagccggccctcgacggggtccctgactcgtcttctcgtggctaccagtctggcaacgacggccctcctcgaccgtctcgcgggtctcgacgactgaggatgagctagactattacngcagtctctagtttgcgtagcacgtccgtatcgtcgttcggaccggtaggaccgtacgcgtacgaccgtcgtacggtcgaccgacccaggccctccggccccgtcgg

SEQ ID NO: 118971 - DNA, 516 bp, Homo sapiens
  misc_feature: GYAE6OF01BFR9L.5.86.H09.1.454.CMB.1.raw
  modified_base (426)..(426): a, c, t, g, unknown or other
  misc_feature (426)..(426): n is a, c, g, or t
  modified_base (436)..(437): a, c, t, g, unknown or other
  misc_feature (436)..(437): n is a, c, g, or t
  modified_base (440)..(440): a, c, t, g, unknown or other
  misc_feature (440)..(440): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
  modified_base (514)..(516): a, c, t, g, unknown or other
  misc_feature (514)..(516): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaaggcaatatacaagactacacagactccgtgaagggccgttcaccactcgagagacaactccagggacacggtgtacctacacatgaaacagccctgagagccgaggacacggccgtatattatgtgtgaggggaaactgggggcaagtttgacgctggggcagggaaccctggtcaccgtctacctcacgcctccaccaaggcccatcggtctcccctgcgccctgctcagngcacctccgnngcncagcgcccgtggctcgcctggtcaaggacctctcccgtgtctgtatcgtgagcgggntcggcaaggcncatagnnn

SEQ ID NO: 118972 - DNA, 620 bp, Homo sapiens
  misc_feature: GYAE6OF01CKX02.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgactattggtcgttataactatgtctctggtaccaacaacatcaggcaaacgaccccaaactcgtgtatttctgacggtcaggtaacgcggccctcgacggggtccctgactcgcttctctcggctccaagtcgtacggcaacgaccggtccctccctcgtacccgtctcgtcgggcctcgacgacgtgaggtatggagcttaggacttattacgtgacgtagtctctagtttcgacgtacggtcgacggttaccgtacttaccgttaccgggttcgggaccgggtaacgggaaccgaacggtacgttaccggtaacccggttccgtacgggttaccgaccggtaaccccggtaagggccccttccggtccccccgttacccgg

SEQ ID NO: 118973 - DNA, 618 bp, Homo sapiens
  misc_feature: GYAE6OF01A9YQL.5.86.H09.1.454.CMB.1.raw
  modified_base (613)..(614): a, c, t, g, unknown or other
  misc_feature (613)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
tcagatcagacacgcacgaccggtgctcgatttagtgctatagacttgagtctgggggaggcttggtacagcctggggggtccctgagactctcctgtgcagcctctggattccacctttactgattttggcatgacgtgggtccgccaggctccagggaaggggctggactggctctacaaatattaaatggaaaaggcaatatacaagactacacagactccgtgaagggtccgttcaccacctcgagagacaactccgagggacacggtcgtacctacacatgaacagcctagagacgccgagacacggccgtatattattgtgtggaagggaacgtggggactaagttcgaccgcgtcggggaccgacgggtaacccgtggtccaccgtctcccgtcgacgtccctacccaaccgaaccgggccctacgtcccggttcccttccccgtcggcccgtccccgtgccctccgaaggccgaccgacccgtccgaagcgaccacgaccggccggcccgtaggggactcggaccgtcggtaccgaacggttcctaccgttccgtcgtctcgtactcgtggacggtcgggcgtggccgtaaggcctacgatacgnngngn

SEQ ID NO: 118974 - DNA, 593 bp, Homo sapiens
  misc_feature: GYAE6OF01BZJ2C.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgactagttggtcgttataactatgtctcctggtaccaacaacatccagacaaacgcccccaaactcgtgtatttctgaggtcagtaagcggccctcgacgggtcctgatcgcttctctgctcaagtctggcacacggccctccctgacccgtctcgtcgggcctccgacgtactggaggatggacggcttcgaacttattactgctagctctatttcgcgtagggacacgtaccgttacgtaccgttccggttaccgggcgggtaacgggaccgaacggtccgtaccggtaccccggtaccgttacgggtacccgtacggaccccggaaggccctcccggtccccccggttacccgg

SEQ ID NO: 118975 - DNA, 642 bp, Homo sapiens
  misc_feature: GYAE6OF01D1VJG.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactgggaccagcagtgacagttggtacgttataacttatgtctcctaggtaccaacaacatccagacaaacgacccccaaacgtcgtgtatttcgtagaggtacagtaacgcgccctcgagggtccctgactcgtcttctcgtacggctaccaagttcaggtaccaacgaccggccctcctcggtaccgtcgtcgtggcctaccgagtacgtggagagtaggacggtcgtacgacttagttacgtgacgtacgcttacgttaacttttcggacgtacgggtacgtaacgtacccgttacttaccgttccggttaccgggaccggggaacgggtaaccgaacggtacgttaccggtaacccggttacccgttacggtaccgtaccggacccgtaaacggcccgtcccgtacccccggttcccgg

SEQ ID NO: 118976 - DNA, 585 bp, Homo sapiens
  misc_feature: GYAE6OF01A0DWR.5.86.H09.1.454.CMB.1.raw
  modified_base (310)..(310): a, c, t, g, unknown or other
  misc_feature (310)..(310): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatcctcctgcactgggaccagcagtgacattggtcgttataactatgtctcctgtaccaacaacatccagacaaacgcccccaaactcgtagatttcgngaggtcagtaacgcggccctcgagggtccctgactcgcttctctcggctccgaagtctagacaacgacggcctcctgaccgtctcgcgggcctccgagactggaggatggacgtctagacttattactgacagtctactagtttcgcaggtcagtccgtataccgttcgtccgggacgggaacgggtacccgaaggtccgtacggtacccgttaccggtacggtaccgtaaccgggtacccgaaagggtcccttcccggtccccccgttaccggg

SEQ ID NO: 118977 - DNA, 719 bp, Homo sapiens
  misc_feature: GYAE6OF01DD0GV.5.86.H09.1.454.CMB.1.raw
tcagatcagacacgcacgaccggtgctcgatttagtgctatagactttggggtttgggggctggggtctcagggaggcagcgctctcaggacgtcaccaccatggcctgggctctgctcctcctcaccctcctcactcagggcacagggtcctgggcccagtctgccctgactcacgccctccctccgcgtccgggtctcctggacagtcagtccaccatcctcctgccacgtgggaccagcagtgactgtttggtactttataactattcgtccttccgtaggttaaccaaacaacactaccgaagggaccaaaaccggccccccctaaaaacgttccgttagtaacttttcgtaggtacggtctaaggtaacgtcccgggtacccctcgaacgggggtccctagtacgttccgtcctttcgtcgtcggtccctacgtaacgttccgtcggaccaaccgacccggtcccttccccgtacgtacccgttcttccggtcgggtcctaccgagtaccgtggacggacgtggacgtcgttacgtaaccttattacgtcgccgtaactccgttagttactttcgacgtacgacgaccggtaccgttacgttaccggttccgttccgggaccgggtacgggaaccgtaacggtcggttaccggacccggttacgtaacggtaccaccggaacccgaaggtcccgtacccgtccccgttacccgg

SEQ ID NO: 118978 - DNA, 813 bp, Homo sapiens
  misc_feature: GYAE6OF01CYU0N.5.86.H09.1.454.CMB.1.raw
tcagatcagacacgcacgaccggtgctcgatttagtgctatagacttgggtttggggtgctcgatttagtgctatagacttgggtttgggatctacgttgcaggtgtaggtctgggtccctgagactctcctgtgcagcctctggattcacctttactgtattttggcatgacgtggtccgcaggctccgagggagggctggactggctctacaaatattaagtggtaaagcaaatataacaagactacacagactccgtagaacggccgtacaccactcgagagacaactccagggacacggtatacctacacatagaacagcctagagacgccgaggacgacggaccgtaatagttaagttgtagtaggaaggggaaacgtggggacctaatttacggaccggtcggtacgggggacccgtaacggggtaaccccgtcgggtacccgtaacccggttacctccccgttaccgaaccggtcccccttaacccggaaaccccggaaacccggggtcccccgtaaacccggttcccggggtttaacccccgttccccccccggttaccggggtcccccgtccccccgtttacgggtaccccttacccgggaacgggaaccccggtaccccggaaaccccgttaccccggaaaccggaacggaccccgtaacccggaacgggtcccccgggtaccccggtccggggtcccgtaaccgggttcccggttaaccggggttacccgaaaccgggttaccccttaacccggtttccccggttccgttacgttacgtaccgtacggtcgggtaaccgggg

SEQ ID NO: 118979 - DNA, 768 bp, Homo sapiens
  misc_feature: GYAE6OF01ESMBW.5.86.H09.1.454.CMB.1.raw
tcagatcagacacgcacgaccggtgctcgatttagtgctatagacttgggtttgggggctggggtctcaggaggcagcgctctcgggacgtcaccaccatggcctgggctctgctcctcctcaccctcctcactcagggcacagggtcctgggcccagtctgccctgactcagccctccctccgcgtccgggtctcctggacagtcagtcaccatcctcctgccagtcgggaccagcagtgactagttggtcgttaataactattgtcctccgtaggtaaccaaacaacactaccgaacggaccaaaaccgaccccccaaaacgtcgtagtaacttttccgaggtacggtcaaggtaacgccgacccctggacgggttccctagactccgtctttcgtcgtggcctaccgtaagtccgtcggaccaaaccgtacccggtcccctcccgtcggtacccgttctcggtaccggtccctaccgtacggtaccgttggaacggtacgttacgggaacggttccttacggtaaacctttaacgtttaccgtacggacctaaggtcctttacgttaacgtttccggaacggtaccgggtacgtaccggtacgttaaccgttaccgttcccggtaccggggaacgggtaaccgggaaccgtaaaggtccccggtttacggtaacccccggttacgttaccgggtacccgaaaccccggtacccggtaaacccggtcccgtttaccccccgggtcccccgttaccgggttaccccg

SEQ ID NO: 118980 - DNA, 659 bp, Homo sapiens
  misc_feature: GYAE6OF01B3I0E.5.86.H09.1.454.CMB.1.raw
  modified_base (358)..(358): a, c, t, g, unknown or other
  misc_feature (358)..(358): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacagggtcctgggcccagtctgccctgactcagcctccctccgcgtccggtctcctggacagtcagtcaccatctcctgcacgtggaccagcagtgactagttggtcgttataactatcgtcttcctaggtaccaacaacactccaggacaaacgcccccaaactcgtgactttcgtgaggtcagtaacgccggcctcgacgggtcctgacgtcgcttcnctgctcaagtctgctaacgcggtcctacctcgaccgtctcgtacggcctccgagtacgtaggacggtagtacggacggtcgtacgtaaccgttacttaccgttacgcgtaacggtccttaccgtaacgttttcgacgtacggaccgtacggtacccgttacttaccgttccgttaccgggaccgggtaacgggtaacccgacgggttacccgtccgggttaaccccggttcccgttaacgggtacccgtaaccggtaccccgtaaacgggtccccgtcccggtaccccccggtttcccggg

SEQ ID NO: 118981 - DNA, 595 bp, Homo sapiens
  misc_feature: GYAE6OF01DKLLC.5.86.H09.1.454.CMB.1.raw
  modified_base (393)..(393): a, c, t, g, unknown or other
  misc_feature (393)..(393): n is a, c, g, or t
  modified_base (467)..(467): a, c, t, g, unknown or other
  misc_feature (467)..(467): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacagtttggtcgttaataactatgtcctcctggtaaccaacaacatccaggaccaaacgacccccaaaactcgtgtatttcgtagaggtcaggtaacgccggccctcgacggggtccctgactcgtcttctcgtcggctccaagtctcggacaacnccggtccctccctgaccgtctcgtgggcctcgagactggagtatggagtctacgacttagttactgctagtctntagttcgcgtaggcacgtaccgttataccgttccggttcgggacgggtacggaccgaacggtcttacggtacccgttccgtacggtaccgaccggacccgaagggtccctcccggtcccccgtaccgg

SEQ ID NO: 118982 - DNA, 729 bp, Homo sapiens
  misc_feature: GYAE6OF01D1LNQ.5.86.H09.1.454.CMB.1.raw
  modified_base (237)..(237): a, c, t, g, unknown or other
  misc_feature (237)..(237): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtctgccctgactcagccctccctccgcggtccggtctccgtggacagtcagtccaccatcctcctgcacgtgggaccngcagtgactattggtacttaataactatcgtctctacggtaaccaacaacatccgaaggaccaaaccgaccccctaaaacgtcgtagtactttcgtaggaggtcaaggtaacgccggtccctacggacgggtccctgactcgtcttcgtcgtcggcctaccgaagttcgtacggaccgaaccgaccggtcccttacccgtcggtacccgttcgtccggtacgggtcctaccgacgtacgtggaacggtagtacggacggtcgttacgtaactttacgttacgtcgactacgtacttacgttacgtttcggaccgtacgggtaccgtaacgttaccgttaacgttacccggttaccggtttaccgggggaccgggtaaacggggtaaacccgtacgggttaccgtaccgggtaaccccggttaccggttacgggtacccgtaccgggtaaccccgaacgggtcccgttaccccgggccccccgtttacccggg

SEQ ID NO: 118983 - DNA, 605 bp, Homo sapiens
  misc_feature: GYAE6OF01A8EN5.5.86.H09.1.454.CMB.1.raw
  modified_base (601)..(601): a, c, t, g, unknown or other
  misc_feature (601)..(601): n is a, c, g, or t
tcagatcagacacgcacgaccggtgctcgatttagtgctatagacgttgagtctgggggaggcttggtacagcctggggggtccctgagactctcctgtgcagcctctggattcacctttactgattttggcatgacgtgggtccgccaggctccagggaaggggctggactggctctcaaatattaatggaaaagcaatatacaagactacacagactccgtgaagggccgttcaccacctcgagagacaactccagggacacggtgtacctacacatgaacagcctgagagccgaggacacggccgtatattattgtgtgagggaactgggggcaagtttgaccgcgtggggccagggaaccctggtccaccgtctcctcacgccctccaaccgaacgggccccacttccgggtccttcccccgtggccgtccccgtgccctccgacgggacgccacccgtccgaaggacgccacacggccgcccgtgggcctggcccgtgggtaccaacgggtaccttaccgttcccgtacgtccgtcgtacttccgtggaacggtcccggggacgtcgggacgaacgggccgtacgacgtaagctgngacg

SEQ ID NO: 118984 - DNA, 572 bp, Homo sapiens
  misc_feature: GYAE6OF01BNFH6.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctacaaatattaatggtaaaaggcaatataacaagactacacagactccgtgaacgggccggttcaccacctcgagagacaactccaggacacggtgtacctacacatgaacagcctgagagccgaggacacggccgtatattattgtgtgaggggaacgtggggactagtttgacgcgtgggccagggacctggtcaccgtctcctcagccctaccaccaacgggcccacgtcggtcccttcccccgtcggccgtccctcgcctccgacggacgccaccgtccgagacgcacgacgccggcccgtgggccgtgcccgtggcgaacggccttaccgttcccgtgtcctgctcgtgacggg

SEQ ID NO: 118985 - DNA, 663 bp, Homo sapiens
  misc_feature: GYAE6OF01EN30Q.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgactagttggtacgtttataactatgtctcctggtaaccaacaacatccaggacaaacgacccccaaactcgtgtatttctgacggtcagtaagcggacctcgacgggtcctgactcgcttctctgctaccgaagtctggcacgaccggcctccgtcgtaccgtctcgtcgggcctccgacgtactggacggtattacggaggtccgtagtaacctttagtttaccgaggctacggtacttccgttaagttttccgacgtacgggtactaccgggtacccttaacttaccgttccggttaccgggaccgggtaaccggaacccgtaacggtcccgttaacgggtacccccgttaccgggttaaccggtcccgtaaccgaccccggtaaaccggtcccggtttaccccggccccccgtttacccggg

SEQ ID NO: 118986 - DNA, 777 bp, Homo sapiens
  misc_feature: GYAE6OF01C4FXV.5.86.H09.1.454.CMB.1.raw
  modified_base (241)..(241): a, c, t, g, unknown or other
  misc_feature (241)..(241): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgactnttggtcgttaataactatgtctcctgtaccaacacatcaggacaaacgccccaaactcgtatatttcagaggtcagtaacgccggcctcgacgggtcctgactcgtcttctcgtcggcctacgtaagtccgtacggaccaaacgtacccggtcccttaccccgtacggtaccccgttccgttccggtccggggtaccccttaccgaacggtaccgttacgggaacgggtaacgtcgggtaacgggtaccgttaggtaaccctttaacgttttaaccgttcggacccgttaacggttccgtttacctttaacggtttttacggacccggtaacgggtacccgtaacgggttaccccggtttaacgtttacccggttacccgggtttacccgggggaacccgggggtaaaccggggaaacccgtaaacgggttccccggttaaccgggtaaccccggttacccggttaacgggtacccgtaacccggtaaccccggtaacgggtcccccgtccccgggttacccccccgtttaccggg

SEQ ID NO: 118987 - DNA, 588 bp, Homo sapiens
  misc_feature: GYAE6OF01B7I61.5.86.H09.1.454.CMB.1.raw
  modified_base (584)..(584): a, c, t, g, unknown or other
  misc_feature (584)..(584): n is a, c, g, or t
tcagatcagacacgcacgaccggtgctcgatttagtgctatagacttgagtctgggggaggcttggtacagcctgggggggtccctgagactctcctgtgcagcctctggattcacctttactgattttggcatgacgtgggtccgccaggctccagggaaggggctggactggctctcaaatattaatggaaaagcaatatacaagactacacagactccgtgaaggccgttcaccacctcgagagacaactcaggacacggtgtacctacacatgaacagcctgagagccgaggacacggccgtatattattgtgtggaggggaactgggggacaatttgaccgcgtggggccgacgggaaccctggtcaccgtctcctcacgcctccaccaacgggcccagtccgtccttccccctggccgcccctgcctccgaggacgccaccgtccgagacgcacacggccggcccgtgggcctcggcccgtcgggtaccgaaacggtccttaaccgttcccggtgtccgtcgtacgtccgtaggtacggcggggtcctgggccgtaaagggccgactaggtagcgtgngtag

SEQ ID NO: 118988 - DNA, 571 bp, Homo sapiens
  misc_feature: GYAE6OF01A0BFA.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcaccttttactgattttggcatgacgtgggtccgccaggctccgagggaaggggctggactggctctcaaatattaatggtaaagcaatatacaagactacacagactccgtagaagggccggttcaccacctcgagagacaactcaggacacggtgtacctacacatgaacagcctgagagcgagacacggccgatattatgtgtgagggaactggggcaagttcgaccgcgtgggccacgggaacccgtggtcaccgtctcctcacgccctccaaccgacggcccagtccggtccttcccccgtggccgtcccctgccctccgacggacgcccacccgtccgaagcgcaccgacggccggtcccgtgggcctcgccgtggacgacggaccttaccgtcccgtgtacgtgtctgtggcggg

SEQ ID NO: 118989 - DNA, 555 bp, Homo sapiens
  misc_feature: GYAE6OF01ENWQ4.5.86.H09.1.454.CMB.1.raw
  modified_base (361)..(361): a, c, t, g, unknown or other
  misc_feature (361)..(361): n is a, c, g, or t
  modified_base (471)..(471): a, c, t, g, unknown or other
  misc_feature (471)..(471): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
  modified_base (495)..(495): a, c, t, g, unknown or other
  misc_feature (495)..(495): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcaccttttactgatttttggcatgacgtgggtccgccaggctccgagggaaggggctggactggctctcaaaattattaatggtaaagcaatatacaagactacacagactccgtgaagggccgttcaccacctcgagagacaacgtccagggacacggtgacctacacatgaacagcctgagacgcgaggacacggcgtatattagtgtgngaaggggaacgtggggactagttcggaccgtcgtggggccaggggaccctggtccaccgtctcctcgacgccctccgacgaacggcccagtccggtcctccccgtggccncctcgcnccgngacgcncctcgancgcacgcgccggccgtggcctcgccgtggacctagcctacgtccgtgtctagctgtgcgg

SEQ ID NO: 118990 - DNA, 584 bp, Homo sapiens
  misc_feature: GYAE6OF01EZR6P.5.86.H09.1.454.CMB.1.raw
  modified_base (310)..(310): a, c, t, g, unknown or other
  misc_feature (310)..(310): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggacaaacgcccccaaatcgtagatttcngaggtcagtaagccggccctcgacggggtccctgactcgcttctctggctccaagtctggacaacaccggcctccctgacccgttctcgtcgggcctccgagtactgaggtatggaggctagtacttattactgcagtctctagtttcgacgtacggcacgtccgttactaccgttcgttaccgggacgggaacgggaccgtaacggtcctacggtacccgtaccgtacggtaccgtacggaccccgaacggtccctccggccccccgttacgg

SEQ ID NO: 118991 - DNA, 752 bp, Homo sapiens
  misc_feature: GYAE6OF01DW1LQ.5.86.H09.1.454.CMB.1.raw
  modified_base (183)..(183): a, c, t, g, unknown or other
  misc_feature (183)..(183): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattctacctttactgtattttggcatgacgtggtccncaggctcgagggaaggggctggactggctctacaaaattattaataggtaaagctaatataacaagactacacagactccgtaggacggtccggtacaccacctacgagacgaacaaccgtccgaggacacggtacgtacctacacagtacgaacagcctgagacgacgagacacggtactatattagtgtagtagggaagggtaaacgtggggaactagttcggaccgtcggtacgggaccgacgggtaacccgtcggtaccgacccgttcctacccgtacgaccgtccctaccgaaccgaaccgggtccctacgttcccggttccccgttccccgtcgggcccctcccggtacgtccgtacccggaacggtaccgaccgaccccggtaccgaacggtacccgaccgaacccggacccggacccgggtccccggtacggggtcccgttaccggtccccgggtttacggtaaacccggtaacccggttaaccccgtttaccccggtttacccccggttacgttacccggttaaccggttaccgtacccgggttacggggtacccggggg

SEQ ID NO: 118992 - DNA, 690 bp, Homo sapiens
  misc_feature: GYAE6OF01AG2TF.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccgagggaaggggctggactggctctcaaatattaagtggtaaaggcaatatacaagactacacagactcgtgaaggccggttcaccactcgagagacaactccaggacacggtgtacctacacatgaacagcctgagacgccgaggacacggccgtaatattacttgtagtaggaaggggtaaacgtgggggactaagtttggacccgtcgtcggggacccaacggggaacccttgggtacctaccggtcctcccgtccacgtcccctaccgaacccgaacgggtccccaagttcccgggttcccttacccccccggtgggccccgttcccccgtcgtcccgttacccggaacgggacccgtacccgaacccggttacccggacgacgcccgaaccgaccggacccggtcccggtcgggtccgtccggtcccgtacgggtacgaccggtacccttacccggttcccgtcgttaccgtagtacgtccggtggtacccgggg

SEQ ID NO: 118993 - DNA, 639 bp, Homo sapiens
  misc_feature: GYAE6OF01EZH9B.5.86.H09.1.454.CMB.1.raw
  modified_base (436)..(436): a, c, t, g, unknown or other
  misc_feature (436)..(436): n is a, c, g, or t
  modified_base (464)..(464): a, c, t, g, unknown or other
  misc_feature (464)..(464): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcacgtgggaccagcagtgactattggtacgttataactatgtctcctggtaccaacaacatccgaggaccaaacgacccccaaactcgtagtactttctggaggtcaggtaacgccggccctcgacgggtcctgactcgtcttctcgtcgctcctaagtctcggcaaccgacggcctcccgtcgaccgtctcgtcggcctcgagactggaggntggacgtcgtagtacttattacgtgacncgtcttcgtacgtttcgacgtacggcgtacgtaccggttaacttaccgttccggttaccgggggaccgggtaaccgggacccgtaaacggtccgtaccgggtaccccggttacccggtacggtacccgtaccggaccccgaagggtccccttccccgggtcccccgttacccggg

SEQ ID NO: 118994 - DNA, 664 bp, Homo sapiens
  misc_feature: GYAE6OF01AC5B3.5.86.H09.1.454.CMB.1.raw
  modified_base (314)..(314): a, c, t, g, unknown or other
  misc_feature (314)..(314): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgactagttggtcgttataactatgtcctctggtaccaacaacatccaggacaaacgcccccaaatcgtgtactttcgngtacgtacagtaacgccgccctcgacggggtccctgtactcgtcttcgtctcggtcctaccgtaagtcgtggacctaaccgaccggtcccttcccgtcgtacccgtcgtccgtcgggtcctccgacgtacgtaggacggtagtacggacggtcgtacgtaaccttacttacgtcgcgtacgtcttacgtacgtttcgaccgtacggtacgtaccgtaccgttacttaccgttccggtcgggtacgggaaccgggaaccgtacggtaccgttaccggtacccggttaccggtaacggttaccgaaccggtaccccgaacggtcccgttaccccggtcccccgttacccggg

SEQ ID NO: 118995 - DNA, 589 bp, Homo sapiens
  misc_feature: GYAE6OF01DQGLS.5.86.H09.1.454.CMB.1.raw
  modified_base (440)..(440): a, c, t, g, unknown or other
  misc_feature (440)..(440): n is a, c, g, or t
  modified_base (570)..(570): a, c, t, g, unknown or other
  misc_feature (570)..(570): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcaccttttactgtatttttggcatgacgtgggtccgccaggctccgaggggaaggggctggactggctctacaaaatattaagtaggtaaaagcaaatataacaagactacacagactccgtgaaggccgttacaccactcgagagaacaactccgaggacacggtcgtacctacacatacgaacagacctgagagaccgaggacgacggccgtatattagttgtgtaggagggaacgtggggactagttgacgtcgtcgggacgacgggaccgtggtcgaccgtctcccncgacgtccctaccgaacgacggcccagtccgtcccttaccccgcgccgtcccgtcgcctcgacgcgccaccgtccgagcacacgcgccgccgcggcgtcgccgtggacgtaacggacttacgttcccgtntacgtatgtcgtggacggg

SEQ ID NO: 118996 - DNA, 660 bp, Homo sapiens
  misc_feature: GYAE6OF01D4O8Y.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgacagttggtcgttataactatcgtctcctcggtaaccaaacaacactccaggaccaaacgacccccctaaaactcgtgtatttcgtgaggtcaggtaagccggtccctcgacggggtccctgactcgtcttctcgtggcctaccgaagtccgtggaccgaaccgccggtccctcccgtgacccgtctcgtcgggcctaccgagtacgtgaggagttggaggtctagtaacttacttacgtcgactacgtcttctaagttttcgacgtaggtaccgacgtaccgttacgttaccgttccggttacggggacccgggaacgggtaacccgaaacggtccgttacggtaccccgttacccggttacgggtaccgtacccggaaccccgtaacgggtaccccgtcccggtcccccccgttaccggg

SEQ ID NO: 118997 - DNA, 529 bp, Homo sapiens
  misc_feature: GYAE6OF01A7NPE.5.86.H09.1.454.CMB.1.raw
  modified_base (306)..(306): a, c, t, g, unknown or other
  misc_feature (306)..(306): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacacatccaggcaaacgccccaaatcgtgatttcngagtcagtaagcgcctcgagggtccctgactcgcttctctggctcaagtctggcacacggcctccgtgaccgtctcgtcggcctccgagactgacggatggacgctgactattactgacacgtctcgtatttcgctacggcagccgtataccgtcgttcggcggaggaccagtctcggacccgtctaggtacacggcccaacggccgtcgtcccccgtaccgg

SEQ ID NO: 118998 - DNA, 636 bp, Homo sapiens
  misc_feature: GYAE6OF01A7NTY.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccaggggaagggctggactggctctcaaatattaatggtaaaggcaatatacaagactacacagactccgtgaaggccgttcaccactcgagagacaactccaggacacggtgtacctacacatgaacagcctgagagcgaggacacggccgtatattattgtgtaggaaggggaaacgtgggggactaagtttcggacccgcgtcggggacccgaaggggtaaccctgggtaccgtacccggttcctcccgttccgacgtcccctacccgaacccgaaacgggccccaacttcccgggtacctttcccccgaggcccgccctgccctccgacgggacgccaccgtccggagacgccacgacggccggcccgtgggacctcggcccgtgggtaccaaacgggtaccttaccgttccccggtgtccgtagaccttcgtcggtaccggg

SEQ ID NO: 118999 - DNA, 724 bp, Homo sapiens
  misc_feature: GYAE6OF01DVKXC.5.86.H09.1.454.CMB.1.raw
  modified_base (288)..(288): a, c, t, g, unknown or other
  misc_feature (288)..(288): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcgaggcacgagggtcctgggcccagtctgccctgactcagcctcctccgcggtccggtctcctggacagtcagtcaccatctcctgcacgtcgggaccagcaggtgactagttggtacttaataactatcgtctccgtacggtaaccaacaacnctaccgaggacaaaccgacccccaaactcgtcgtatttcgagaggtcagttaacgccgtcctcgacgggtccctgacgtcgtcctttctcgtcggccttacgaagttccgtacggcaaacgccggtccttacccgtacgtacccgttcgtccgtccggggtcctaccgacggtaccgtagggaacggtaacgtcggacgggtacgtacggtaactttagtttaaccggtcgactacggtaccttccgttagttttaccggacgtacggtaccgtacggtaccgtttacttaacccggttccggttacgggggaaccgggtaaccgggtaaccggtaaacggtcgttaccgggttaaccccggttaccggttacgggttacccgacgggtaaacccccggaggtcccggttcccccggtcccccggttaaccccggg

SEQ ID NO: 119000 - DNA, 684 bp, Homo sapiens
  misc_feature: GYAE6OF01ENKV5.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgacacgtgggaccagcagtgactagtttggtcgttaataacctattgtcctccgtggtaaccaacaacactccaaggaccaaaaccgcccccaaacgtcgttagtacttttcgtggaggtcaaggttaacggccggtacccgtcggacggggttccctgacttcgcttctcgtcggctcgaagtcgtcggacacgaccggtcctccgtcgtaccgtcgtccgtacgggcctaccgtagtacgtaggaaggtacgtggacggttctacggtaactttaacgtttacgacggtctacggtccttacgttaagtttcgggacgtaacgggtccctacgggttacccgttacgttacccgtttccgggttaccgggccggggtaacggacccgtaacggttccgtaccggtacccgtccgttaacggccgtaccgacccgaaggtcccgtcccgtcccccgttaccgg

SEQ ID NO: 119001 - DNA, 724 bp, Homo sapiens
  misc_feature: GYAE6OF01ASKLC.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacgagggtcctgggcccagtctcgccctgactcagccctccctccgccgtccgggtctccgtggacagtcagtcaccatcctcctgcctacgtcgggaccagctagtagactagttcgggttacgttaataacttattcggtccttccgtaggtaacccaaacaacactccgaaggaccaaaaccgcccccctaaactcggtgtaacttttcgaggtacggtactaaggtaacggccggtcccgtaccggtacggggtaccctacgacgttccgtaccgtttctcggtacggtcctaccgaacggttccgtacggacctaaacccgaccggtcccctaccgtcgtacccgtcgtacgtcggcctaccgagtacgtagaggtacgtggacggtcctagtaacttagtacgtactcgaaccgtctcttagttccggacgtacggtacgtaccgtaccgttacttaccggttccgggttcgggaccgggttaacgggacccgtacgggtaccgtaccgggttacccgtaccgtacgggtaccgtacccgtaaccgggaccggtcccgtcccggtcccccgttaccggg

SEQ ID NO: 119002 - DNA, 798 bp, Homo sapiens
  misc_feature: GYAE6OF01EGJ86.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgactattggtcgttataactatgtctcctggtaccaacaacatccaggacaaacgcccccaaactcgtgtatttctagaggtcagtaacgccggccctcgacggggtccctgactcgtcttctcgtcggtctaccgaagttcctaggaccaaccgaccggtcccttcccgtacgtacccgttctccgtcggggtacctacccgtaaggaccgttggaacggtactagggacgggtcctttaacgggtaacctttaacgtttaacccggtacggtaccgtacggtacccgtttactaacggtttttccggaccgtaaccggggtacctaaacccgggttaccccggtttaaaccgtttacccgtttacccgggtttacccggggggaccgggggtaaaaccggggtaaccccggtaaaacgggttccccgttaacccggggttaaaccccccgggtttaacccccgggttaacggggttaacccccgtaacccgggttaaaccccccggaaacggggtttccccgttaccccccgggtccccccccggtttaaacccccgggg

SEQ ID NO: 119003 - DNA, 611 bp, Homo sapiens
  misc_feature: GYAE6OF01A7HHI.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaccagcagtgactattggtcgttataactatgtctcctgtaccaacaacatccaggcaaacgcccccaaactcgtgtactttcagaggtacagttaacgccggtccctcgtacggggtccctgactcgcttactcgtcggctacgaagtctagggaccaacgaccggccctcctcggacctctacgtcggcctccgagactgagtacgtgacggtctagacttattaccgtgctagtctcgtaatttcgacgtaggcacgtcccgtaacgtaccgttccggttaccgggaccgggtaacgggaacctaaggtccgtacggtacccgttccgtaaccggtccgaacccgtacccgaaccgggtcccttccgtacccccgtccggg

SEQ ID NO: 119004 - DNA, 785 bp, Homo sapiens
  misc_feature: GYAE6OF01BJDNF.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtgggaccagcagtgactagttggtacgttataactatgttcctcctacggtaaccaactaacactaccgaggaccaaaccgacccccctaaacgtcgtagtacttttccgtaggtacggtacaacggtaacggcccgggtacccccgtaccggtaacgggggtttcccctaggtacgttcccggtccttttccgttccgttcgggtcccgttaacccgtaaacggttcccgttacggggaaccctaaacccggtaaccccggtcccccgtttaccccgttaccggtaaccccggtttccgttccggtacccggggtcccttacccggaacggtaccgttacgggaacgggtacgttacgggacgggtccgttacggttaaccgtttaacgtttaaccgtcggtacctacgtccttacgttacgtttcgaccggtacggacgtacgtccgttacttaccgtcggttacgggaccgggaacgggtaccgaaacggtcgtacggtacccggttcgtacggaccgtaccggacccgaaggtccgtaccccgtccccggtaccgg

SEQ ID NO: 119005 - DNA, 756 bp, Homo sapiens
  misc_feature: GYAE6OF01A00A1.5.86.H09.1.454.CMB.1.raw
  modified_base (754)..(754): a, c, t, g, unknown or other
  misc_feature (754)..(754): n is a, c, g, or t
  modified_base (756)..(756): a, c, t, g, unknown or other
  misc_feature (756)..(756): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccgagggaaggggctggactggctctacaaatattaatggaaaagcaatatacaagactacacagactccgtagaacgggccgttcaccacctcgagacgacaactcgagggacacggtcgtacctacacatagaacagcctgagagccgaggacgaccggccgtatattagttgtggtaggaagggaaacgtggggactaagttcggaccgcgtcggggaccgacgggtaacccgtcggtaccaccgtcctcccgtacgaccgtcccctacccgaacccggaaccgggtcccctaacggttccccgggttaccccgtttcccccccggtcgggtacccccgtcccccgttccggtaccccgttacccggacgggtaccgaccccgtaaccccggtacccgggaacggtaccgacccgtaacccggaacccggtccccggggtaccccggtcggggacccgttccgggtaccccggttacggggtaacccgtaaacgggttaccctttaaccccggttcccggttacgttccgtacgtaccgtccggtacgggtacgggtcccgggcggtcgggacgtaccgggacctagtaacgtggctgngn

SEQ ID NO: 119006 - DNA, 620 bp, Homo sapiens
  misc_feature: GYAE6OF01BBIP7.5.86.H09.1.454.CMB.1.raw
  modified_base (615)..(616): a, c, t, g, unknown or other
  misc_feature (615)..(616): n is a, c, g, or t
  modified_base (618)..(619): a, c, t, g, unknown or other
  misc_feature (618)..(619): n is a, c, g, or t
tcagatcagacacgcacgaccggtgctcgatttagtgctatagacttgagtctgggggaggcttggtacagcctggggggtccctgagactctcctgtgcagcctctggattcaccttttactgtattttggcatgacgtgggtccgccaggctccgagggaagggctggactggctctcaaatattaatggaaaaggcaatatacaagactacacagactccgtagaagggccgttcaccacctcgagagacaactccgagggacacggtcgtacctacacatgaacagcctgagagccgaggacacggccgtatattagttgtgtggagggtaacgtgggggactaagttgaccggtcggtacggggaccgaacgggtaacccgtggtaccgaccgtcctccgtcgacgccctacccgaccgaacggccctacgtccggtccttccccgcggccgtccctcgcctccgacggacgccaccgtccgacgacgcgacgcggccggcccgtgggcctcggccgtaggtccgaacggtccttacccgttccggtcgtccgtagtcgttcgcgggtacggcgggcggttcggacccgaagggtccgacgtacgtaggnngnng

SEQ ID NO: 119007 - DNA, 577 bp, Homo sapiens
  misc_feature: GYAE6OF01E06T5.5.86.H09.1.454.CMB.1.raw
  modified_base (555)..(555): a, c, t, g, unknown or other
  misc_feature (555)..(555): n is a, c, g, or t
  modified_base (574)..(577): a, c, t, g, unknown or other
  misc_feature (574)..(577): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaagcaatatacaagactacacagactccgtgaagggccggttcaccacctcgagagacaactccagggacacggtgtacctacacatgaacagcctgagagccgaggacacggccgtatattattgtgtggaaggggaaacgtgggggactaagtttggaccgcgtcggggccgaagggaaccctggtaccaccgtctcccgtcacgccctccgaccgaacgggccccagtccggttccttcccccgtcggccgcccctcgccctccgacggacgccaccgtccggacgacgcaccgcgccggcccgtgggctcgccgtggtccaaggcctacgttcccgtgtctcgctcgtcgcggcgggcncgggacaggcgacagtagnnnn

SEQ ID NO: 119008 - DNA, 713 bp, Homo sapiens
  misc_feature: GYAE6OF01BR1UF.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcacgtgggaccagcagtgactagttggtcgttaataactatcgtctcctaggtaaccaacaacatccaggaccaaacgcccccaaactcgtagtactttcgtagaggtcagtaacgccggccctcgacggggtccctgactccgtcttctcgtggctaccgaagttcgtcggaccaaccgaccggtccctcccgtacgaccgttctcgtcggcctaccgagtacgtggaaggtacgtcggacggtcgttacgtaaccgttaacgtttacgtacgacctacggtccttacgtagttttccggacgtacgggtaccgtacggtacccgttaacttacccggttaccggttaccggggaccgggtaaaccggggtaacccgtaaacgggtcccggttaaccgggtaacccccggtttacccggtaagggtaccccgtaaccgggtaccccgtaaaccggggtcccgttaccccgggtcccccccggtttacccgggg

SEQ ID NO: 119009 - DNA, 710 bp, Homo sapiens
  misc_feature: GYAE6OF01CZGG3.5.86.H09.1.454.CMB.1.raw
  modified_base (326)..(326): a, c, t, g, unknown or other
  misc_feature (326)..(326): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcaggcacgagggtcctgggcccagtctgccctgactcacgcctccctccgcggtccgggtctccgtggacagtcagtccaccatcctcctgccacgtcgggaccagcgagtgactagttggtacgttaataactatgtctcctggtaccaacaacactacgagaccaaacgaccccaactcgtactattcgngaggtacgagtaacgccggacctacgacgggtccagtacgtcgtcttctcgtcgtcgtactaacggtcgtacgacgaaccgccggtccctccgtcgtaccgttcgtcgtccgggtcctaccgaggtaccgtaggaacgggtacgtaggacgggtccgttagtaccgttaacgtttaacgtcgtacgtacgtacgttacgttacgtttacggaccgtacgggacctaacggtaccgtttacgttaacccgttccgggttaccggggaaccgggtaaccgggaaacccggtacggtacccgtacgggttacccggttacccgggttacggtacccggtaaccggaccccgtaacgggtcccgttccccggtacccccgttcccggg

SEQ ID NO: 119010 - DNA, 682 bp, Homo sapiens
  misc_feature: GYAE6OF01CTU61.5.86.H09.1.454.CMB.1.raw
  modified_base (215)..(215): a, c, t, g, unknown or other
  misc_feature (215)..(215): n is a, c, g, or t
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
  modified_base (450)..(450): a, c, t, g, unknown or other
  misc_feature (450)..(450): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacgagggtcctgggcccagtctcgcctgactcacgccctcctccgcgtcccgggtctccgtggacagtcagtcacngtctctgcagtcggaccagcagtcgatgttggtacgttaatacgtatcgtctacgtagtaccaacaacactaccgagaccaaaccgtaccccaaattcggtctatttcgngagtacgacgtaacgccgcctacggcggtcctgacgtcgtcgtctcgnggtacctacgaagtctacggcaaacgtccgtccctcgacgccttcgcgtcggtaccaccgagtacgtacgaacggtntacgggtacgtacgttagtaacctttacggttaacctacgcgtaaccgtaccgttacgttacgttacgaccggtaacggtaccgtacggttcccgttaaacgtccggttacgggttacccgggaacggggtaaccgaacgtaccgggttacgttccggttaaccccgggttacgttaacgggaccctaacccgggacgtaaaccggtccccgtccccggtcccgtttaccgg

SEQ ID NO: 119011 - DNA, 706 bp, Homo sapiens
  misc_feature: GYAE6OF01D4JB5.5.86.H09.1.454.CMB.1.raw
  modified_base (239)..(239): a, c, t, g, unknown or other
  misc_feature (239)..(239): n is a, c, g, or t
tcagatcagacacgcacgaccggtgctcgatttagtgctatagacgttgggtttgggggctggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtccaccatcgtcctgcactcggaccagcagtnactattggtcttataactatgtctcctaggtaccaacacactccgaggaccaaaccgacccctaactcgtatctttcgagacgtcaaggtaacgccgtcctacggtacgggtcctagactcgtacttcgtcgtcggtacctaccgtaagttccgtacggacctaaccgtacccggtccccttcccgtacggtacccgttcgttccgtccgggaccttaccgacgtaccgtaggaacggtacgtacggtacgtcgtacgtaactttattaccgagtacgtacgtcttacgttacgtttacggaccgtacggtaccttaccgggtaccgtttactacccggtttaccggttaccggggaccgggtaaccggtaaccggtacggtcccgttacgggttaccccgttaccgggtacggaacccgtaccggacccggtaaccggtcccggttcccccgtccccggttacccg

SEQ ID NO: 119012 - DNA, 867 bp, Homo sapiens
  misc_feature: GYAE6OF01DHFLF.5.86.H09.1.454.CMB.1.raw
tcagatcagacacgcacgaccggtgctcgatttagtgctatagacttggggtttgggggctggggtctcaggaggcagcgctctcaggacgtcaccaccatggcctgggctctgctcctcctcaccctcctcactcgagggcacgagggtcctgggcccagtctgccctgactcagcctccctccgcgtccgggtctccgtggacagtcagtcaccatcctcctgcacgtgggaccagccagtgactagttggtacgttaataactatcgtcttccgtacggtaaccaaacaacactaccgaaggaccaaaaccggaccccctaaaactcggttacgtaacttttccgtagggtaacggtacgtaacggttaaacggcccggtacccctacggaaccgggggttcccttagacgttccgtccgtttccgttcgtcggtaccttaccgtaaacggttcgtacggaccgtaaacccgtaccgggtccccttacccgtacggtacccgttcgttaccggtcggggtaccttaccgaacggtaccgttgggaaacgggtacgtacgggtaacgggtccgtttaacggtaaacctttaacgttttaaccgacggtaccggtaacgttcccgttaacgtttaacgttttaccgggacgttaaccggggtacgtaaacccgttaaccggttttaccgttaaccgggtttcccgggtttaccggggggaacccggggttaacggggaaaccccgtaaaccgggttcccggttaaccgggtaaccccgttaaccgggtacggtaaacccggaaccccgttaacccgggtaaacccgggcccccgtttccccgggtaccccccggttttaacccggg

SEQ ID NO: 119013 - DNA, 641 bp, Homo sapiens
  misc_feature: GYAE6OF01BK556.5.86.H09.1.454.CMB.1.raw
  modified_base (143)..(143): a, c, t, g, unknown or other
  misc_feature (143)..(143): n is a, c, g, or t
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacgngggtcctgggcccagtctcgccctgactcacgccctccctccgccggtccgggtctccgtggacagtcagtcaccntctcctgcacgtgggaccngccagtcgactagttcggtacgttataactatcgttctccgtaggtaaccaacaacactaccacggacaaaccgaccccaactcgtgtatttcgagtagtacagtacgcgcctacgacgggtccagactcgtcttctcgtcgtctaccgaagtcgtacgacacgacgtccctccgtcgaccgtcgtcgtcggtcctaccgaagtacgtaggaagtacgttaggacgtcgttacgtaacttacgttacgtcgactacgtacgtcttaacgttcggacgtcgggaactcggtaccgtacgtaccgttcggtacggacgggaacggtacccgacgtaccgttacgacccggttacgtaccggtaccgaacggtacccgaggttccccgccggtccccgttaccggg

SEQ ID NO: 119014 - DNA, 752 bp, Homo sapiens
  misc_feature: GYAE6OF01C1CLG.5.86.H09.1.454.CMB.1.raw
  modified_base (203)..(203): a, c, t, g, unknown or other
  misc_feature (203)..(203): n is a, c, g, or t
  modified_base (321)..(321): a, c, t, g, unknown or other
  misc_feature (321)..(321): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacngtcagtcaccatctcctgcactgggaccagcagtgacattggtacgttaataactatgtctcctaggtaaccaacaacactccaaggacaaaaccgccccccaaaatcgtgtatttcngaggtcagtaagccggcctcgacgggtccctgactcgcttctctcggctaccgaagtctacggaccaaaccgaccggtcccttaccccgtacgtaccccgttccgtccggttcggggtaccttacccgaacggtaccgttaggaacgggtaacgttacgggaacgggtcgttaacggtaaacctttaagttttaacccgttcggaccgttaaccggtccttaccgttaagttttaccggaccgtaaccgggtaccgtaaccggttaccccggttagttaaccccggtttcccggtttacccgggggaccgggtaacggggaaccccgtaaaggtccccgttaacgggtaacccccgtttaccgttaacgggtacccgtaaccgggtacccccggaaacggtccccgttccccggtccccccgtttaccggg

SEQ ID NO: 119015 - DNA, 641 bp, Homo sapiens
  misc_feature: GYAE6OF01DFSCH.5.86.H09.1.454.CMB.1.raw
  modified_base (199)..(199): a, c, t, g, unknown or other
  misc_feature (199)..(199): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacagggtcctgggcccagtctgccctgactcagcctcctccgcgtccgggtctcctggacngtcagtcacatctcctgcacgtggaccagcagtgacagttggtcgttaataactatcgtctcctggtaaccaacaacataccaggacaaacgacccctaaactcgtntattcngagtcagtaacgcgcctgacgggtcctgactcgtcttctctcggtctaccagtcgcggcaacgaccgtcctcccgtcgtacccgtcgtcgtcggtcctccgacgacgtggaaggtagtaggtacggctcggtaaccttaacgttaccgtagcgtaacgtccgtacttacgtttcggacgtacgggtcctaacggtacccgttacttaccgttaccgggttccgggtaccggggaacgggtaacccgtaaggtcccgttacggtacccggttaccggtacgtaccgaccggtaacccggacggtacccgtcccggtaccccgttacccgg

SEQ ID NO: 119016 - DNA, 750 bp, Homo sapiens
  misc_feature: GYAE6OF01C4MHM.5.86.H09.1.454.CMB.1.raw
  modified_base (258)..(258): a, c, t, g, unknown or other
  misc_feature (258)..(258): n is a, c, g, or t
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
tcagatcagacacgcacgaccggtgctcgatttagtgctatagacgttgggtttgggggtgctcgatttagtgctatagacttgggtttgggatctacgttgcaggtgtaggtctgggtccctgagactctcctgtgcagcctctggattcaccttttactgtattttggcatgacgtgggtccgccaggctccgaggggagggctggactggctctcaaaattattaagtggtaaaggcaatataacaagactacanagactccgagaaggtccgtcaccacctcgagagacaactccaggacncggtcgtacctacacntagaacacgcctagagacgccgaagacgacggctatattattggtgtagggaaggggtaacgtgggggactaagtttcggaccggtacggtacgggggacccgaaacggggaacccgttgggtacccgtacccggttcccttaccgtcccgacgcccccgttaccgaacccgaaccgggtcccctaacgttccgggttccccgttacccccggtcgggtccccgtacccgttccgacccgttacccggaacggtacccggaccgtaaccccgttccgggaacgttaccggacctaccggccggccccgggttaccccggtcgggtacccggttccgacccgggttcgggtacccggtaaacgggtacccctttaacccggttccccggttacggttcccgttaggtacgttccgtcgggtaacccgggg

SEQ ID NO: 119017 - DNA, 805 bp, Homo sapiens
  misc_feature: GYAE6OF01CC1DV.5.86.H09.1.454.CMB.1.raw
  modified_base (747)..(747): a, c, t, g, unknown or other
  misc_feature (747)..(747): n is a, c, g, or t
  modified_base (800)..(800): a, c, t, g, unknown or other
  misc_feature (800)..(800): n is a, c, g, or t
  modified_base (804)..(804): a, c, t, g, unknown or other
  misc_feature (804)..(804): n is a, c, g, or t
tcagatcagacacgcacgaccggtgctcgatttagtgctatagacttgagtcgtgggggaggcttggtacagcctggggggtccctgagactctcctgtgcagcctctggattcacctttactgtattttggcatggacggtggtccgccaggctccgagggaagggctggactggctctacaaattattaaatagggaaaagcaaatataacaagactacacagactccgtaggaacggccggttacacctacctcgagacgaccaacgtccggaggactcggtacgtacctacacatacgaacgacgccgtagacgacggaccggaacggaaccgaccggtaccgttaagttagtttacgttggtaggtaagggaacggggtaaacgggttcggggtaacttaacgtttccggaaccggtcggtaccgggggacccggtaaacccgggtacccgttacggtaccccgttacccggttcccgtacccgtaccgaacccggtcccctaaccccggaacccggtaaacccgggtccccgtacggtttcccccggttcccctttcccccgggtccggtcccccgtccccgttcgtccccgttaaccggaacgggacccgtacccgtacccgtaccggaaggaccgacccgaaccggccggcccggtacccggtggcccgtcgtacccggtagggtacctaaccggttccgttacccgtttcggtcccgttacgtacgtccgtttacggngggtaccggtccgggacggtacggaccggacgggttccacgttaagacgtcgngtgng

SEQ ID NO: 119018 - DNA, 758 bp, Homo sapiens
  misc_feature: GYAE6OF01EKT2D.5.86.H09.1.454.CMB.1.raw
  modified_base (753)..(754): a, c, t, g, unknown or other
  misc_feature (753)..(754): n is a, c, g, or t
  modified_base (756)..(756): a, c, t, g, unknown or other
  misc_feature (756)..(756): n is a, c, g, or t
  modified_base (758)..(758): a, c, t, g, unknown or other
  misc_feature (758)..(758): n is a, c, g, or t
tcagatcagacacgcacgaccggtgctcgatttagtgctatagacttgagtctgggggaggcttggtacagcctggggggtccctgagactctcctgtgcagcctctggattccacctttactgtattttggcatgacgtgggtccgccaggctccgagggaggggctggactggctctacaaatattaataggaaaaggcaatatacaagactacacagactccgtgaacgggccgttcacccacctcgagacgacactccgaggacacggtcgtacctacacatagaacagcctagagacgaccggaggaccgacggtaccgtaagttagtttagttggtagtagggaaggggtaaacggtgggggtactagtttacggaccgtcggtcggggacccgacggggtaccctcgggtaccaccggtcctccgtcgaccgcccctaccgaaccgaaccggcccgtacgttcccggttaccccgttccccccggacgggccccgtacccccgttcggtccccgtaccggaacgggtaccgaccccgtaacccgtacccggacggaccgtcccgaacccgtacgggccccgggtacccgtcggggccttaccgggtacccggttcgggtaacccgtaaaccggttacccgtttaccccgttacccgggttcggtaccgttcggtaccgttacggtacggtacggggtcccgggtcggtaccgggacgggtaaacccggcggtaaccgtagtacggnngngn

SEQ ID NO: 119019 - DNA, 529 bp, Homo sapiens
  misc_feature: GYAE6OF01A8IFL.5.86.H09.1.454.CMB.1.raw
  modified_base (371)..(371): a, c, t, g, unknown or other
  misc_feature (371)..(371): n is a, c, g, or t
  modified_base (416)..(416): a, c, t, g, unknown or other
  misc_feature (416)..(416): n is a, c, g, or t
  modified_base (457)..(457): a, c, t, g, unknown or other
  misc_feature (457)..(457): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttctgaggtcagtaagcggccctcgaggggtccctgatcgcttctctggctccaagtctggcaacncggccctccctgaccgtctctcgggcctccagactggaggatggnggctgactattaactgcagtctcatttgctaggcagtctanactcgtcggcggacgggacaagtctacggaccgtccgtagcacgtacccgaaggcctccgtcccccgtccgg

SEQ ID NO: 119020 - DNA, 625 bp, Homo sapiens
  misc_feature: GYAE6OF01A4U2K.5.86.H09.1.454.CMB.1.raw
  modified_base (465)..(465): a, c, t, g, unknown or other
  misc_feature (465)..(465): n is a, c, g, or t
  modified_base (498)..(498): a, c, t, g, unknown or other
  misc_feature (498)..(498): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctcctcactcagggcacagggtcctgggcccagtctgccctgactcagcctccctcgccgtccgggtctcctggacagtcagtcaccatctcctgcactcgaccaaccagcagtgacggttgggtggttacgaagtatcgtctccgtaggtaacccaaacaaccaaccccgaacaaaccgacccccaaactcaactcttattttgacggtacactaccgccaccctcgacgggtccctgactcgtcttcgtcgtcggtctccgagtcgacgccaaccgccgtcccttcctcggtaccgtcgtcgtcggtcctccgaggcgtaggaggacgtgacggttntagttactttactacgtgcgtacgtctatagtntcgacgacgacgacgtacgaacgactacccgacctagttcggtagtaccgttccgggtacggggacgggtaaccgtcgaccgtacgtacccgggttaccgtacggaccgtccgtaccggtaacccgg

SEQ ID NO: 119021 - DNA, 703 bp, Homo sapiens
  misc_feature: GYAE6OF01EXYGE.5.86.H09.1.454.CMB.1.raw
  modified_base (331)..(331): a, c, t, g, unknown or other
  misc_feature (331)..(331): n is a, c, g, or t
  modified_base (618)..(618): a, c, t, g, unknown or other
  misc_feature (618)..(618): n is a, c, g, or t
tcagatcagacacgcacgaccggtgctcgatttagtgctatagacttgggttttgggggctggggtctcaggaggcagcgctctcaggcgtcaccaccatggcctgggcgtctgctcctcctcaccctcctcactcaggcacaggtcctgggcccacgtctgccctgactcagcctccctccgcgtccgggtctcctggacagtcagtcaccatctcctgcactgggaccacgcagtacgactagttcggttacgttaacttaacttagtcgttccttccgtacggtaaccaaacaaacaactaccgaacggaaccgaaaaccgaaccccnccgtaccgtacgtacgtttacgttacgttacggtacggtaacgtaacggtacggtacccggtaccggtaccggtaccggtaccgtacgtacgtccgttccgtttccgttcgtccgtaccgtaccgtacgtacgtacgaaccgaccgacccgtcccgtccgtaccgtaccgtcgttcggtcgtccgtacgacgacgtacgtaggacgtagcgtacgtacgtacttacttacgtcgacgacgtctacttagtttcgtacgacggacgtacgtaccgttaacgttaccgnttccgttaccgggtacggggaccgggtaaccgaacgtaccgtaccggtacccggttacccggttacggtaccgtaccggacccgg

SEQ ID NO: 119022 - DNA, 620 bp, Homo sapiens
  misc_feature: GYAE6OF01BC0OS.5.86.H09.1.454.CMB.1.raw
  modified_base (354)..(354): a, c, t, g, unknown or other
  misc_feature (354)..(354): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtctcgccctgactcagccctccctcgcgtccggtctccgtggacagtcagtcaccatctctgcacgtggaccagcagtgacattggtcgttatactatgtctctgtacaacaacatcagacaacgacccaactcgtgattctgagtcagtaagcggcctcgtacggtccgtgactcgctctctcgtctacagtcngttttcaacgacgccctccgtcgtaccgtcgtcgtcggtcctccgacgtacgtagaggtagtaggacggtcgttacgtacttaacttacgttcgacgtacgtcgttacgttacgtttcgacgtacggaccgtacgtaccgttacgttaccgttcgttaccgggtaccgggtacgggtaaccgtaacggtaccgtaccggttaccgtaccgttacggtaccgtacggaccccgtaacggtaccgtccggtcccccggttaccccggg

SEQ ID NO: 119023 - DNA, 640 bp, Homo sapiens
  misc_feature: GYAE6OF01DMTZV.5.86.H09.1.454.CMB.1.raw
  modified_base (185)..(185): a, c, t, g, unknown or other
  misc_feature (185)..(185): n is a, c, g, or t
  modified_base (523)..(523): a, c, t, g, unknown or other
  misc_feature (523)..(523): n is a, c, g, or t
  modified_base (622)..(622): a, c, t, g, unknown or other
  misc_feature (622)..(622): n is a, c, g, or t
  modified_base (633)..(633): a, c, t, g, unknown or other
  misc_feature (633)..(633): n is a, c, g, or t
tcagatcagacacgcacgaccggtgctcgatttagtgctatagacttggggtttgggggtgctcgatttagtgctatagacttgggtttgggatctacgttgcaggtgtaggtctgggtccctgagactctcctgtgcagcctctggattcaccttttactgtattttggcatgacgtgggtccnccaggctccgaggggaagggctggactggctctacaaaatattaaagtaggtaaaggctaaatataacaagactaacacagactccggtaggaacgggccgttacaccaccgtcgagacgacaactccgaagggacacggtacgtacctacacatacgaacagccgtaggaacgacggaccgaaggaccgacggtaccgtaatattagttggtggtagggaacggggtaacgtggggactaagttcggaccggtcggtacgggaccgaacggtaccgtggtaccaccgtcctaccgtcacgccctaccgacgacggccctacgtccgtccctccccgngacccgtctcgcctacgacgaccgccaccgtaccggacgacgaccgacgcggcccggcgtcggcgtcgccgttaggaaccacggtaccttacgtcccgngtactgactgnggacggg

SEQ ID NO: 119024 - DNA, 662 bp, Homo sapiens
  misc_feature: GYAE6OF01BY4BV.5.86.H09.1.454.CMB.1.raw
  modified_base (237)..(237): a, c, t, g, unknown or other
  misc_feature (237)..(237): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaccagcagtnactatttggtacgttataacttatgtcctcctcggtaaccaacaacactccgaggaccaaacgcccccaaactcgtgtactttcgtgaggtacagtacgccgcccgtcgacgggtccctgactcgtcttctcgtcgctccgtaagtcgcggacaacgccgtcctccctcgtaccgtctcgtcggcctaccgacgacgtaggaggtagtcggagtactacgtacgttacgttacgtcgactacgtcttcttacgtttgacgtacgtaccgtacgtaccgttacgttaccgttccggttccgggaccggggtaacggtaacccggacgggtcccgttaacccgggttacccgttacccggttaacggtacccggtaaccggaccccggtaaccgggtccccgttccccggtcccccggttacccggg

SEQ ID NO: 119025 - DNA, 662 bp, Homo sapiens
  misc_feature: GYAE6OF01A5314.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggacaaacgcccccaaactcgtgtatttcgtgaggtcaagtaagcggtccctgacgggtcctgactcgcttctctggctaccagtctggacaacgcggcctcccgtgacccgttctcgtcgggcctccgacgtacgtggaacggtatcggagtctagacttactttaccgtcgacagtccttactacgtttcggacgtaacgggcctaacggtacccggtttactacccgttccgggtttaccggggaccggggtaaaccggggtaaccccgaaacggtcccggttaccggtaaccccggttacccgggttaacgggttacccgtaaccgggacccccggtaaacgggtcccttaccccggggtcccccccgttaccgggg

SEQ ID NO: 119026 - DNA, 598 bp, Homo sapiens
  misc_feature: GYAE6OF01AJ45G.5.86.H09.1.454.CMB.1.raw
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacagggtcctgggcccagtctgccctgactcagcctccctccgcgtccgggtctcctggacagtcagtcaccatcctcctgcactcgggaccagccagtcgactagttcggtcttataactatgtcctcctaggtaccaacaacatccagacaaacgccccaactcgtnactttcngacgtcagtaagccgcctcggacggtcctgatcgcttcnctgctccaagtccnggactaaccgcggtccctcgtcgaccgtctacgtccggcctaccgagacctggacgagtcggacgtctacggtacttacgtacgtcgctaggtctacttaacgttcgacgtacggctacggaccttagtccgttcgttccgggacggtaaccggaccgtaaggtccgtacggtaccccgttacggtaaccgtcgacccgtaccgacggcccgttaccggcccccgttacgg

SEQ ID NO: 119027 - DNA, 589 bp, Homo sapiens
  misc_feature: GYAE6OF01B2ZBN.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccgagggaaggggctggactggctctacaaatattaatggtaaaggcaatatacaagactacacagactccgtgaagggccggttcaccacctcgagagacaactccagggacacggtgtacctacacatgaacagcctgagagccgaggacacggccgtatattatgtgtgagggaactggggcaatttgacgctggggccagggaccctggtcaccgtctcctcgacgccctccgaccaagggccccagtccggtccttcccccgtcggccgcccgtcgcctccgaggacgccacccgtccgacgacgcgaccacggcccggccccgtggggcctcggcccgtgggtaccgacgggtacctaccgttccccgtcgtcctagactccgtggtaccgggg

SEQ ID NO: 119028 - DNA, 715 bp, Homo sapiens
  misc_feature: GYAE6OF01BJRTL.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcaggcacagggtcctgggcccagtctgccctgactcagcctccctcgcgtccggtctctggacagtcagtcaccatctctgcacgtggaccagcagtgactagttggcgctataactatcgtcctcgtacggtaaccaacaacactaccgaacggaccaaaaccgccccctaaaacgtccgtagtactttcgtaggtacggtacaaggttaaccggccggtcccgtacggtaccggggtccctggactccgtctttctcgtcggcctaccgaagttcgtacggacctaaccgtaccggtcccttcccgtacgtacccgttcgtccggtccgggtcctacccgtaaggtaccgtagggaacggtacgttacgggacggttcctacgtaacctttacgttaaccgtgaccgtagtcccgttattacggttacgacgtacggaccgtacgtaccgttaacgttaccgtacgggttacccgggaacggggtaacgtaacccgtaggtacccggttaccgtaccccggttacggtaccgggttaccaacccggtacccgtaacggtcccgttccccgggtaccccg

SEQ ID NO: 119029 - DNA, 677 bp, Homo sapiens
  misc_feature: GYAE6OF01CMJ0Q.5.86.H09.1.454.CMB.1.raw
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtccaccatctcctgcacgtgggaccagcagtgacnttggtcgttataactatgtctcctgtaccaacacatcaggacaaacgacccccaaactcgtntatttcngaggtcagtaagccggccctcgacgggtccctgactccgtcttctcgtggtcctacgaagtcgtcggaccaacgaccggtccctcccgtcggtacccgtcttcgtcgggtcctccgaacgtacgtgggaaggtagtggacgggtcgttagaccttacttacgtcgacacggtcttacgtagtttcgaccggtacggtaccgaacggttacccgttacgttaaccgttccggtttaccggggaccgggtaacggggaacccgtaacggtcccggttaaccgggtaaccccggttacccgtaacgggttacccgaaccggtaccccgtaacggggtcccccttcccgggtcccccccgttacccggg

SEQ ID NO: 119030 - DNA, 856 bp, Homo sapiens
  misc_feature: GYAE6OF01AVGDY.5.86.H09.1.454.CMB.1.raw
  modified_base (267)..(267): a, c, t, g, unknown or other
  misc_feature (267)..(267): n is a, c, g, or t
tcagatcagacacgcacgaccggtgctcgatttagtgctatagacttgggtttgggggtgcgtcgatttagtgctatagacttgggtttgggatcgtacgttgcaggtgtaggtctgggtccctgagctctcctgtgcagcctctggattcaccttttactgtattttggcatgacgtggtccgcaggctccgagggagggctggactggctctacaaatacgttaagtaggtaaaggactaaagtaactaacaaagacctaacaanacgtactaccggtagaacgggtccgttacaacctaccgtacgaacgaacgaaccaacgtaccgaacggaccgaacggtacgtacctaacgacacgtaacgacacgactagacgagaccgaagacgaacggtaccgtaagttacttagttagtacggttagggaaacggggtaaacgtcgggggtaacttaacggttacggtacccggtacggttaccggggaccgtaaccggggttaaccccggtacgggtaccggtaacccggtccgttacccgtacgtaacccggtacccccgttacccgaacccggtaaacccgggccccgtaaccgttaccccgggttaccccgtttcccccgtacgggtcccccgtcccggttaccctacccgggtacccgaaccgggtaaccggcccggtaacccgtcccccggtaacggaacccggacccgtaaccggacccgggtcccggacccggtcccgggacccggttacccgaccggttccgggtaaccgtaaaccgggttcccgttaccccggtttacccgttccggtttacccgtaaccggttcgtcccggttacggtaccgggg

SEQ ID NO: 119031 - DNA, 807 bp, Homo sapiens
  misc_feature: GYAE6OF01CYATG.5.86.H09.1.454.CMB.1.raw
  modified_base (252)..(252): a, c, t, g, unknown or other
  misc_feature (252)..(252): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctccaccctcctcactcgagggcacgagggtccgtcgggcccagtctcgccctgactcacgtccctccctccggccgtccgggtctccgtggacagtcagtccacctatcctcctgaccgacgtcgggaaccngcagtcgactgtttcggtacgttaataactattcgtccttaccgtacgtaaacccaaacaacctactaccgaacggtaacccaaacccgtaaccccctaaacgtcggtacgttacttcgtacggtacggtacgtaacggtaaccggtccccggtaccgtaccgggtaccggggttccctagtaccgttccgtccgttaccgtccggtacgtaccctaaccgtacgtcggtaccgaccgaaccgtaccccgtcccgtcccgtaccgtccgttccgttcccggtcggtacccacgtacggtacggttaacggaggtacggtacggtaccgtacgttacgttaacgttaccgtaccgtcggacctacgtcgttacgtagttaccggacggtacgtaccgtacgttaacccggttcgttaaccgggtccgggttaaccggggaccggtaaccggaaccggtaccgttacccgggttaacccggtacccggtaccggtaccggacccgtaacccgggtacccgtacccggtccccgttacccccggtcccggttaccccg

SEQ ID NO: 119032 - DNA, 699 bp, Homo sapiens
  misc_feature: GYAE6OF01A3AT4.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtgggaccagcagtgactagttggtacgttataactatgtctcctggtaccaacaacatccaggacaaacgacccccaaactcgtagtatttcaggacggtacaaggtaacgccggtccctacggacgggtccctggtactcgtccttctcgtcggtcctaccgaacgttcgtcgggaccaaaccgtcccggtacccttccccgtacggtaccccgttcccgtcgggccctaccgacgtaccgtaggaacggtatacggacggtctagtaaccttaacttaccgtcggactagtccttacgtagtttacggccgtaacggtcccgaacggtaccgttaacgttacccgttccgggttaccgggaccggggtacggaacccgtaacggtcgttaccggtaccccggttacggtaaccgggtacccgaaccggtaccccgaacgggtaccctccccggtcccccgtcgggttacccc

SEQ ID NO: 119033 - DNA, 550 bp, Homo sapiens
  misc_feature: GYAE6OF01D9AIK.5.86.H09.1.454.CMB.1.raw
  modified_base (406)..(406): a, c, t, g, unknown or other
  misc_feature (406)..(406): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctctggtaccaacaacatccaggcaaacgccccaaactcgtgatttctgagtcagtaagcggtcccacgcgggtccctgatcgcttctacgtgctccaatctggcaacgaccggcctccctgaccgtctcgtggctccagactgagntgagtctgactacttactgcagtctctaatttcgcgtaaggcacgtcgtactaacgtcgttaccggtcgggaacgggaccgtaacgacgtacggacccgtaccgtacggtacgaccgacccgaaggtcctccgcccccgtccgg

SEQ ID NO: 119034 - DNA, 641 bp, Homo sapiens
  misc_feature: GYAE6OF01DLZTF.5.86.H09.1.454.CMB.1.raw
  modified_base (323)..(323): a, c, t, g, unknown or other
  misc_feature (323)..(323): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagccctccctccgcgtccgggtctcctggacagtcagtcaccatcctcctgcacgtgggaccagcagtgactagttggtacgttaataactatcgtctcctaggtaccaaactaacactccaggacaaacgcccccaaactcgtgtatttcgngacggtcagtaacgccggtccctgacgggtcctggatccgtcttctcgtcggtcctacgtaacgtcgtcggacctaaccgaccggtccctcccgtcgtacccgttctccggtcgggtacctaccgaacgtaccgtggaacggtaagttcggacggtcgtacgtacttactttaacgtcggactacgtcttctaagtttcgacgtacggactacgtaccgttattaccgttcggttcgggacggtacggaaccgtagactaccggacccgttaccgtacggaccaccggtaccgaacggtccctccgtcccccgtaccg

SEQ ID NO: 119035 - DNA, 798 bp, Homo sapiens
  misc_feature: GYAE6OF01CL2S5.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacagtcagtccaccatctcctgcacgtgggaccagcagtgactagttggtacgtttaataacctatggttcctccgttcggtaaccaaacaacacgttaccagggaccaaaaccgaccccccaaaacttccgtaggtacttttcgtaggtacggtactaacggtaaacgcccgggtaccccttacggtaacgggggttcccccttaggaaccgtttccggtccttttccgttccgttcggtaccctttaccgtaaacgttccgttcgggaaccctaaaccgacccggtcccctttccccgtacggtaaccccgttccgttaccggtcggggtacccttacccgaaggtacccgttacgggaagggtaactcggggtaagggtccgttacgggtaacctttaacgtttaaccgtcggtacctacgggtcctttacgttaacgttttcggaccggtacggaccgtacgttacccggttacttaccgttccggttccggggaaccgggtacgggtaaccgaacggtcgttaccggtacccggtacccgttaacgggtaccgaccggaacccgagggtccccgtccggtccccgttaccggg

SEQ ID NO: 119036 - DNA, 545 bp, Homo sapiens
  misc_feature: GYAE6OF01CO642.5.86.H09.1.454.CMB.1.raw
  modified_base (344)..(344): a, c, t, g, unknown or other
  misc_feature (344)..(344): n is a, c, g, or t
  modified_base (532)..(532): a, c, t, g, unknown or other
  misc_feature (532)..(532): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacagggtcctgggcccagtctgccctgactcagcctccctccgcgtccgggtctcctggacagtcagtcaccatctcctgcacgtgggaccagcagtgacagtttggtcgttataactatgtctcctggtaccaacaacatccaggaccaaacgcccccaaactcgtgtatttctgaggtcagtaagcggccctcgaggggtcccngactcgcttctctcggctcgaacgtctggcaacgaccggtccctcccgtcgtaccgtctcgtgggcctcgagacgtagaggtagtgacgtctagactattactcgcgacgcttcgtatttcgcgaggcacgcctatcttcgtcggcggacggacgagcgtcggaccgtctaggtcacgaccaggtccnccgtccccgtccg

SEQ ID NO: 119037 - DNA, 522 bp, Homo sapiens
  misc_feature: GYAE6OF01CZ18L.5.86.H09.1.454.CMB.1.raw
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
  modified_base (427)..(427): a, c, t, g, unknown or other
  misc_feature (427)..(427): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttcngaggtcagtaagcggcctcgacggggtcccngactcgcttctctggctcaagtctggcaacacggcctccctgaccgtctcgtcgggcctccagactgacgatgaggctgactattacngcagctcattgcagcagcctatactcgttcggcggtaggaccaagctacggaccgtccgtaggtcacggacccaaggtcctcggcccccttacgg

SEQ ID NO: 119038 - DNA, 841 bp, Homo sapiens
  misc_feature: GYAE6OF01BFNAL.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcgaggcacgagggtcctgggcccagtctcgccctgactcacgccctccctccgccgtccgggtctccgtggacagtcagtccacctattcctccgtgcctacgtcgggaacccaggctaggtacgactagtttggttacgtttaataacttagttcgttccctaccgttacggtaaccaaacaaccacgttcccgaaggaacccaaaacccggacccccctaaaagttccgttataccgtttttcgagggtaacggtacgtaaacggtaacgccccgggtaccccgttacgggtaccggggttacccctaggtaccgttcccgttccgtttaccgttcggtccggtacccttaccccgtaaaggttccgtaccgggacccgaaacccgtccccggtccccttacccggtacggttaccccgtttcgtcccggtcgggtcccgtacccgtaagggtacccgtacgggaaggtacgtaggtaccggttacgtacggttaacctagtttaccgcgtacgtacgtacgttaccgttagtttccgggaacgtacgggtaccgtacggtacccgttacgttaaccgttcccgggttaccggggacgggttaaccggaacccggtacgtcccggttacccggtaaccggttcccggtaaccgtaccggtacccgacccggtaacggccccttccccggtaccccccggttaccg

SEQ ID NO: 119039 - DNA, 665 bp, Homo sapiens
  misc_feature: GYAE6OF01D0TMT.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcacgcctccctccgcgtccgggtctccgtggacagtcagtccaccatctcctgcacgtggaccagcagtgactgttggtacttataactatgtcttcctacggtaccaacaactactaccaggacaaacgaccccctaaactcgtgtactttcgtgagtcagtacgcggccctcgacgggtccctgactcgtcttcgtcgtcggcctctaagtcgtggaccaaccgtccggtccctcccgtacggtacccgttccgtccgttcgggcctaccgacgtacgtggaacggtagtggtacggcttacggtacttatttaccgtcgacgtaacgtcttacgttagtttcgaccggtaggcccgtacggtaccgttacgttaccgttccggtacgggaccgggtaacgggaaccgaacgtaccgttaccggtacccgttaccggtacggtacccgtaccggacccgtaaagggcccgtacccggtcccccgttacccggg

SEQ ID NO: 119040 - DNA, 583 bp, Homo sapiens
  misc_feature: GYAE6OF01CSBJ6.5.86.H09.1.454.CMB.1.raw
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (389)..(389): a, c, t, g, unknown or other
  misc_feature (389)..(389): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaatatacaagactacacagactccgtgaaggccggttnaccactcganagacaactccaggacacggtgtacctacacatagaacagcctagagagccgaggacaacggccgtatattattgtgtggagggaaactgggggcaagtttcgaccgntcggggccagggaaccctggtacaccgtctcctcacgccctccaccaacgggcccatccggtcttccccgtggccgccctgcctccgacgtacgccaccgtccgagacgccgaccacggccggccccgtgggcctcggtccgtggttcaacggtaccttaaccttcccggtgtacctagacgtcgtaggacggg

SEQ ID NO: 119041 - DNA, 828 bp, Homo sapiens
  misc_feature: GYAE6OF01A25TC.5.86.H09.1.454.CMB.1.raw
tcagatcagacacgcacgaccggtgctcgatttagtgctatagacttgggtttgggggctggggtctccaggaggcagcgctctcaggacgtcaccaccatggcctgggctctgctcctcctcaccctcctcactcagggcacagggtcctgggcccagtctgccctgactcagcctccctccgcgtccgggtctccgtggacaggtcagtccaccatccgtcctgcacgtgggaccagcagtgactattggtcgttataactatgtcctctggtaccaacaacatccgaggacaaaccgacccccaaacgtcgtacgtatttcgtaggaggtacaaggtaacgccggcccgttacgacggggttccctaggactcgtaccttcgtcgtcggtcctaccgtaacggttccgtacgggtaccctaaaccggtacccggtccccttaccccgtacgtaaccccggttcccgttacccggttccggggtacccgttaccccgaacgggtaacccgttacgggaacgggtaacggttaacggggtaaccgggttacccgtaacggttaaaccgtttaaactttaccgttacggtaccgtaacggttaccttaccgttaagttttccggacggtaacggtccgtaacgggttaccggttaacgtttaccgttccgggttaccggggtaccgggggtaaaccggggtaacccggtaacgggttacccggttaaccgggtaccccgggtttacccggttaacccggggttaccggaaacccgggttacccgggtaaaccgggtcccggtccccgggttcccccccgttaccgggg

SEQ ID NO: 119042 - DNA, 582 bp, Homo sapiens
  misc_feature: GYAE6OF01A4OQW.5.86.H09.1.454.CMB.1.raw
  modified_base (492)..(492): a, c, t, g, unknown or other
  misc_feature (492)..(492): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaagggctggactggctctcaaatattaatggtaaaggcaatatacaagactacacagactccgtgaagggccggttcaccacctcgagagacaactccagggacacggtgtacctacacatgaacagcctgagagccgaggacacggccgtatattatgtgtgaggggaaactggggacaagtttgaccgctggggccagggaaccctggtcaccgtctcctcagccctccaccaaggcccatcggtccttccccctggccgcccctgcctcccgaggacgccaccgtccgacgacncgaccacggccggaccccgtggggcctcggcccgtgggtcccgaaagggtaccctaccgtccccgtgtacctgacttccgtggtaccggg

SEQ ID NO: 119043 - DNA, 740 bp, Homo sapiens
  misc_feature: GYAE6OF01C8035.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcgagggcacgagggtcctgggcccagtctgccctgactcagcctcctccgcgtccgggtctcctggacagtcagtcaccatcctcctgcacgtgggaccagcagtgactagttggtcgttataactatcgtctccgtacggtaaccaacaacactaccgacggaccaaaaccgacccccctaaacgtcgtacgtactttcgtaggtaggtacgaaggtaaacggtcccggaccccgtacggtaccggggttccctggtactccgtcttccgtcgtcggtccttaccgtaacggttcgtacggaccgaaaccgacccggtcccttcccgtacgtacccgttcgttccggtcgggtacccttaccgaacgtaccgtagggagtacgtggacggtcgtacgtaaccttacgttaccgtcggacctaagtcttacgttacgtttacggaccgtaggcctaacggtaccgttacttaccgttaccgggttcgggaccgggtaacgggacccgtaacggttacccgaccggttaccccggttaccggtaacgggtacccgtaaccggtaccccggaaccgggtcccgtcccccggtcccccggttacccggg

SEQ ID NO: 119044 - DNA, 643 bp, Homo sapiens
  misc_feature: GYAE6OF01EA6I9.5.86.H09.1.454.CMB.1.raw
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
  modified_base (638)..(638): a, c, t, g, unknown or other
  misc_feature (638)..(638): n is a, c, g, or t
  modified_base (640)..(641): a, c, t, g, unknown or other
  misc_feature (640)..(641): n is a, c, g, or t
  modified_base (643)..(643): a, c, t, g, unknown or other
  misc_feature (643)..(643): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctacaaattattaatggaaaaggcaatatacaagactacacagactccgtgaacgggccgttcaccacctcgagagacagctccgaggacacggtcgtacctacacatgaacagcctagagacgccgaggaccacggaccgtatattagttgtagtgagggaacgtggggactaagttgaccgngtcgggaccgacgggaaccctggtaccnccgtcgtccncgacgccctaccaccgaacgggccctacgttccggtcccgttcccccgtcgggcccgtccccgttcgcccgtaccgacgggaccgaccctacccgtaccggacgaccgaccaccgacggcccgggcccgtacgggctccggtcccggtacggtaccgaacggtacccttacccgttcccggttacgtccgtagtactccggtggacggtccgggccgtacgggcgaaacgggcgacgtagngnngn

SEQ ID NO: 119045 - DNA, 983 bp, Homo sapiens
  misc_feature: GYAE6OF01BHMFP.5.86.H09.1.454.CMB.1.raw
tcagatcagacacgcacgaccggtgctcgatttagtgctatagacttgagtctgggggaggcttggtacagcctggggggtccctgagacctctcctgtgcacgcctcgtgtactttcctaccttttacgtgttagtttttcggactagtcggtacgggttcggggtcccgaccgaggcctaccggaagggggaacgggcgtggacgtggctactaactaaaattaatttaaagaagggaaaacggactaaattaactaaaccgaaagaacctaacaacgagtaccgtccggtaaggaaccggggtcccgttaccacccgtacctacggaagaacgaacctaaccgtaccggaagggaccgtacgggttacgtaacccttaaccaacgagtacgaaaccgacgtacccgtaggacggaccggacccggaagggaaccgtaaccggggtacccgtttaaatttaagttttaggtttagggttacgggtagggaacggggggtaaacggttcgggggggtactttaaaggttttaccggacccggtcgggtaccgggggacccggaaccggggtaacccggtcggtacccgtaccgttcccgttcccgtacggaccgtacccccttacccgaaaccccggtaaccgggccccgtaacggttccccgggttacccccgtttccccccggtcgggtacccccggtaccccggttacgtacccccgttacccggaacgggtaccgtacccccgtaccccggtaccggaacggtacccggtacccgaacggtacccgggaccccgggtcccgggttcgggacccgttacccgggtcccggtttacgggtaaccccggtaacgggttaccccgttaacccggttttcccggtcggttaccgtacggtaccgttcggtacgggacgggtcccgggtaccggttcgggaaccggtaaccgggtccgtaacggtacgttaggccgagtccgag

SEQ ID NO: 119046 - DNA, 794 bp, Homo sapiens
  misc_feature: GYAE6OF01A69Y6.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgactagttggttacgttataactatgtctcctggtaccaacaacatccaggcaaacgcccccaaactcgtgtatttctagaggtcagtaagcggaccctcgaggggtccctgactcgtcttctcgtcggtcctaccgaagtcgtcgggacctaaaccgaccgggtccccttccccgtacgtacccgttcctccgttacggggcccttacccgaaggtaccgtacgggaacgggtacgttacgggacgggaccttggtaaacctttaaacgttttaccctggtaccgtaacggtccttacgtttaacgttttacggacccgtaacgggttaccgtaacggttacccggtttaaacttaccccggttttaccgggttcccggggggtaacccgggggtaaccgggggttaaacccccgtaaacggggttacccggttaacccggggttaaacccccgggtttaccccgttaaaccggggttacccgtaaacccggggtaccccccgtaaaacgggggtccccgttaccccgggtacccccccccggttttaaccccgggg

SEQ ID NO: 119047 - DNA, 743 bp, Homo sapiens
  misc_feature: GYAE6OF01DV891.5.86.H09.1.454.CMB.1.raw
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (291)..(291): a, c, t, g, unknown or other
  misc_feature (291)..(291): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagccctcctccgcgtccggtctccgtggacagtcagtcaccntctctncacgtgggaccagcagtcgactagtttcggtacgtttaataacttattcgttcttccgttaggtaacccaaanaacacttaccgacggaaccaaaccgacccccaaaacgttcgtagtacttttcgaggtacggtcaaggtaacgcccggtaccctcggacggggttccctaggactcgttctttccttcgttcgtaccgtaccgtaacgttcgtacgggaccaaaccggtacccggtccctcccgtacgtacccgttcgtccgtcggtcctaccgacgtacgtaggacggtgtacggacggttacgtacgtaacttattaccggtgtaccgtagtccttacgttattacggacgtacgtaccgacggttaccgttacttaacccggttccggttaccgggaccggggtaaaccgggtaacccgtaacgggtcccgttacccgggtaacccgttaccgggtaacggttacccgaacccgggtaacccggtaacgggtccccctaccccggtccccggttacccgg

SEQ ID NO: 119048 - DNA, 748 bp, Homo sapiens
  misc_feature: GYAE6OF01D17ZN.5.86.H09.1.454.CMB.1.raw
tcagatcagacacgcacgaccggtgctcgatttagtgctatagacttggggtttgggggctggggtctcaggaggcagcgctctcaggacgtcaccaccatggcctgggctctgctcctcctcaccctcctcactcgagggcacgagggtcctgggcccagtctcgcctgactcacgccctccctcgcgtccgggtctccgtggacagtcagtcaccatctcctgcacgtggaccagcagtgactagttggtcgttaataactatcgtcctccgtacggtaaccaacaactactccgaaggaccaaacgaccccctaaaacgtcgtgtatttcgtggaggtcaagtacgccggcctcgtacgggtcctggactcgtcttctcgtcggtcctacgaagtcgtgacctaaccgtaccggtccctcccgtacggtacccgttccgttccgtcggggtaccctccggtaacgtaccgttagggaacgggtacgttacgggacgggtaccttacggtaaacctttacgtttaaccgtcggtcctaacggttcttacgtacgttttggaccgtacgggtaaccgttacggtaaccgttaccttaaccggttcccggttacggggacccggggtaaacggtaacccggtaaccggtacccggttacccggtaacccggttacccgtaaccgggtacccgtaacccggaccccggtaaccgggtccccgttccccgggtccccccggttaacccgg

SEQ ID NO: 119049 - DNA, 841 bp, Homo sapiens
  misc_feature: GYAE6OF01DXWM8.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctctgtgcagcctctggattctacctttactgtattttggctatggacggtgggtccgccgaggctaccggaggggaacgggctaggacgtggctctacaaatattaagtaggtaaagactaaatataacaagactaacacacgactccggtaggaacgggtccgttaccaaccaccgtacggaacgaacgaacctaaccgtccggaagggaaccgtacggttacgtaaccctaacgaactaagtacgaaacgacgcgtaggacgacggaccggaaggaccgacgggaccttaataagttagttcggtaggtacgggaagggggtaaacgtcggggaacttaacggttacgggaccggtacggtacggggaacccggtaacggggtaaccccgttagggtacccgtacccggttacctcccgtacgtaaccggtaccccgtacccgaaccgggaacccggtacccgtaaccgttcccggttccccgtttacccccggtacggtccccgcccgttacggacccgttacccggaacggacccgtacccaacccggtaccgaacggtaccgcccggtaaccggacccggtcccgggttcccggtcgggtacccgtccggtaccggttacggtaacccgttaaaccgggtacccgtttaaccccggttcccgggttacgttacccgttaggtaccgttcccggttaagggaccgggg

SEQ ID NO: 119050 - DNA, 699 bp, Homo sapiens
  misc_feature: GYAE6OF01AUYN3.5.86.H09.1.454.CMB.1.raw
  modified_base (217)..(217): a, c, t, g, unknown or other
  misc_feature (217)..(217): n is a, c, g, or t
tcagatcagacacgcacgaccggtgctcgatttagtgctatagacttggggtttgggggctggggtctcaggaggcagcgctctcaggacgtcaccaccatggcctgggctctgctcctcctcaccctcctcactcagggcacagggtcctgggcccagtctgccctgactcagccctccctcgcgtccgggtctcctggacagtcagtcaccatcncctgcacgtgggaccagcagtgactattggtacgttataactatgtctacctggtaaccaacaacataccgaaggaccaaaaccgccccctaaaacgtcggtagtactttacgtaggtacggtacaaggtaacgccggtccccgtacggaacggggttccctaggtacgtaccgtcctttacgtccgtcggtacctaccgtaagtccgtagggaccaaaccgtaccggtccctcccgtaggtacccgttctcggtcgggtcctaccgaacggtactaggaacggtagtaggacggtaccgtagtaaccttaacttacgtgacgtacggtcttacgttaacgtttcgacgtacggacgtacggtaccgttaataccgttccgggttacggacgggtaacgggaaccgagtacccgtacggtacccgttaccggtaaggtaccgtacgacccgtaaggccgttaccccggccccgttacccggg

SEQ ID NO: 119051 - DNA, 601 bp, Homo sapiens
  misc_feature: GYAE6OF01CU3Y6.5.86.H09.1.454.CMB.1.raw
  modified_base (359)..(359): a, c, t, g, unknown or other
  misc_feature (359)..(359): n is a, c, g, or t
  modified_base (444)..(444): a, c, t, g, unknown or other
  misc_feature (444)..(444): n is a, c, g, or t
tcagatcagacacgcacgaccggtgctcgatttagtgctatagacttgggtttggggggctggggtctcaggaggcagcgctctcaggacgtcacaccatcggcctgggctctgctcctctcacctctcactcagggcacagggtcctgggccagtctgcctgactcacgcctcctccgcgtccgggtctccgtggacagtcagtcacctatcctctcgctacgtcgggaccagctagtcgaactgttggtacttaatactatcgtctcgtacggtaaccaacacactacgacggacaaacgaccctaaactcgtgtacttctgtagtacgacggtacgcggaccgtcggacgggtccngtactcgtctcgtcgtcgctactagtcgtacgactaccgccgtcctccgtacgcgtactcgtacggtctacagtactggagtagngacgtctagtactacttacgcgactcgtacgtacttcgtagtacgcgactcggtactacgtacgttccggacggtaccgggaggtaccgtacgtacggacgttccggacgttaaccggcgtaacggacctaacgggctacccggttcccgtacccgg

SEQ ID NO: 119052 - DNA, 676 bp, Homo sapiens
  misc_feature: GYAE6OF01CVKJ0.5.86.H09.1.454.CMB.1.raw
  modified_base (384)..(384): a, c, t, g, unknown or other
  misc_feature (384)..(384): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcgaggcacagggtcctgggcccagtctgccctgactcacgcctccctccgcgtccgggtctcctggacagtcagtcaccatctcctgcacgtgggaccagcagtgacatttggtacgttaataactatgtctccgtacgtaaccaaacaacactccaggaccaaacgacccccaaactcgtagtacttttcgaggtacggttacaaggtaacgccggaccctcggacggggtccctgtactcgtcttctcncggtctacgaagtctcggacaaccgcggtccctccgtcgtaccgtctccgtcggccttaccgacgtacgtcggaaggtacgtggacggtacgtacgtaacttacttacgtgtaccacgtacttacgtacgtttacggacgtcggactacgtacccgttattaccggttccggttacggggaccgggtaacgggtaaccgtaaacggtcccgttaccgggtaacccgttaccgttaacgggtaccgtaccggtaaaccccgaggttcccgtccccggtcccccgtttaccggg

SEQ ID NO: 119053 - DNA, 659 bp, Homo sapiens
  misc_feature: GYAE6OF01A57YT.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaccagcagtgactagttggtcgttataactatgtctcgtgtaccaacaacatccaggcaaacgcccccaaatcgtagatttctgagtcagtaacgcgccctgacgggtcctgatcgtcttctcgtggcctacgaagtctggaccaaccgcggtcccctccgtctaccgtcctcgtcggcctaccgacgtactacggaaggtattcgggacgtacgtacgtaaccttacgttacctcgaccgacgtcgttactagttttcggacgtcggactacggtaccgttacgttaccgttccggttacgggacccgggtaacggggtaacccgtacgggtacccgttaccgggttaaccccggttcccggttaacgggttacccgaccggtaccccggtaacgggccccggttcccggtcccccccggtttaccccggg

SEQ ID NO: 119054 - DNA, 942 bp, Homo sapiens
  misc_feature: GYAE6OF01DZ29C.5.86.H09.1.454.CMB.1.raw
tcagatcagacacgcacgaccggtgctcgatttagtgctatagacttgggtttgggggctggggtctcaggaggcagcgctctcaggacgtcaccaccatggccgtgggctctgctcctcctcaccctctcactcgagggcacgacgggtcctcgggcccagtctcgccctgactcacgccctcccgtccgtcggtccgggtctccgtaggactagtccagtccacctacttcctccgtgccgtacgtcgggaaccacggctaggtcgtacttaggtttcggttacgtttaactaacgtttacgttcggttaccttaccgtacggtaaacccaaaccaacctaacctaccgaaccggtaaaccaaaacccgtaccccccgtaaacgttccggttacgttaacttttacggtaggtaaccggttaacgtaacgggtaccgtaccccgggtccccgttaccgggtaacccgggggttcctacggttaccggttccgttaccgtttccgtcggtacccggttaccgtaacccgttaacggttccggaacggtaacccgtaaaccccggtccccgggttacccccgtttcccggttaccgggttaccccgttcccggttacccgggttcccgggtacccgttaaccccggtacgggttaaccggttacgggtaaagggttacggtacgggtaacggtaccgttaacgttaaaccgtttaccgttaccggtacgtcgtaaccgtcgttaaccggtttagtacccgggtagtaacccgggttccgtaacccggtttaccgttaaccgtttacccgggttacggggttaaccccggggacgggtaacccggaacccggttcggaacccgttcccgggtaacccgttacggtaaccggtaccggacccggtaacggtacccgtcccggtacccggttcccccggtaaccg

SEQ ID NO: 119055 - DNA, 765 bp, Homo sapiens
  misc_feature: GYAE6OF01AU1PW.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgtattttggcatgacggtgggtccgccaggctccgaggggaaggggctggacgtggctctacaaaattattaaagtagggtaaaacggctaaataactaacaaagactaacaacaacgaccgtccggtaggaacggggcccggttaccaacccgaccgtacggaaggtaacgaaccaaccgtccggaaggggaaccgtacgggtacgtaaccctacacgaagtacgaaacgacgccgtaggacgacggaccggaaggaccgacggtaccgttaatagttagtgtaggtagggaaggggaaacggtggggactaagttcggaccggtcgggtacggggaccgacggggtacccgtcgggtccctaccggtcctccgtccacgtcccgtaccgaaccggaaccggccctacggttcccggttcccgttcccccgtcgggtcccgtccccgtcggcccgtaccgaacgggtacccgaccgacccgtaccggacgacgaccgaccgacggcccggaccggtcgggtccgtccggtccggtacgggaaccgtaaccgggttaccttacccggttcccgttgtacccgttggtacgtcgggtcggtaccggg

SEQ ID NO: 119056 - DNA, 639 bp, Homo sapiens
  misc_feature: GYAE6OF01DPHW6.5.86.H09.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
tcagatcagacacgcacgaccggtgctcgatttagtgctatagacttgggtttgggggctggggtctcaggaggcagcgctctcaggaccgtcaccaccatggcctgggctctgcctcctcctcaccctctcactcaggcacagggtcctgggcccagtctgccctagactcagcctcctcgcgtccggtctcctgacngtcagtcacntcnctgcatggacancagtgctattggacgttatactntgtctccgtgtaccaactatacgaccacgacaaacgaccccctaaatcggtatatttccgtagaacggtctaagtaacggccgtcccttcggacgggtccctggctccggtcttacgtcgtggacctccgtaagtccgtaggccaaaccggtcggaccccttccgtccgtacgttcgtccggtcggtacctccgaagaccgttaggagtacgtcgacggcttaggtaaccttactacgtcgcgtaccgaagttccgttaagttcggtactacgggctaaccgggtccttacgtaaccgttccgttcgggaaccggtagggtaacctacgggtctacgggtaacccgtccgttagaccgttaccgacgaccggtacctcccgtccgttacccg

SEQ ID NO: 119057 - DNA, 729 bp, Homo sapiens
  misc_feature: GYAE6OF01A8SJG.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacgagggtcctgggcccagtctgccctgactcacgccctccctccgccgtccgggtctccgtggacagtcagtccaccatctcctgccacgtggaccagcagtgactgttggtacgttaataactattgtcctccgttacggtaaccaacaacactaccgaaggaccaaaaccgaccccccaaattcgtacgtactttcgagtacgtcaaggtaacgccgccctcggacgggtccctagactcgtccttcgtacgtcggactccgtaagtcgtacggaccaaccgtaccggtccctcccgtacgtacccgttccttaccgggtcggtcctacccgtaagtacgtacggaacggtgtacggacgtccgttaagtaacctttacgttaccgtcggaccttacgtacttaccgttagttcccggacggtacggtactaacccggtccgttaacttaccggttccgggttacccgggacgggaaccgggttaacccgtacgtaccggttaccccggtaccgttacccgggtacggttaacccggacccgtaaccggtaaccggttccccgtaccccggtccccggttaccccgg

SEQ ID NO: 119058 - DNA, 653 bp, Homo sapiens
  misc_feature: GYAE6OF01ALHIZ.5.86.H09.1.454.CMB.1.raw
tcagatcagacacgcacgaccggtgctcgatttagtgctatagacttgggtttgggggctggggtctcagggaggcagcgctctcaggacgtcaccaccatggcctgggctctgctcctcctcaccctctcactcagggcacagggtcctgggcccagtctgccctgactcagccctccctccgcgtccgggtctccgtggacagtcagtcaccatctcctgcacgtcgggaccagcagtgacattggtacttataactatgtctcctgtaccaacaacatccgaggacaaaccgacccccaaactcgtgtattttcctggtacggtacaagtaacggccggccctcggtacggggtccctagactcgtccttctcgtcggtacctctaagtcgtcggaccaaccgtacccggccctcccgtacggacccgttccgttccggtcgggtccttacccgacgtacgtaggaaggtacgtggaacggcttaacgaaccgtttagtttacgcgtactaccgtacttcttagttcgacgtacggcgtacgtcgtacttccgtcgtccggggcggaacgggtaccacggtcgtacggtacccgttccgtacggtaccgaaccgacccggtaaggtcccgtcccggtcccccgttccggg

SEQ ID NO: 119059 - DNA, 698 bp, Homo sapiens
  misc_feature: GYAE6OF01D6F7Q.5.86.H09.1.454.CMB.1.raw
  modified_base (351)..(351): a, c, t, g, unknown or other
  misc_feature (351)..(351): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctcgccctgactcagcctccctccgcgtccggtctcctggacagtcagtcaccatctcctgcacgtgggaccagcagtgaactagttggtacgttaataacgtattcgttcctccgttacggtaacccaaacaaaccactacccgagggtaccaaaaccggacccccctaaaacgtcggtacgtacttttcgnggtaggtacaaggtaacggccggtccctacggtacggggtccctgacgtcgtcttctcgtcggctaccgtaacgtcgtacggacctaaccgaccggtccctacccgtcggtacccgtccgtccgtacgggccctaccgacgtacgtggaaggtacgtggacgtcgtagtaccttaattaccgtgactacgtcttcgtagtttcggacgtaggtaccgacgtaccgttacgttaaccgttcggttccgggacggggtaacggaaccgtacgtcggttacggtacccggttccgtacggtacccgtaccggacccgtaaccgggtcccgtcccgtcccccggttaccgg

SEQ ID NO: 119060 - DNA, 645 bp, Homo sapiens
  misc_feature: GYAE6OF01A3OZG.5.86.H09.1.454.CMB.1.raw
  modified_base (245)..(245): a, c, t, g, unknown or other
  misc_feature (245)..(245): n is a, c, g, or t
tcagatcagacacgcacgaccggtgctcgatttagtgctatagacgttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtccaccatcctcctgcactgggaccagcagtgacnttggtcgttataactatgtctcctggtaccaacaacactccaggacaaacgccccccaaactcgtgtactttctgtaacggtctaagtaagccggccctacgacggggtccctgactccgcttctcgtggctcgagtctggcaacacggtccctcctcgacccgtctcgtgggcctccgagtactggacggtatgggacggtctacgtacttagttacgtacgtctacgtctacgttactttcggacgtacggtacctacggttaccgttacgtaccgttccggtaccgggaccgggtaacgggaacccgtaacggtccgttacgggtaccccgttaccggttaaccggtaccgtaaccggaccccgtaacgggtccctcccggtccccccggttaccgg

SEQ ID NO: 119061 - DNA, 703 bp, Homo sapiens
  misc_feature: GYAE6OF01DA3PJ.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcgaggcacagggtcctgggcccagtctgccctgactcagcctcctccgcgtccggtctcctggacagtcagtcaccatctccgtgcacgtgggaccagcagtgacattggtacttaataactatgtctccgtgtaccaacaacatccgagacaaacgaccccaaactcgtgtattcgagagtacagtaacgcgcctcgacgggtccctagactcgtcttctcgtcgctacgaacgtctcggacaaccgaccggtcccttacccgtggtaaccccgttccgttccggtccgggtaccctacccgtaacggtaccgttagggaacggtaacggtgggtaaccggtccgttaacggtaacctttaacgtttaaccgttcggaccgtaagttcctaacgtttatttaccggacgtacggaccgtaaccgtaccggttaacttccgttaccgggttaccgggacggggtaacgggaacccgaaacggtcccgttaacggtaaccccgttaccgtagggtaacccgtacccgggaaccccgtaagggtacccctcccggtccccccgttaaccggg

SEQ ID NO: 119062 - DNA, 720 bp, Homo sapiens
  misc_feature: GYAE6OF01BM8WL.5.86.H09.1.454.CMB.1.raw
  modified_base (143)..(143): a, c, t, g, unknown or other
  misc_feature (143)..(143): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacngggtcctgggcccagtctgccctgactcagcctccctccgcgtccgggtctccgtggacagtcagtcacatctcctgcactgggaccagcagtgactagttggtacgttataactatgtctcctaggtaccaacaacatccaggaccaaacgcccccaaactcgtgtacttcgtagacgtcagtaacgccggtaccctcgacggggtcctagctacgtcttctcgtcggtcctaccgtaacgtcgtcggacctaaaccgtaccggtccctcccgtacggacccgttccgtaccgttccgggcctaccgtaacggtactaggtaggacgtacggacggtcgtacggtaactttacgttacgtcggtactacgtacgttccgttaacgtttcggaccgtaacgggccgttaacggaccggtttaacgttaccgttcccgggttacggggaacccggggtaacgggtaacccggtaacgggtaccgttaccgggtaccccgttacccggttaacggtcccggtaaccggtaaccccggtaaccgggcccccttacccgggtccccccggttaaccccggg

SEQ ID NO: 119063 - DNA, 623 bp, Homo sapiens
  misc_feature: GYAE6OF01DJKGX.5.86.H09.1.454.CMB.1.raw
  modified_base (455)..(455): a, c, t, g, unknown or other
  misc_feature (455)..(455): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctcctccgcgtccggtctcctggacagtcagtccaccatcctcctgcactgggaccagcagtgactagttggtacgttataactatgtctccgtagtaccaacaacactccaggccaaaacgacccccctaaatcggtagtatttcgagacgtagagtaacgccgccctcgacggggtcctgacgtcgtcttctcgtcgctaccgagtcgtagccaacgaccgtcctccgtacgccgtctacgtcggctccgagctgaggatgacgctacgtactacttacncgtactacgtcgtactagtttagccgtagactacgtaccgttacgttaccttccgggttccgggaacggggtaacggacccgtaaagtccggtaccggtaacccgttcccgtaagggtacccgaccggaacccgtaacggcccgttacccggtccccccgttaccggg

SEQ ID NO: 119064 - DNA, 737 bp, Homo sapiens
  misc_feature: GYAE6OF01D5MAG.5.86.H09.1.454.CMB.1.raw
  modified_base (202)..(202): a, c, t, g, unknown or other
  misc_feature (202)..(202): n is a, c, g, or t
tcagatcagacacgcacgaccggtgctcgatttagtgctatagacttgggtttgggggctggggtctcaggaggcagcgctctcaggacgtcaccaccatggcctgggctctgctcctctcacctctcactcagggcacgacgggtcctgggcccagtctcgccctgactcacgcctccgtcgcgtccggtctcgtaggacncgtcacgtaccaccgactctcctagcctacggtacgggaccaggtctaggtcgtaacgttgtttcgggttaacctttaattaaacgtcgttcgtcctccgttacggaaccaaaactaactacgtacccgacgggaacctaaaacccgtacccccgtaaaacgttcggttacgttacttttcgacggtaacggtaccgtaacggtaaaccggtccccggtaccgtaccgggtaacggggttccctaggtacgttccgtacgttccgtcggtacgtcacgtacgtgtacgactacgctccgtcgtacgtccgtctacgtcggcctacgacgcgttaggacgtacgtagcgtctacgtacgttacgactcgactcgtactcgtagttcgacgacgtacgtactaccgtacgttccgttcgggtcgggtaaccgtaacgggaccgaaacggtttccggttaacggccccggttagggttaaccggacccgtaccgggaaaacccggtccggtcccgttaacccggtccccgttaacggg

SEQ ID NO: 119065 - DNA, 621 bp, Homo sapiens
  misc_feature: GYAE6OF01AUHUL.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctcgggcccagtctgccctgactcagcctcctccgcgtccggtctccgtggacagtcagtccaccatcctcctgcacgtcgggaccagcagtgactagttggtacgttataactatgtctctcggtaacctaacaacatccagacaaacgacccccaaactccgtacgtactttcagtaggtcaagtaacgtccgcctacgacgggtcctgctcgcttcgctcgctacagtcgagacacgtcgcctcctacgaccgtctcgtcggtctccgagtacgtggacgtagtcggacgtacgtacggtacttaacgttcgtacgtaccgtagtacgtacttacgttacggacgtacggacgtacgtaccgtaacgttaccgtcgttacgggccgggtaacggacgtaaccgtgtaccgtcccggtaccgtacggtaccgaaccggtcccgaacgggccctaccgtccccggttaaccgg

SEQ ID NO: 119066 - DNA, 686 bp, Homo sapiens
  misc_feature: GYAE6OF01COUFD.5.86.H09.1.454.CMB.1.raw
  modified_base (341)..(341): a, c, t, g, unknown or other
  misc_feature (341)..(341): n is a, c, g, or t
  modified_base (489)..(489): a, c, t, g, unknown or other
  misc_feature (489)..(489): n is a, c, g, or t
tcagatcagacacgcacgaccggtgctcgatttagtgctatagacgtttggggtttgggggctggggtctcaggaggcagcgctctcaggaccgtcaccaccatggcctgggctctgctcctcctcaccctcctcactcagggcacagggtcctgggcccagtctgccctgactcagccctccctccgcgtccgggtctccgtggacagtccagtcaccatcctcctgcacgtcgggaccagcagtgactagtttcggtacgttaataactatcgtctccgtacggtaaccaacaacataccgaggaccaaaccgccccctaaactcgtacgtactttcgnggtacggtacaggtaacgccggtccctcggtacggggtccctgacgtcgtcttcgtcgtcggcctaccgtacgtcgtacggaccaaccgtaccggtccctacccgtcgacccgttcgttcgtcggtcctaccgagacgtggaacggtntacggtacggcttagtaacgttacttacgcggtactacgtcgttactacgtttcgaccgtaggacgacggttaccgtacgttaccgttccggttcgggaccggaacgggtaccgtaaacggtcccgtaacggttacccggttccgtacggtaccgtaccggacccggtaacggtcccgtcccgtacccccgttccgg

SEQ ID NO: 119067 - DNA, 663 bp, Homo sapiens
  misc_feature: GYAE6OF01DBM1B.5.86.H09.1.454.CMB.1.raw
  modified_base (253)..(253): a, c, t, g, unknown or other
  misc_feature (253)..(253): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccgagggaagggctggactggctctacaaatattaataggtaaagcaatataacaagactacanagactcgagaacgggccgttcaccacgtcgagagacaacgtccgaggacacggtcgtacctacacatagaacagcctgacgagaccggagaccacggccgtatattacgtgtacgtaggaagggtaacgtgggggactaagtttacggaccgtggtaccggggaccgtacgggtaacccgtcgggtacctacccgtccgtcctacgaccgtacccctccgaaccgacgggcccctagtcccggtccccttcccgtcggtcccgtccccgtcggccctaccgaacggcgtaccctaccggtccgacgacgaccaccgcggcccggtccgtcgggtaccgtcggtcccgtggttaccgaacggtacccttacccggttcccgtcgtaccgtagtaccgtcgtggtaccgggg

SEQ ID NO: 119068 - DNA, 765 bp, Homo sapiens
  misc_feature: GYAE6OF01DQEMH.5.86.H09.1.454.CMB.1.raw
tcagatcagacacgcacgaccggtgctcgatttagtgctatagacttgggtttgggggctggggtctcagggaggcagcgctctcaggacgtcaccaccatggcctgggctctgcctcctcctcaccctctcactcgagggcacagggtcctcgggcccagtctcgaccctgactcacgccctcccgtccgcggttccgggtctccgtggactagtcagtccacctatcctcctagaccacggtcgggaccagtccaggtgtacgtagtttcgggtactttaataactagttgtcctccgtacggtaaccaactaacactacgacggaaccaaccgacccctaaatcgtagtactttcgtaggtacgtcaaggtaacgccgacccgtcggtaacgggtcctagtactcgtcttccgtcgtcgtcctacgtaacgtcggtacgacctaaaccgtccggtacccttcccgtacgtacccgttcgtacggtccgggtacctacgtaacggtcgtagggtacgtagtccggtacgtcgtacggtaacttacgttcgtagacgtgtacttcggttaacttcgaaccggtaccgtacgtaaccggttaccgtttacggttaacccggttccgggttaccgggggaacccggtaacggggtaaacccgtacggtacccgttaccgggtaaccccgttaccgggtaacgggttaaccctaccgggtaacccggtaaccggttcccggttaaccccggtcccccgtttacccgg

SEQ ID NO: 119069 - DNA, 719 bp, Homo sapiens
  misc_feature: GYAE6OF01AQP9E.5.86.H09.1.454.CMB.1.raw
  modified_base (315)..(315): a, c, t, g, unknown or other
  misc_feature (315)..(315): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctccgtggacagtcagtcaccatctcctgcactgggaccagcagtgactattggtcgttataactatcgtctcctagtaccaacaacatccaggaccaacgacccccaaagtcgtgtatttcgnggacgtcgagtaacgccggtcctcggacgggtcctagactccgtcttctcgtcggtacctaccgtaacggttccgtaggaccgtaaaccgacccgggtccccttccccgtacggtaccccgttccgtccggttcgggtcccttaccccgtaagggtacccgttagggaacgggtacgtacgggaacgggtccgttacgttaaccgttacgttaacgtcgacctacgggtccttaacgttagtttacgggacctaccgggtaccgttacgtacccgttaaccgttaccggttcccgggttacgggaccgggtaaacgggtacccgtaacggtccggtacggtacccgttaccggtacgggtacctaccgggacccgtacggtccctccccggtccccgttaccgg

SEQ ID NO: 119070 - DNA, 682 bp, Homo sapiens
  misc_feature: GYAE6OF01DGCS7.5.86.H09.1.454.CMB.1.raw
  modified_base (174)..(174): a, c, t, g, unknown or other
  misc_feature (174)..(174): n is a, c, g, or t
  modified_base (221)..(221): a, c, t, g, unknown or other
  misc_feature (221)..(221): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacagggtcctcgggcccaggtctcgccctgactcanccctccctcgcgtccgggtctccgtggactagtcagtcacatctccngcacgtcggaccagcagtgacagttggtacttaataactatctctcctaggtaaccaacaatactcaacggacaaaaccgacccctaaactcgtagtaactttcgagaggtacaggtaagccgccgtacgacggggtccctagacgtcgtccttacgtcgtcggaccttaccgtaagtcgtacggacaaccgtaccggcccttaccgtgacccgtcgtccgtacggcctacgacgtacgtaggaaggtagtcggacgtcgttacgtaacttacttacgtacgacgtacgtacttacttaacgttacgaccggtacgtacgtaacgttaccgtaacgtttccgtacggtttaccggggaccgggaacgggtaaaccggtacggtacggttacccggtcccggttacggttacggttaaccgaccggacccggtaaccgtccggtcccgtccccggttaccgg

SEQ ID NO: 119071 - DNA, 622 bp, Homo sapiens
  misc_feature: GYAE6OF01B988O.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtggtccgcaggctccagggaagggctggactggctctcaaaatattaatggtaaaggcaatatacaagactacacagactccgtgaaggccggttcaccacctcgagtagacaactccaggacacggtgtacctacacatgaacagcctgagacgccgaggaccacggccgtatacttattgtgtgaggggaacgtggggaccagtttgaccgtcgtagggggccagggtaaccccgtggaccgtacccggtcctccgtcgagccctacccgaccgaacgggccccaactccggtccttccccccgtaggcccgtccctggccctccgacgggacgaccgacccgtcggacgacgaccgacgtacggccgcccggtcgggacctcggccgtggacgtaacgggccttacccgttcccgtcgttccgtacgtacgtccgtgtacccggg

SEQ ID NO: 119072 - DNA, 706 bp, Homo sapiens
  misc_feature: GYAE6OF01CMJ46.5.86.H09.1.454.CMB.1.raw
  modified_base (351)..(351): a, c, t, g, unknown or other
  misc_feature (351)..(351): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctcgggcccagtctcgccctgactcacgcctccctccgcgtccgggtctccgtggacagtcacgtcaccatctcctgccacgtgggaccagcagtgactgttgggttacgttaactaactagtcgttcctccgttacgtaacccaaactaacactaccgacggaccaaaccgaccccctaaacgttcgtacgtactttccgnggtacggtacaggtaacgccggtcctcggacggggtcctagacctcgtcttcgtcgtcgtctacgtaacgtcgtacggacaccgaccggtcccttccgtacgtcccgttccgttccgtcggtccgtaccgtaggaccgttagggaaggtagcgggtacgtcttacgtaacttctacgtcgacgactctacgttgttcgacggtcggtacctacgggtaaccttacgtacccggttcggtacccggggacgggaaccggttaaccgaccggtacggttcccgggtaacccgtaccgtaaccggtccggtaaaaccggcccggtaaccggtccccggtcccggttccccgtaccggg

SEQ ID NO: 119073 - DNA, 509 bp, Homo sapiens
  misc_feature: GYAE6OF01DQG3H.5.86.H09.1.454.CMB.1.raw
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactgggacagcagtgacattggtacgttatactatgtctcctgtacaacaacatcagacaacgaccccaaactcgtgtattcgtgaggtcagtaagccggcctacgagggtccctgactcgtcttctctcgctacaagtctggcacgcgacctcccagacctctcgtggctcagactgagangaggctgactatctncagtctntattcgacngtcacgtacgtatacgtcgtcggcggacgacaagcgtcgacctccgagtccacgtaccgagtcctcgccccgtacg

SEQ ID NO: 119074 - DNA, 668 bp, Homo sapiens
  misc_feature: GYAE6OF01AZ6IQ.5.86.H09.1.454.CMB.1.raw
  modified_base (531)..(531): a, c, t, g, unknown or other
  misc_feature (531)..(531): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatctcctgcacgtggggaccaggctaggtgactagttggttacgttaataactatcgtcctccgtacggtaaccaaacaacactaccgaacggaccaaacccgaaccccccaaacgttcgtagtactttcgtaggtaacggtacgaaggtaacggcccggtcccgtacggtaccggggtccctgtacgtccgtccgttcgtcgtcggtcctacgtacgtcgacgacaacccgtaccggtccctccgtacgtaccgtcgtcggtcggtccacgtacgacgtaggaggtagtcggacgtcgtagtactagtacgtcgtcncgtctgttcgttacgcgtacgctacgtaccgttactcgtcggtacgggacggtaaccgggacctaccgcgttaccggtaccgttacccggtacgaccgtaccggtacccgaccggcccgtcccgtccccgtacccgg

SEQ ID NO: 119075 - DNA, 769 bp, Homo sapiens
  misc_feature: GYAE6OF01CECKS.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcagtccaccatctcctgcacgtggaccagcagtcgactagttggtacgttaataacttatcgtcttccgtacggtaaccaacaaacactccgaacggaaccaaaaccgacccccctaaacttccggttagtaacgttttcgaggtacggtacaacggttaacgcccgggtcccgttacggaccggggtccctaggaccgttccggtcctttcgtccgtggtaccctaccgtaacggttcgtacgggacccaaaccgtacccggtcccctacccgtacggtacccgttcgtccgttcgggcctacccgagtacgtaggaacggtgtacggtacgggtccttacggtaaccttacgttacgtaccgacgtaacgtcttacgttacgtttccggaccggtacggtcctaccggtaaccgttagttacccggttacgggtaccggggaaccggggttaaccgggtaacccggtacggtaccgttacccggtaacccggttaccggttaccggtaccgaccggtaaccccgggaccggttccccggttccccggtccccggttacccgg

SEQ ID NO: 119076 - DNA, 603 bp, Homo sapiens
  misc_feature: GYAE6OF01BEV9Q.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgactagttggtcgttataactatgtctcctggtaccaacacatccaggacaacgaccccaaactcgtagattctgaggtcagtaagcgcctcgacgggtcctgatcgcttctcgtgcctccgaagtcgtggacaacgaccggtcctccgttgacccgttccgtcgtcgggtcctaccgacgtacgtagaggatcggacggtcgtagtacttaagttacgtgacacgtcttactacgtttcgacgtacggccgacgtccgttacgtccgttccgtacggggtacggaacgggtacccgaaggtccgtcggacccgttaccgtaaggcccgtacggaccccaagggtccctccggtcccccgttaccgg

SEQ ID NO: 119077 - DNA, 699 bp, Homo sapiens
  misc_feature: GYAE6OF01D0320.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtccacatctcctgcacgtgggaccagcagtgactagttggtacgttaataactatcgtctccgtacggtaaccaaactaacactaccgacgaccaaaccgaccccctaactcgtagtactttcgtaggaggtacagtaacgccggcccgtcggtaccgggtcctgacgtcgtcttcgtcgtcgcctacgtaagtcgtagaccaacgccggtcccgtcctacggtacccgttcgtacggtccggtacctccgaacgtacgtaggaacggtagtacgggacggtacgtacgtacgttaactttacgacgtactacggtccttaacgttacgtttacggacgtacggtacgaaccggttaccgtttaacttccggttacccgggttcggggaaccgggtaacgggaaccgtacggtaccggttaccggtacccggttaccggtacggtaccgacccggaaccgtaccggtcccgtcccgtccccggttacccgg

SEQ ID NO: 119078 - DNA, 736 bp, Homo sapiens
  misc_feature: GYAE6OF01CNR52.5.86.H09.1.454.CMB.1.raw
  modified_base (210)..(210): a, c, t, g, unknown or other
  misc_feature (210)..(210): n is a, c, g, or t
  modified_base (221)..(221): a, c, t, g, unknown or other
  misc_feature (221)..(221): n is a, c, g, or t
tcagatcagacacgcacgaccggtgctcgatttagtgctatagacttggggtttgggggctggggtctcaggaggcagcgctctcaggacgtcaccaccatggcctgggctctgctcctcctcaccctctcactcgagggcacgagggtcctcgggcccagtctcgccctgactcacgccctccctccgcggtccgggtctccgtggacngtcagtcaccntctcctgccacgtcgggaccagcagtgactagtttcggtacgtttaataacttatcgtccttccgtacggtaacccaaacaacactaccgaggaacctaaaccgaccccctaaacgttcgtacgttacgttttcgaggtacggtacaacggtaacggcccggtcccgttacggaccgggggtccctaggtacgtccgtcgttccgttcgtcggtcctacgtacgtccgtacggacctaaccgtaccggtccctccgtccgtaccgtccgtacgtcggtcctaccgtacgtacggtacggtaggtacgtggacggtacgttagtaaccgtttacgttaacgtcgtacgtaacgtcgttacgttaacgttcgccggtaggtactaccggttacgttaccgttaccggttaccgggttccgggaaccgggtaccgggaactaccggtccgtaccggtcccgtacgtacccggtacgacccgtaccggtaccggcccgtccccggtcccgttacccggg

SEQ ID NO: 119079 - DNA, 577 bp, Homo sapiens
  misc_feature: GYAE6OF01AVMBG.5.86.H09.1.454.CMB.1.raw
  modified_base (179)..(179): a, c, t, g, unknown or other
  misc_feature (179)..(179): n is a, c, g, or t
  modified_base (261)..(261): a, c, t, g, unknown or other
  misc_feature (261)..(261): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
  modified_base (457)..(457): a, c, t, g, unknown or other
  misc_feature (457)..(457): n is a, c, g, or t
tcagatcagacacgcacgaccggtgctcgatttagtgctatagacttgggtttgggggcgtggggtctcaggaggcagcgctctcaggacgtcaccaccatggcctgggctctgctcctcctcaccctctcactcaggcacaggtcctgggcccagtctggccctgactcagcctcccnccgcggtccggtctccgtggacagtcagtcaccatcctctgcacgtgggaccagcagtcgactagttggtacgttataactntgtctctgtacacantcagnaacgccccaagtctgtcttagngacgtcaagtagcgcctcgacgggtccngactcgtctctcgtggcctacgagtctcggactaacaccggccctaccgtcgacccgttcttcgacgggtcctacccgtagaccgtgaggagtcggaagtcgtagctttactcgcgacgcgttacncgttaattcggacgcggactaggcttacgtaccgtccgttcgggcgaaccgggacctagccggtaactcccggtaccttaagggcccgtagaccccgaggcccgtacggcccccgtccgg

SEQ ID NO: 119080 - DNA, 726 bp, Homo sapiens
  misc_feature: GYAE6OF01C97TK.5.86.H09.1.454.CMB.1.raw
tcagatcagacacgcacgaccggtgctcgatttagtgctatagacttggggtttgggggctggggtctcaggaggcagcgctctcaggacgtcaccaccatggcctgggctctgctcctcctcaccctctcactcgagggcacgagggtcctcgggccctagtctcgccctgactcacgccctcccgtccgcgtccgggtctccgtggacagtcacgtccacctatcctccgtgcctacgtcgggaacctagcgagtcgactagtttcggttacttaataactagtcgtcctaccgtacgtaaccaaactaacacgtaccgaacggaaccaaacccgaccccctaagtcgtagttacgttcgtaggtacgtactaaggtacggcccggtaccgtcggtaccggggtcctaggtaccttccgtaccttcgttcgtcggtacctaccgtacgtcgtacggaccgaccgtaccgtcccttaccgtcggtacccgtcgtcggtcggtaccgtacgacgtcgtacggaggtacgtacggacgtacgtacgttaacgttacttccgacgtacgtcgttaccttcgttaggttccgacggtacggaccgtacgttccgttacgttaccgtccgggttacggaccgggtaacgaaccgtacgtccggtaccgtcccggttacgtacggacccgtacggtacccggaccggttcccgtcccggtccccggtacgg

SEQ ID NO: 119081 - DNA, 605 bp, Homo sapiens
  misc_feature: GYAE6OF01BS4CO.5.86.H09.1.454.CMB.1.raw
  modified_base (478)..(478): a, c, t, g, unknown or other
  misc_feature (478)..(478): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacagtcagtcaccatctctgcactcgggaccagcagtgactagttgtcgttaataactatcgtctcgtggtaccaacaacactccgaggacaaaccgacccccaaactcgtgtattctaggacgtcagtaagccggcctcgacgggtcctgctcgtcttctcgtgcctacgacgtcgtcgacaaccgacgtccctcccgtcgtaccgttcgtccgtcgggtcctaccgacgtacgtaggacggagtggacgtcgtacgtacttatacgtgcgactcgtntagttcgcgtacgctacgaccgtactaccgttcgtccgggaccggtacgggacgtacgtccgttaccggacccgttccggtacgaccctacggaccccgacggtcccgtcccgtccccgttaccggg

SEQ ID NO: 119082 - DNA, 624 bp, Homo sapiens
  misc_feature: GYAE6OF01BPO91.5.86.H09.1.454.CMB.1.raw
  modified_base (333)..(333): a, c, t, g, unknown or other
  misc_feature (333)..(333): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgactagttggtacgttataactattgttcctcctaggtaacccaacaaccatccaaggacctaaaacgcccccctaaaactcgtagtacttttcgnggaggttacaaggtaacgccgggccctacgacggggtccctgactccgtcttctcgtggcctaccaacgtcgtcggactaaccgacggtccctcccgtacgacccgtctcgtcggcctccgagactgagacgtagaggcctagtactacttactgcagtctactattgacgtagccgtagccgtataccgtcgttcgggacggaacggaccgacgtaccgtacgtacccggttccgtaacggttaccgaccgtaccccgaacggtcccgtacccggtcccccgttcccggg

SEQ ID NO: 119083 - DNA, 793 bp, Homo sapiens
  misc_feature: GYAE6OF01DFNM2.5.86.H09.1.454.CMB.1.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (246)..(246): a, c, t, g, unknown or other
  misc_feature (246)..(246): n is a, c, g, or t
tcagatcagacacgcacgaccggtgctcgatttagtgctatagacttgggtttgggggctggggtctcagggaggcagcgctctcaggacgtcaccaccatggcctgggctctgctcctcctcaccctctcactcagggcacgacgggtcctgggcccagtctcgccctgactcacgtccctcccgtccgcgtccggtctccgtggactagtcngtcaacctntcctcctcgcgacgtcgggaccnggcaggtcactagtttcggtacgttaataactatcgtcttaccgtacgtaaccaaactaactactaccagggtaaccaaaacccgaccccctaaaacgtccggtagttatttccgtacggtacgttcgtaaacggtaacggtcccggtacccgttacgggtaaccggggttccctaacgggtcttcccgttccgtttccgtccggtcggtacccttaccggtaacggttcggtcggaaacctaacccggtacccggtcccccgttacccggtacggtaaccccgtttcgtccgggtaccgggtaccctaccgtaacggtcccgtaagggaaaggtacggtggtaacgtcgttaacgaaccgtttagtaccgtcgtacgtaccgttcgtaagttacttcggacggtacggtactccgttaccgtacgttaccggttacggtacggaccgggaccgtaaccggtacgtacccggttaccgtaccgtttccgggaccgttaacggtccgaacccgttacggaacgggtcccgtaccccggttacccccgg

SEQ ID NO: 119084 - DNA, 752 bp, Homo sapiens
  misc_feature: GYAE6OF01DEU6J.5.86.H09.1.454.CMB.1.raw
  modified_base (244)..(244): a, c, t, g, unknown or other
  misc_feature (244)..(244): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcgagggcacgagggtcctgggcccagtctcgccctgactcacgccctccctccgcggtccgggtctccgtggacagtcagtccacctatcctcctgcctacgtcgggaccngcagtgactagttggtacttaataactatcgtccttccgtacgtaaccaacaactactaccgacggaaccaaaacccgaccccctaaacgttcggttacgttacttttccgtaggtaacggttacgaaggtaacggcccggtacccgttacggtaaccggggttccctaggtacgttccggttacctttcgtccgtcggtacccttaacgtaacggttccgtacggaacctaccggtaccggtcccttacccgtacggtacccgttcgtccggtcgggtacctacccgaggtaccgtagggaacggtagtcggaacgtcgttaacggtaccttacgtttacgtcgtacgtacgttccttaacgttacggtttcgacggtaaccggtcgttacgttaaccgttacgtttaccggtaccggttacggggaccgggtaacggaccgtaagtccgtacgtccgtacgtcggaccgaccgtacccggaggtccctacccggtcccgttaccgg

SEQ ID NO: 119085 - DNA, 706 bp, Homo sapiens
  misc_feature: GYAE6OF01CKW4R.5.86.H09.1.454.CMB.1.raw
tcagatcagacacgcacgaccggtgctcgatttagtgctatagacgttggggtttgggggctggggtctcaggaggcagcgctctcaggacgtcaccaccagtggcctgggctctgctcctcctcaccctctcactcgagggcacgaggtcctgggcccagtctcgccctagacctcacgccctccctccggcgttccgggtctccgtggactagtcagtcacctatcctccgtgcctacgtcggaaccagtcagtcgactagttggtacttataactagtcgtcctacttacgaaccaaacacactacgaacgaccgaaaccgtacccctaaacgtcgtactaacgttttcgaggtacgttacgaaggttaaccgcccggtacctacggtaccgggttccctggtaccttcggtacttcgttcggtcgtcctaacgtagtccggtacgacctaaccgtccggtcccgttcgtacggtcccgtacgttcggtcggacctacgacgtacgtaggagtacgtacggacgtacttacgtacgttaacgttcgacgacgtcgttcgttaacgttacgttcggacgttacgaccgtaacggtcccgttacttccggttccgggttacgggacgggaccgtaaccgcgtaacgtcggtacccgttacgacggtaccgacggaccttaccggcgtacccggtccccggttacg

SEQ ID NO: 119086 - DNA, 687 bp, Homo sapiens
  misc_feature: GYAE6OF01EIAKO.5.86.H09.1.454.CMB.1.raw
tcagatcagacacgcacgaccggtgctcgatttagtgctatagacttggggtttggggggctgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcacgtgggaccagcagtgactattggtcgttataactatgtctctgtaccaacacatcagacaacgaccccaactcgtgtatttctggagtcagtaacgcgcctcgacgggtcctgactcgtcttctcgtcgcctaccaagttcgtcggaccaaccgtaccgcccttcccgtcgtacccgttccgtccggtcgggtcctaccgacgtacgtaggaacggtagtcggtacgggcttacgtaaccgtttacttaccgtacggtacctacgtaccttacgttacgtttacgacgtacgggtactacgggtacccgttaacgttaccgttccgggttaccggggtaccggggtaacggggaaccccgtaacggtcccggttaacgggtacccccggttaccggttaccggtacccgtaaccggtaccccggaacgggtccccgttccccggtaccccccggttacccgg

SEQ ID NO: 119087 - DNA, 662 bp, Homo sapiens
  misc_feature: GYAE6OF01B2SHJ.5.86.H09.1.454.CMB.1.raw
  modified_base (308)..(308): a, c, t, g, unknown or other
  misc_feature (308)..(308): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtccaccatctcctgcactgggaccagcagtgactagttggtcgttataactatgtctcctggtaccaacaacatccaggcaaacgccccaaatcgtgatttcngagtcagtaagcgccctgacgggtcctgactcgcttctctcgctcaagtctcggaccaacgacggtccttcccgtgacccgttctcgtcgggccttccgagtaccgtggaacggtagtcggacggtacgtgtaacttacgtttacttcggacctaacggtcccttcgtaacttttcgggacgtacggggtactacggtacccggtttacttaaccgttcccggtttaccggggcgggttaaacccgggtaaccgtaaccggtacgtacccgggttaaccccggtaccgttaacgggaacccgtacggacccccggtaaagggtcccctacccgggtcccccccggtttaccggg

SEQ ID NO: 119088 - DNA, 750 bp, Homo sapiens
  misc_feature: GYAE6OF01B3IVT.5.86.H09.1.454.CMB.1.raw
  modified_base (158)..(158): a, c, t, g, unknown or other
  misc_feature (158)..(158): n is a, c, g, or t
  modified_base (182)..(182): a, c, t, g, unknown or other
  misc_feature (182)..(182): n is a, c, g, or t
  modified_base (338)..(338): a, c, t, g, unknown or other
  misc_feature (338)..(338): n is a, c, g, or t
tcagatcagacacgcacgaccggtgctcgatttagtgctatagacttgggtttgggggtgctcgatttagtgctatagacttgggttgggatctacgttgcaggtgtaggtctgggtccctgagactctcctgtgcagcctctggattcaccttttangtattttggcatgacgtgggtccnccaggctccgaggggaagggctggactggctctacaaatattaagtaggtaaagcaaatataacaagtactacgacagactcgtaggaacggccgtcaccaccgtagagacgacacgtccgacggacacggtcgtaacctacgacagtacgaaacncggacctaggacggacggaccggaaggtaccgaaccgggtaccgtaattacgtttagttaggtacgggtagggaaacggggtaaacggtcgggggtaactaaggtttacggacccggtacggtacgggggacccgacgggtaacccgtcgggtaccgacccgttctcccgtacgaccgtcccctaccgaacccggaacggtcccacgtcccggtaccctccccggcggtccccgccgtcgacccgtaccgacggaccgacccgtaccgtaccgaggtaccgaccgaccgaccgggtcccggtcccgttacgggccgtaccggtcccggtacggtaccggtaaccgggttacccttaaccccggttcccggttcttaccgggttacgtacggttccgggtcggtaacccgggg

SEQ ID NO: 119089 - DNA, 614 bp, Homo sapiens
  misc_feature: GYAE6OF01CDBB0.5.86.H09.1.454.CMB.1.raw
  modified_base (182)..(182): a, c, t, g, unknown or other
  misc_feature (182)..(182): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccnccaggctccgagggaaggggctggactggctctcaaaatattaaatggtaaaaggcaatataacaagactacacagactccgtagaagggccggttcaccacctcgagagacaactccaggacacggtgtacctacacatgaacagcctgagagccgaggacacggccgtatattattgtgtggaagggaacgtggggactaattgacgcgtagggccgagggaccctggtacgaccgtctcctcacgccctaccgaccaacggccctactccggttaccttcccccgtcggcccgtacccgtcgcctccgacggacgccaccgtcccgagtacgccgaactcggccggacccgtcgggccgtcggcccgtaggtacgaaccgggtaccttacccgttcccggttgtccgttagtccgtcgtgggtaccggg

SEQ ID NO: 119090 - DNA, 739 bp, Homo sapiens
  misc_feature: GYAE6OF01BBWEV.5.86.H09.1.454.CMB.1.raw
tcagatcagacacgcacgaccggtgctcgatttagtgctatagacttggggtttgggggctggggtctcaggaggcagcgctctcaggacgtcaccaccatggcctgggctctgctcctcctcaccctctcactcagggcacgagggtcctgggcccagtctcgccctgactcacgccctccctccggcgtccgggtctccgtggacagtcacgtccacctatcctcctgcacgtcgggaccagcagtcgactagttcggtacgttataactattcgtcctccgtacggtaaccaacaacactaccgaacggaccaaaaccgaccccctaaacgtcgtagtactttcgtagacggtacaacgtacgccgtacctacggacggggtcctgtactcgtcttcgtcgtcggtcctacgaagtccgtacgtaccaacgtaccggtccctcccgtagtacccgttctacggtccggacctaccggagtacgtaggacggtacgtacggacggtacgttacgtaactttacgttaccgtcggtaccgtacgttacttaccgttaagtttcggaccgtacgggtaccgtaaccggttccgtaacttaccggttaccgggttaccggggtaaccgggtaaaccgggaaccgtaacgttcccggtaaccggttacccggtaaccggttacgggtaccgaaccggtacccggaacggttcccgtaccccgggtccccgtttaacccggg

SEQ ID NO: 119091 - DNA, 727 bp, Homo sapiens
  misc_feature: GYAE6OF01DHP3M.5.86.H09.1.454.CMB.1.raw
tcagatcagacacgcacgaccggtgctcgatttagtgctatagacttggggtttggggggctggggtctcaggaggcagcgctctcaggacgtcaccaccatggcctgggctctgctcctcctcaccctcctcactcgagggcacagggtcctgggcccagtctgccctgactcacgccctcctccgcgtccgggtctcctggacagtcagtccaccatcctcctgacctacgtcgggaccagctaggtcgactagtttggtacgtttaataactatcgtccttcgtcggtaaccaacaactactacgacggaccaaaccgaccccctaaagtcgtagtactttcgtaggtacggtacgaagtaacgcctaaccgtcccgtaccggtacgggtcccgtagtacgtccgttcttaccgtcgtcggtcctaccgtacgtcgtcggaaccaaccggtaccgtccccttacccggtacggtacccgttccgtcggtccgggtcctaccgtacgtacgtaggaggtacgtagggcgtacgtagtacttacgttacgcgtacgtacgtctacgttacgttcgacgtacggtacgacggttaccgttacttaccggttcggtccggggtaccgggaacgggtaacccgtaacggtcggttaacccggacccggttaccggtaccggtaccggtaacccggtacccggtaaccggtccgtaccccggtcccccgg

SEQ ID NO: 119092 - DNA, 735 bp, Homo sapiens
  misc_feature: GYAE6OF01AYEU9.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagctctcctgtgcagcctctggattctaccttttactgtattttggcatgacgtgggtccgccaggctccgaggggaaggggctggactggctctacaaatattaagtagggtaaacggcaatataacaagactaacgacagactccggtaggaacgggccggtcaccacctcgagagacaactcgagggactacggtctaccgtacactagtacgaacgagccgtagagagaccggaacggaacgaccggctaattattagttggtggtagggacggggtaacggtggggactagttcgacgcggtcgggacgacgggacccgtgtccgtaccggtctccgacgacgtccccgtaccgaaccgaaccgggacccctacgtcccggttcccgttcccccgaggccccgtccccgtcgacccgtcccggaacggaccgaccccgtacccgttaccggaacgtaccgacccgaaccggaccggtcccgggtaccccgggacgggttcccgtaccggtcccggttacggtacccgggaaaccggtttccccgtaaccccgggtttttcccggtcgttaccgtaccgggtacgtttcccgggtcggggtaccgggg

SEQ ID NO: 119093 - DNA, 640 bp, Homo sapiens
  misc_feature: GYAE6OF01BS990.5.86.H09.1.454.CMB.1.raw
  modified_base (324)..(324): a, c, t, g, unknown or other
  misc_feature (324)..(324): n is a, c, g, or t
tcagatcagacacgcacgaccggtgctcgatttagtgctatagacttggggtttgggggctggggtctcaggaggcagcgctctcaggacgtcaccaccatggcctgggctctgctcctcctcaccctctcactcagggcacagggtcctgggcccagtctgccctgactcagccctccctccgcgtccgggtctccgtggacagtcagtcaccatctctcgcacgtgggaccagcagtgactagttggtacgttataactatcgtcctccgtagtaaccaacaacataccgagaccaaacgaccccaaagtcgtatacttcgnggtacgtcacggtacgccgccgtgacgggtcctgatcgtcttctcgtggcctacgacgtctcggacaaacgccgtccctccgtacgaccgttcgtcggtcggcctacgagtaccgtggaacgtacgtggtacggtcgttacgtacgttagttacgtcgaactcgtactacgttagttcgacgtaacggtccgtaacggtccgttaactacgttccgggtacgggtacggaacgggtacctaacggtccgtacggtacccggtacgttacggaccgtacggtacccgaacggtcccgtacccggtccccgtacccgg

SEQ ID NO: 119094 - DNA, 691 bp, Homo sapiens
  misc_feature: GYAE6OF01DAUL6.5.86.H09.1.454.CMB.1.raw
  modified_base (148)..(148): a, c, t, g, unknown or other
  misc_feature (148)..(148): n is a, c, g, or t
  modified_base (155)..(155): a, c, t, g, unknown or other
  misc_feature (155)..(155): n is a, c, g, or t
  modified_base (163)..(163): a, c, t, g, unknown or other
  misc_feature (163)..(163): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
tcagatcagacacgcacgaccggtgctcgatttagtgctatagacgttggggtttgggggctggggtctcagggaggcagcgctctcagggactcaccaccatggcctgggctctgctcctacctcaccctctcacgtcgaggcacgngggtccncgggcccngtcctcgcctgactcacgccctcctcggcgttccgggtctccgnggacncgtcacgtccaactncctccgtgaccgtacggcggaccagtcgtagtgaaccgttagtttcggtaacgtttaaactaactacgttcgtactaccgtacgtaaaccaacaactacacgacgaccaaaccacctaaattcgtattactcgaggctaagtacgtaacgccgtaccgtacggtaccggtctgactcgttctcgtcgtacggtcctaacgtacgtacgtacgaacgtaaccgccggtcctaccgtacgttaccgtcggtaacgtccgggacctacggtaaacgtcggtacgggtaagtaggtacggtacgtacgttacgttaacgttacgtacgtacggtactacgtacgtaacgttcgtacggaacgtcgtacggttacttacgtaacgttccgtaacggtacgggacggtaacgaccgaagtacgtaccggtacgacgtacgacgccgaaacggtcacgtcccggtctaccg

SEQ ID NO: 119095 - DNA, 701 bp, Homo sapiens
  misc_feature: GYAE6OF01B5M55.5.86.H09.1.454.CMB.1.raw
  modified_base (275)..(275): a, c, t, g, unknown or other
  misc_feature (275)..(275): n is a, c, g, or t
tcagatcagacacgcacgaccggtgctcgatttagtgctatagacttggggtttgggggctggggtctcaggaggcagcgctctcaggacgtcaccaccatggcctgggctctgctcctcctcaccctctcactcgagggcacgagggtcctgggcccagtctgccctgactcacgccctccctccgcggtccgggtctccgtaggactagtcacgtccaccatcctcctgccacgtcgggaccagcagtcgaactgttggtacgttaataactntcgtcctctacggtaaccaacaacactaccaggacaaccgaccccaaatcgtatactttcgagtagtacagtacgccggcctcggacgggtcctgactcgtctctcgcgtactcgaagtcgacgtacaccgaccggtccctaccgtcgtaccgtctcggtcggtacctcgacgtacgtcggaacggtacgtaggaacggtcgttacgtaacttacgttacgtacgactacgtctacgttacgttcggaccgtacgtacgtacggttaccgtacgttacccgttacgggttaccggggacgggtaaaccgggtaccgtacgggtaaccggtttccggtaaaccccggttaccgggtaacccggttaccggaaccccggttacccgggacccgggttacccgttcccccggggtccccgttacccggg

SEQ ID NO: 119096 - DNA, 690 bp, Homo sapiens
  misc_feature: GYAE6OF01DQ9WK.5.86.H09.1.454.CMB.1.raw
  modified_base (249)..(249): a, c, t, g, unknown or other
  misc_feature (249)..(249): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtctgccctgactcagccctccctccgcgtccgggtctccgtggacagtcagtccacctatctcctgccacgtcggggaccaggcaggttnactagttggtacgtttaataactatgtctcgtcgtaaccaacaacactacacggaccaaaccgacccccaaacgtcgtatacttcgtaggacggttacgaacgtaacggccgggtacccgtccggaccggggttccctaggtacgttcgttacctttcgttcgtcggtcctaccgtaacgtccgtaccggaccaacccgtacccggtcccttcccgtacgtacccgttcgtccggtcgggtcctccgagtaacctggaacggtacgtggacggtcttacgtaaccttgttaccgtgtacacgtccttcgttattcggacgcggacgtacgtacgtacttaccgttcggtacgggtcgggacgtaccggacgtaccgtacggtaccccgtcggttacgtaccgaccgacccgacgggtccctcccgggtcccccgttacggg

SEQ ID NO: 119097 - DNA, 663 bp, Homo sapiens
  misc_feature: GYAE6OF01EVDE2.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcaccttttactgtattttggcatgacgtgggtccgccaggctccgagggaagtggctggactggctctcaaatattaatggtaaagcaaatatacaagactacacagactccgtgaaggccggttcaccacctcgagagacaactccgagggacacggtcgtacctacacatagaacagcctgagacgccgaggacgacggccgtatattagttgtgtggaggggaaacgtgggggactaagtttcggaccgtcggtaggggcccgaacggggtaacccgttggtacccgtacccggttccgtcccgtacgacggtccctacccgaacccgaaccgggcccctaacgtcccggttacccgtttcccccgtcgggcccgtccccgtcgcccgttacccgacgggacgccgacccgtcggacgacgaccgaccgacggcccggtcccgtacgggccgtccggccgtcgggtccaacggtccttaccgttcccgtagtacctcggtactcgtacggg

SEQ ID NO: 119098 - DNA, 720 bp, Homo sapiens
  misc_feature: GYAE6OF01BINZ5.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcacgtggaccagcagtgacattggtcgttataactatgtctcctgtaccaacacatcaggcaaacgcccccaaatcgtgtatttctgtacggtcagtaacgccggccctcgacggggtccctgactcgcttctcgtcggcctaccgaagttcgtacggaccaaccgtaccggtcccctcccgtcggtacccgtcgtaccgtcgggtacctacccgagtaacccgtggaacggagttggacggtcttacggtaacctttagtttaaccgtcgtacgtaccgtcttaccgtaacgttttcggccgtaacggtaccgtaacggtacccgtttaacgttacccgttcccgggtttaccggggaccggggtaaacggggtaacccgtaaacggtacccggttaaccgggtaccccggttaacccggttaacgggtaaccccgtaaccgggtacccccgtaaacggggtccccttccccggggtccccccccgttaaccccgggg

SEQ ID NO: 119099 - DNA, 759 bp, Homo sapiens
  misc_feature: GYAE6OF01ALS5U.5.86.H09.1.454.CMB.1.raw
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
  modified_base (587)..(587): a, c, t, g, unknown or other
  misc_feature (587)..(587): n is a, c, g, or t
tcagatcagacacgcacgaccggtgctcgatttagtgctatagacttggggtttggggggctgggggtctcaggaggcagcgctctcaggacgtcaccaccatggcctggggctctgctcctcctcaccctctcactcgagggcacgagggtcctgggaccctagtctcgcctgactcacgcctccgtcgcggtccgggtctccgtggactagtcagtaccacctctcctcgtnaccgtacggtcgggaaccncgtcgtaagtcgtacgttaggtttacggttacgtttaaactaactattcgttcctaccgttaacggaacctaaacgtaactacgtccgaacggaacccgaaacccgtacccctaaacggtcgtaagtactttcggaggtacggtacgaacggtaccgcccggtaccggtacggtaccggtcgtaggtctccgtacttcgttacgcccggtactacccggtacgtgtaccggaactcgaccggtccctaccgtacgtaccgtccgtcggtaccggtacctacggtacgtacggtaggacgggtaacgtcgggtacgtaacgtacgtaacggtttntaacgtcgtaacgtcgtacgttacgttgttacggacgtacggtaccgtacgttaccgtacgttacgtccgggtaacgggacggtaacgggaccggtaccgttacgtccggtaccgttaccggtacgggaccgtaccgtaaccggtccgtcccggtcccgtaccgtacccggg

SEQ ID NO: 119100 - DNA, 775 bp, Homo sapiens
  misc_feature: GYAE6OF01DM4GG.5.86.H09.1.454.CMB.1.raw
  modified_base (246)..(246): a, c, t, g, unknown or other
  misc_feature (246)..(246): n is a, c, g, or t
tcagatcagacacgcacgaccggtgctcgatttagtgctatagacttggggtttgggggctggggtctcaggaggcagcgctctcaggacgtcaccaccatggcctgggctctgctcctcctcaccctctcactcgagggcacgagggtcctgggcccagtctgccctgactcagccctccctccgcgtccgggtctccgtggacagtcagtcaccatctcctgcacgtgggaccagcagtgactnttcggtacgtttaataacgtatcgtcctctaggtaaccaaacaacataccacggaccaaacgcccccaaatcggtagtactttcgtagaggtcaagtaacgccgcctacgacggggtccctgactcgtcttctcgtcggtctacgtaagtcgtacggaccaaaccgtccggtccctacccgtcgtacccgtcgttaccgtcgggccttaccgaacgtaccgttgggaaggtagtacgggtacgcgttaggtaactttacgttacgtacgtacgtacgtcgttacttacgtttacggaccgtaacggacgttacggtaccctttaacggttaccgtttacccgggttaccgggggtaaaccggggtaaccggggtaaacccgtaaaccgggttaccccgggtaaccgggttaaccccccggttttaacccggggttaaaccgggtaaccccggttaacccggggaaccccccgggtaaaaggggtttccccccggtcccccgggttacccccccgggttttaaccccggg

SEQ ID NO: 119101 - DNA, 714 bp, Homo sapiens
  misc_feature: GYAE6OF01CH8EX.5.86.H09.1.454.CMB.1.raw
  modified_base (240)..(240): a, c, t, g, unknown or other
  misc_feature (240)..(240): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacgagggtcctgggcccagtctcgccctgactcacgtccctccctccgcgtccgggtctccgtggacagtcagtccacctattcctctgcacgtcgggaccngcagtcgactgttggtacttaataacgtatcgtcttccgtaggtaacccaaacgaactactaccgacggaccaaaccgtacccccaaacgttcgtacgtacgtttcgaggacggttacacggtaaccggtcccggtacccgtaccggtacggggttccccgtaggtacgttaccggttcctttaccgttcggtcgggtacccttaaccggtaaacggttccgttacgggaccaaaccggacccggtccccttaccccgtacggtacccgttcgtaccggtcgggtccctacgacggacgttggaacggtacgtcggtacgcgttacgtacttaattaccgtcgactagtcttacttaacgttgacgtaggacctacgtccgtacgttcgtccggtacgggccggaacggtacgcgtacgacggtacccgtacggtcgaccgaccgtaccgaggtcccgtccggccccgttacgg

SEQ ID NO: 119102 - DNA, 882 bp, Homo sapiens
  misc_feature: GYAE6OF01C6DKO.5.86.H09.1.454.CMB.1.raw
  modified_base (213)..(213): a, c, t, g, unknown or other
  misc_feature (213)..(213): n is a, c, g, or t
  modified_base (253)..(253): a, c, t, g, unknown or other
  misc_feature (253)..(253): n is a, c, g, or t
tcagatcagacacgcacgaccggtgctcgatttagtgctatagacttggggtttgggggctgggggtctcagggaggcagcgctctcaggacgtcaccaccatggcctgggctctgctcctcctcaccctcctcactcgagggcacgagggtcctcggggcccagtctcgccctgactcacgccctccctccgcgtccgggtctccgtggacngtcagtccaccatcctcctgccagtcgggaccagctaggngactagtttcggtacttaataacttattcggtccttcccgtacggtaaccaaacaactactaccaacggaccaaacccgaccccctaaaacttccggtagtacttttcgtaggacggttcgaacggttaaaccggcccggtaccccgtaccgggtaccgggggttcccctaggtaccgttccggttccgtttccgttaccggttcggtacccgtttaccgtaacgttccggttacgggaccgtaaaccgtaaccccggtcccctttccccggtaccgggtttaccccggtccggtttaccggtccggggtaccccgttaccccgaaacgggtacccggttaagggtaacgggtaacgggtaccgggtaacgggtacccggttacggttaaaccctttaacgtttaccggttacgtaccgggtaccttccgtttacttacggtttaccggaccgggtaacggtccgtaccggttaaccggttaccttacgggttcccgggttaccgggggaccgggtaagggtacccgtaaacggtcccgggttaaccgggtcccgttaacccggttcgggtaaccgcccgggtaacccgtaacgggtcccccggttcccggtacccccgttaccccggg

SEQ ID NO: 119103 - DNA, 603 bp, Homo sapiens
  misc_feature: GYAE6OF01BFMTS.5.86.H09.1.454.CMB.1.raw
  modified_base (497)..(497): a, c, t, g, unknown or other
  misc_feature (497)..(497): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagccctccctccgcgtccgggtctcctggacagtcagtcaccatctcctgcacgtgggaccagcagtgactattggtacgttaataactatcgtctccgtaggtaccaacaacatccgaggaccaaacgacccccaaactcgtgtactttcgtaggtaggtacagtaacgccggccctcgacgggtccctgactcgtcttctctcggactccaacgtcgtacggacctaacgccggtccctcccgtcgtacccgtctcgtcgggcctacgacgacgtggacggtgtaggacggtctagtaacttattacgtgcagtctacgtagttnacgtaggcagtccgtataccgtcgtcgggacgggacggaccgacggtactcggtaccgttccgtacgaccgtacggacccgaaggtcccgtcccgccccgttacgg

SEQ ID NO: 119104 - DNA, 682 bp, Homo sapiens
  misc_feature: GYAE6OF01B4E6F.5.86.H09.1.454.CMB.1.raw
  modified_base (166)..(166): a, c, t, g, unknown or other
  misc_feature (166)..(166): n is a, c, g, or t
  modified_base (208)..(208): a, c, t, g, unknown or other
  misc_feature (208)..(208): n is a, c, g, or t
  modified_base (518)..(518): a, c, t, g, unknown or other
  misc_feature (518)..(518): n is a, c, g, or t
  modified_base (569)..(569): a, c, t, g, unknown or other
  misc_feature (569)..(569): n is a, c, g, or t
  modified_base (620)..(620): a, c, t, g, unknown or other
  misc_feature (620)..(620): n is a, c, g, or t
tcagatcagacacgcacgaccggtgctcgatttagtgctatagacgtttggggtttgggggctggggtctcaggaggcagcgctctcaggacgtcaccaccatggcctgggctctgctcctcctcaccctcctcactcgagggcacgagggtcctgggcccagtcncgccctgactcacgcctcccgcgtcgtccggtctccgtgacngtcacgtccacctatcctcctagctacgtcgggaccagccagtgaactgttaggtacgttaataactagttgtcctcgtacgtaacctaacaactacgtacgacggtaacaaacccgaccccctaaacgttcgttagttaactttcgtggtaacggtacacggtaacgccggtcccgttaccggacgggtccctagacgttccgtaccttcgtaccgtcggttaccctacgtacgtcgtcggaaactaccgaccgtccctaccgtacggtcctacgttcgcgggtcctacgtaccgagtcggaagtacgnggttaccgtcacggttaaacttgtaacgcgacaacgttctacgtaggttcncgacgtacgtcgtaactacgtcgtttccggagggtaccgaccgagtaccgntcccggtacgtcccgtaggaccgtaccgacggttacccgccttccccgggccgtttaccccg

SEQ ID NO: 119105 - DNA, 715 bp, Homo sapiens
  misc_feature: GYAE6OF01EQZUJ.5.86.H09.1.454.CMB.1.raw
  modified_base (480)..(480): a, c, t, g, unknown or other
  misc_feature (480)..(480): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
  modified_base (586)..(586): a, c, t, g, unknown or other
  misc_feature (586)..(586): n is a, c, g, or t
tcagatcagacacgcacgaccggtgctcgatttagtgctatagacttgggtttggggctggggtctcaggaggcagcgctctcagggacgtcaccaccatggcctgggctctgctcctcctcaccctcctcactcagggcacagggtcctggcccagtctgccctgactcagcctccctccgcgtccggtctcctggacagtcagtcacatctctgcactggaccagcagtgactagtttcgggtacgtttaataaccttattcgttcctccgttaggttaacccaaacgaaacacttacccgaagggacctaaaacggtccccccaaaacgttcggtacgtactttacgtgaacggttccaacggttaacgccggtaccctaggaccggggttccctacggtaactccgtccgttctccgtggtcctccgaaagttccgtaggacctaaaccgcggtacccctcccgtcggacccgttntaccgttaccgggtcctaccccgagtacccgtaggacggtatacgggaggcttcggaacttaacgttntcgganacggtactccgtatttcggctaggtcgtaacnccggttaatccgtggttccgggacgggtaacggtaaccgaacggttcgacccggttaaccggtcccgttaaacgggcccttaacccggaccggtaaaccggtccccgttccggtccccccgtaaccggg

SEQ ID NO: 119106 - DNA, 878 bp, Homo sapiens
  misc_feature: GYAE6OF01A913S.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcagtcaccatctcctgcacgtgggaccagcagtgactagttggtacgttataactatgtcctcctacggtaacccaacaacatccgaaggaccaaaccgacccccctaaacgtccggtagtacttttcgtggtaacggtacaaggttaacggcccggtaccccgtacggaacgggggttccctaggtacgtccgtccgtttccgttcgtcggtcctacccgtaacggttccgtacgggaccctaaacccggacccggtccccgttacccccgttacggtaccccggtttccgttacccgggttccggggtaccccttacccggaacgggtaaccgttaggggtaacgggtaacgttacgggaacggggttacgttaacggtaaccgttttacttaaccgttcggaaccgttacggtacccgttacgttaccgttttacggaccggttaacgggtacccgtaaccgggtacccgtttaacgttacccggtttacccgggtttacccgggggaaaccggggtaaccggggtaaccccggtaaacgggttaccgttaaccccgggttaccccgggttacccggtttaacccggggtaccccggtaacccggggacccccggttaaacccggggttccccgttaaacccccggggttccccccccggttacccgggg

SEQ ID NO: 119107 - DNA, 802 bp, Homo sapiens
  misc_feature: GYAE6OF01A96O9.5.86.H09.1.454.CMB.1.raw
  modified_base (634)..(634): a, c, t, g, unknown or other
  misc_feature (634)..(634): n is a, c, g, or t
tcagatcagacacgcacgaccggtgctcgatttagtgctatagacgtttggggttttggggggctggggtcctcaggaggccagcgcgtctcaggacggtctaccacctatggcctgggctctgctccgtcctcaccctctcactccacggcacgcggtcctgggcccaggtctgccctgacctcgacgccctcccgtccggcggtccgggtctccgtggacgagtcgagtccaaccgacgttccgtcctgccgtacgtcgggaccctaggtaccgtaggttcgtaacgtagtttacgggttaccgtttaattaaaccgttaacgttcggttacccttcccggttaccgggttaaacccgtaaaaccgtaaccgtaaccgtacccggaacggggaaccccgaaaacccggacccccccgtaaaaggttccggttaggttacgttttaccggtagggtacgggttacaacggttaacggcccgggtaccccttacgggtaccggggttccctaggtacgtccgttacttaccgtcgtacggtcctaaccgtacgtcgtacggaccaaccgcccggtccctacccgtcgtaccgtccgtcggtacggcctaccgacacggtaggaccgtgtaccgngtcgtaggacttacgtacgtcgctaccggtctaaccgttagttccgcgacggactacgtactattcgtcgggtacggaccgggaacggaacctaacggtcccgtacggtaccccgtacggtaccggacctaccgggtacccgtacggcccgtcccggtccccgtacgg

SEQ ID NO: 119108 - DNA, 679 bp, Homo sapiens
  misc_feature: GYAE6OF01EP4HP.5.86.H09.1.454.CMB.1.raw
  modified_base (257)..(257): a, c, t, g, unknown or other
  misc_feature (257)..(257): n is a, c, g, or t
  modified_base (677)..(677): a, c, t, g, unknown or other
  misc_feature (677)..(677): n is a, c, g, or t
tcagatcagacacgcacgaccggtgctcgatttagtgctatagacttgagtctgggggaggcttggtacagcctggggggtccctgagactctcctgtgcagcctctggatttccacctttactgtattttggcatgacggtgggtccgccaggctccgagggaaggggctggactggcttctacaaatattaatggaaaaggctaatataacaagactacacagactccggtgaacgggccgttcaccacctcganagacactcgagggacacggtagtacctacgacatgaacagcctagagacgccgaggacacgggtccgtatagttattgtagtggaggggaactggggactaagtttcgacggcgtcggggccgaagggtaacccgtggtacctaccggtctccgtccacgtcccctaccgaacccgaaggggcccctaaggttcccggtcccgtttacccccgtccggaccggtccccgtacgtcccgtacccgacggacgacccgtacccgttaccgacgtacgaccgtacacggaccggcccgtacgggtccgtcgtccgttcgggtacgaacgggtacctacccgttacccgtcgttccgtcgtacgtccgtacggtacggtacggggccgttcgggacgtaacgggccgtacgtacgtaagctcgngc

SEQ ID NO: 119109 - DNA, 754 bp, Homo sapiens
  misc_feature: GYAE6OF01AW74C.5.86.H09.1.454.CMB.1.raw
  modified_base (226)..(226): a, c, t, g, unknown or other
  misc_feature (226)..(226): n is a, c, g, or t
tcagatcagacacgcacgaccggtgctcgatttagtgctatagacttgggtttgggggctggggtctcaggaggcagcgctctcaggacgtcaccaccagtcggccgtgggctctgctcctcctcaccctcctcactcgacgggcacgagggtcctcgggcccagtctcgcctagactcacgccctcccgtcggcgtccggtctccgtgacagtcacgtccacctntcctcgtcgactacgtacggacctagctagtcgactagttcggtacttataactatcgttcctccgtagtaaccaacaactctaccgaaggaccaaaccaccccgaaacttcgtatcgttcgtaggacgtacaacgtacggaccggtcccgtacggtaccggtacctacgtcgttctccgttcgtcctcggtactaccgtaagtccgcgtaaaccaccggtcccgtaccgttccgcggtaacccgtccgtccgtcggtacctacgtacggacgtacgggagtacggtacggtcgtaccgtacgtaccgttacgtaccgtacgtacgtaaccgtcgttacttaccggtcgtacgggtaccgtaccgttaaccgtaccgttaaccgttcccgttacggggtcccgggtaacgggtaacccggtaaaccggtccgggtaaccgttacccggtaccggttacccggtaacgtacccggtaaaccggtaccccgtaacgggtccccggtaaccccggtcccggttaaaccccg

SEQ ID NO: 119110 - DNA, 752 bp, Homo sapiens
  misc_feature: GYAE6OF01A3UVZ.5.86.H09.1.454.CMB.1.raw
  modified_base (266)..(266): a, c, t, g, unknown or other
  misc_feature (266)..(266): n is a, c, g, or t
tcagatcagacacgcacgaccggtgctcgatttagtgctatagactttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcacgtccaccatcctcctgcacgtgggaccagcagtgactagttggtacgttataactntagtcctccgtaggtaaccaacgaacactccgaggacaaaccgaccccccaaatccgtagtatttcctaggacggtcaaggtaacgccggtccctcgacggggttcccctggactcgtcttctcgtcggcctaccgtaagtcgtacggacctaaaccgaccggtccccttcccgtacggtacccgtttcctccggttcgggtccttaccgaagtacccgtaggaacgggtattacgggacgtacgttacgtacctttaacgttaccgttggacctaacggttcctacgtttaacggtttcggaccggtacggtaccgtaaccggtacccgtttaactacccggttccggttaccggggaccgggtaaaccggggtaaccctaacgggtccgttaacccggtaccccggtttacccgttaaacgggtcccgtaaacccggcccggttaaacggtccccgttaccccgggtcccccccggtttaccgg

SEQ ID NO: 119111 - DNA, 746 bp, Homo sapiens
  misc_feature: GYAE6OF01C8APT.5.86.H09.1.454.CMB.1.raw
tcagatcagacacgcacgaccggtgctcgatttagtgctatagacttggggtttgggggtgctcgatttagtgctatagacttgggttgggatctacgttgcaggtgtaggtctgggtccctgagactctcctgtgcagcctctggtattctacctttactgtattttggcatgacgtgggtcccgcgaggctccgaggggaaggggctggactggctctacaaattattaagtaggtaaagcaaatataacaagtaactaccacagaccgtccggtaggaacgggtcccgttacacctacctcgaagacgaaccaactccgaggacacggtctaccacacatagaacacgcctaggagacgaccggaacggaccgaaccggtaccgtaattacgtttagttcggttggtaggggaaggggtaaacggtgggggtactaagtttcgaccggtcggtcggggaccgaaccgggtacccgtgggtacccgtaccgtccgtaccgttcaccgtccctacccgaaccggaaccggcccgtaccgttcccgtccccgttccccgtcggccccgtcccgtcgtcccgtccgacggaccgccccgtacccgtacggaccgacgaccgccgacggcccgggcccgtcgggtccgtccggtcccggttacgggtaacccgtaaccgggttaaccccgtttacccgttccccggtcggtttcccgtagttaaccgtcggttacgggtaaccggggg

SEQ ID NO: 119112 - DNA, 955 bp, Homo sapiens
  misc_feature: GYAE6OF01AFX1I.5.86.H09.1.454.CMB.1.raw
tcagatcagacacgcacgaccggtgctcgatttagtgctatagacttgggtttgggggctggggtctcaggaggcagtgctctcaggacgtcaccaccatggcctgggctctgctcctcctcaccctcctcactcagggcacagggtcctgggcccagtctcgccctgactcacgcctccctccgcgtccgggtctccgtggacagtcagtccaccatcctcctgcacgtgggaccagcagtcgactagtttcgggtacgtttaataactattcgttccttccttacgggtaacccaaacgaaccacttacccgacggacctaaaacccggacccccctaaaacgttccgttagtacttttcgtaggtacgggttacctaacggtaacggcccggtccccgtacggtaccgggggttcccctaggtaccgttaccggtcctttacgtccgtcgggtacccttaccgtaacggttccgtacggggaccctaaaacccggtcccgggttacccccctttaccccggtacccgggttaaccccgggtttcccggtttacccgggttccgggggtaccccgtttaccccgaaacggggttaaccccggttaacgggggtaacgggtacggtttaaccggggaaccggttaccggtttaacgttaaccgtttaacgttttacccggtcgggtaaccgtaccggtacccttttaccgttaaacgttttccgggaaccggtaaccggggtaccgttaaccggttaccccggttaaccgttacccggtttaccggggttaccccgggggtaacccgggggtaaacgggtaaccccggtaaacggggtacccgttaccccggggttaaccccggttacccgggttaaccgggtaacccggtaacccggtacccccggaaacgggttcccccgttaccccggggttcccccccggtttacccggg

SEQ ID NO: 119113 - DNA, 682 bp, Homo sapiens
  misc_feature: GYAE6OF01AVD0R.5.86.H09.1.454.CMB.1.raw
  modified_base (265)..(265): a, c, t, g, unknown or other
  misc_feature (265)..(265): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcggtcccgggtctcctggacagtcagtcaccatcctcctgcacgtgggaccagcagtgactagttcggtacgttataactntcgtccttccgtggtaaccaacaactatccgacggacaaaaccgcccccaaacttcgtagtaactttctaggacgtcaaggtaacgccggcctcggacgggtccctagactcgcttctctcgctacgagtcgagacaaccgcgcctccgtacgaccgtctcggtcgtccgtaccgtacgacgtggaacggtagtacgggacggtcgtaagtaccgttaagtttaccgtacgacgtaacgtccgttagtacggtttcgaccggtacggtaccggtacgtaccgttacttaccgttcggtaccggggtacccggaccgggtaacgtaaccgttaccgggttaccgtacccgggtaccggttaccggacccgtacccggacccggtaacggtcccgtccccgggtccccgttaacccggg

SEQ ID NO: 119114 - DNA, 723 bp, Homo sapiens
  misc_feature: GYAE6OF01BGRHP.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcgagggcacgagggtcctgggccctagtctcgccctgactcacgccctcccgtccggcgtccgggtctccgtggacagtcagtccacatcctcctgacctacgtcggaccagctagtgactagtttcggtacgttaattaactatcgttcctccgttacggtaaccaaacaactacgtaccgacggaccaaaccgaccccctaaacgtcgtagtactttcgtggacgtcgtacggtaacgcccggtaccccgtacggtaccgggtccctagtacgtcgtcttccgtacgtcgtcctaccgtaacggtccgtcggacccaaccggtacccgtccccgttacccgtaccggttacccgtccgtccggttaccggtccgtaccgtacggtacgtagggacggtacgtacgggacgtcggtaacgttaccgttacgttacgtcgcgtacgttccgtcgtttagtcgacggtacggactacggtcctacgttaccggtcggttccgggacgggtaaccggtactacggtccgtacggtccggtacgtaccggacgtaccggcccgaacgtcccgtaccccggtcccggttaccg

SEQ ID NO: 119115 - DNA, 779 bp, Homo sapiens
  misc_feature: GYAE6OF01BW8NW.5.86.H09.1.454.CMB.1.raw
  modified_base (239)..(239): a, c, t, g, unknown or other
  misc_feature (239)..(239): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctctcactcagggcacagggtcctgggcccagtctgccctgactcagcctccctccggcgtccgggtctccgtggacagtcagtccaccatctcctgccacgtcggggaaccngacgagtgactagtttggttacgttaacttaactagtcgtccttaccgtacggtaaccaaacaaactacgtaccgaacggacctaaaccggaccccaaacgtcgttacgtaacttttcgtagggtaggtcgtaacggtaacggcccgggtaccgtcgggtaaccggggttccgtacgtacgttccggtaccttttccgacgttcgggtacctaccggtaacgttcggtaacgaccgtaaaccgaccggtcccgtacctacggtaccgttcgtccgtcgggtacctaccgtacgtacgtacggaggtacgttacggacggttcgttacggtaacttattaccgtacgtactaaccgttctacgttacgttacggacgtacggaccgtacggtaccgttaacttacccggttacgggttacccgggtacgggtaaccgggtaacctaacgggtacccggttaacccggtaccggttaccggttacggtaacccgaacggtaacccggtacgttccccggtacccggtcccccgggttaccgg

SEQ ID NO: 119116 - DNA, 645 bp, Homo sapiens
  misc_feature: GYAE6OF01CI0C5.5.86.H09.1.454.CMB.1.raw
  modified_base (489)..(489): a, c, t, g, unknown or other
  misc_feature (489)..(489): n is a, c, g, or t
  modified_base (640)..(641): a, c, t, g, unknown or other
  misc_feature (640)..(641): n is a, c, g, or t
  modified_base (643)..(643): a, c, t, g, unknown or other
  misc_feature (643)..(643): n is a, c, g, or t
tcagatcagacacgcacgaccggtgctcgatttagtgctatagacttgagtctgggggaggcttggtacagcctgggggggtccctgagactctcctgtgcagcctctggattcacctttactgattttggcatgacgtgggtccgccaggctccgagggaggggctggactggctctcaaatattaagtaggaaaaggcaatatacaagactacacagactcgtgaagggccgtcaccacctcgagagacaactccgagggacacggtgtacctacacatgaacagcctgagacgccggagacgacggccgtatattatgtgtggagggaacgtggggactagttggaccgtcgtggggacccgacggggtaacccgtcgggtaccaccgtcctcctaccacgccctacccgaccgaacgggcccctacgttccggtacccgttcccccgtcggccccgtacccctcggtccctacccgaagggaccncccgtacccgtcccggaacgaccgcccaacgaccggcccggtcccgtcgggcctccggaccgtacgggtaccgaacggtacccttaaccgttcccggtatccgtgtactcgtagacgggcgggtctcgggacgaacggcgacgtacgtagnngncg

SEQ ID NO: 119117 - DNA, 736 bp, Homo sapiens
  misc_feature: GYAE6OF01DGB60.5.86.H09.1.454.CMB.1.raw
  modified_base (125)..(125): a, c, t, g, unknown or other
  misc_feature (125)..(125): n is a, c, g, or t
  modified_base (161)..(161): a, c, t, g, unknown or other
  misc_feature (161)..(161): n is a, c, g, or t
tcagatcagacacgcacgaccggtgctcgatttagtgctatagacttgggtttgggggctggggtctcaggaggcagcgctctcgaggacgtcaccaccatcggcctgggctctgctcctcctcnccctctcactcagggcacgacgggtcctcgggcccngtctcgccctgactcacgtccctcccgtccgcggtccggtctccgtggactcggtcacgtccaccactctccgtcgcgacgtcgggaccagcagtagactagttgtacgttaatactagtctcctcgtacggtaaccaacaactactaccgagaaccaaaccgacccctaaacgtcgtacttagttcaggtacgtacaggtaccgccgccgttacggacgggtcctgacgttcgtccttcggtcgcggttccacgtagtcgacgtaccgaaccgtccgcccttaccggtcgtacccgtcgtacgtcggacctacgacgtacgtggaagtcgtacggtagtcgtacttaaccgttacgtacgcgtacgtaccgtactttacggtacgttaccgaccggttaacgaccttaccggttaaccgtttaccgtccggttaccgggtaaccggggtaccggaaccgggttaaccgtaaacccggtccggttaaacccggtccccggttaaaccggttacccgggtaaccgtacccggaacccggttaccgggaccccgtccccgggtaccccggttacccg

SEQ ID NO: 119118 - DNA, 778 bp, Homo sapiens
  misc_feature: GYAE6OF01D3AHG.5.86.H09.1.454.CMB.1.raw
  modified_base (205)..(205): a, c, t, g, unknown or other
  misc_feature (205)..(205): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcaggcacagggtcctgggcccagtctcgccctgactcacgccctccctccgcgtccgggtctccgtggacngtcagtccaccatcctcctgcacgtcgggaccagcaggtcgaacgtagttcggtacgtttaacttaactattcgtccttccgtacggtaacccaaacaactactaccgaacggaaccaaaccgaacccccctaaaacgttcggtagttactttcgtacggtaaggtcgtaacgtaacgcccggtccctacggtaccggggtccctacgtacgttccgtccgtttcctacgttcggtaccttaccgtacgttccgtcggaccaaaccggtacccggtccccttacccgtccgtacccgttccgttaccggtccggtcccgtacccgtaacggtaccgtacgggaacggtacggtacggtacgggtaccgttaccgtaaaccgtttaccgtttacgtacgtaccgtacggtacctttacgttacgtttacgaccgggtacgtaccgtacgtaccgttacgttaccggttcggtaccggggaccggtaacgggacccgtaacggtcctaccgggtacccgtaccggtcgtacccggaccgtaacccggacgtccccgtcccggttccccgtaccgg

SEQ ID NO: 119119 - DNA, 700 bp, Homo sapiens
  misc_feature: GYAE6OF01A0FQ4.5.86.H09.1.454.CMB.1.raw
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgggaccagcagtgacatttggtcgttanaactatgtctcctggtaaccaanaacatccaggcaaacgcccccaaactcgtgatttcngagtcaagtaagccggcccgtcgacggggtaccctgacgtcgtcttacttctcggtctaccgtaacgtcgtaggccaacgaccggtcccttccccgtacgacccgtccgttcgtccgggtcctacccgaacggtaccgttggaacgggagtacggtagggtccttagggtaaccctttaaggttaccgtacgtaccgaggtccttacgttaacgtttcggtaccgtaacgggccgtaaccggtaccgtaccgttaacccgtttccgggttacgggaaccgggggtaccgggaaccgtaaacggtcccggttacggtaccccggttaccgttaacgggtcgaaaccggaccccgtaacggtcccgttccccggtccccccgttaccggg

SEQ ID NO: 119120 - DNA, 744 bp, Homo sapiens
  misc_feature: GYAE6OF01EA7VO.5.86.H09.1.454.CMB.1.raw
  modified_base (127)..(127): a, c, t, g, unknown or other
  misc_feature (127)..(127): n is a, c, g, or t
  modified_base (146)..(146): a, c, t, g, unknown or other
  misc_feature (146)..(146): n is a, c, g, or t
tcagatcagacacgcacgaccggtgctcgatttagtgctatagacgttggggtttggggctggggtctcgaggaggcagcgctctcaggacgtcaccacatggcctggctctgctctctcaccctcncactcaggcacgaggtccnggcccagtctgccctgactcgacgccctcccgtccgcgtccgggtctcccgtggacctagtcaacgtccactatcctccgtgacacgtgggaaccagctaagtgtaacgtgtttcggttactttaagttaaacctgttccgttactaccctggttaaccaaactaacctacgtccaacgggtaaccaaaaccgaccccccgtaaaagttcgttacgtacgtttaccgtaggtaacggttaccggaacgttaaccgggcccgtaaccccgtcggtaaacccggggttccctaaggtccgttaacggtccgtttaacggcgttcggtacctacgtaacggtcgtacgtacaacggccggttacccaccgtacgaccggttcgaccggtacggacctacgaaggtcgtacgggagttaggacgtcgggcttacggtaaccttagtttacgcgtaccacggttactacgttacttacggcgtaacggtcgtacgtaccgtagttaccctcgggacgttccgggacaccgtaaacggccttacggtaacccgtgtaaccgtaccggtacgtaaccccagggtaccctcccgtcccggttaccg

SEQ ID NO: 119121 - DNA, 729 bp, Homo sapiens
  misc_feature: GYAE6OF01EL5DC.5.86.H09.1.454.CMB.1.raw
  modified_base (575)..(575): a, c, t, g, unknown or other
  misc_feature (575)..(575): n is a, c, g, or t
tcagatcagacacgcacgaccggtgctcgatttagtgctatagacttggggtttgggggctggggtctcaggaggcagcgctctcaggacgtcaccaccatggcctgggctctgctcctcctcaccctctcactcagggcacagggtcctgggcccagtctcgcctgactcacgtccctcccgtcgccgttccggtctccgtggactagtcagtccactattcctcctgaccacgtacgggaccaacgcagttacgacttaggtttcggttacgtttaactaacttattcgttcctaccgttacggtaaccaaactaactactaccgaacggaaacctaacccgtaacccccctaaagtttcggttacgttacttttacggtacggtaggttaaccgaggtaaccgggcccgttacccgtacgggtaccgggttaccctggtaccgttccgttccgtttaccgtccgttcggacctttaacggaacgttccgacggtaacccgaaccgtccccggtcccgttacccgtacgtacccgttcgtaccggtcggtacctccgaacgtcgaggtacggngtacgacgtcgtacgtacttcgtacgtgtcactgttacgtagttcgacgcgtacgacgttacgtacttcgtacggtcgggaccggaacgtacgtacgtcggtaactccggtacgtacgaccgaccggacctaggccccgtccgtcccggtaccc

SEQ ID NO: 119122 - DNA, 797 bp, Homo sapiens
  misc_feature: GYAE6OF01BRTLZ.5.86.H09.1.454.CMB.1.raw
  modified_base (222)..(222): a, c, t, g, unknown or other
  misc_feature (222)..(222): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcgagggcacagggtcctgggcccagtctcgccctgactcacgcctccctccgcgtccgggtctccgtgacagtcagtccacatctccngccacgtcgggaccagcagtgactagttggttcttaataactatcgttcctaccgtacggtaaccaacaactactccgaacggactaaaccgacccccaaaacttcgtagtacgttttcgtaggacggttacgaacggtaacggccgggtcccccgttacggaaccgggggtttcccctaggtaccgttccggttcccgtttcgttccggtacggtaccctaccgtaacggttccgtcggaaccgaacccgacccggttcccgttaccccgtcgtacccgttaccgtccggttcgggtaccctccgaacggtacgtcggaacgggttacgtacgggacggttcgttaacgtaaccgtttacgttaccggttacgtacgtacgttaccttacgttaacgtttcggacggtaccggtaacctaccggttaacccgttagttacccgttccggggtaccgggtacccggggtaaacgggtacccgtaaccggtccggttaaccgggtaccccgtacccgggttacggtaccgaccccgtaccggaaaccggtcccgtccccgtccccgggtttacccg

SEQ ID NO: 119123 - DNA, 716 bp, Homo sapiens
  misc_feature: GYAE6OF01B4LUE.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtctgccctgactcagccctcctcgcgtccggtctccgtggacagtcagtccacctatctcctagccacgtcgggaccagcagtcgactagttggtacgttactaacttatcgtacttccgtacgttaaccaacaactactaccgacggaccaaaccgaccccctaaacgtcggtactactttcgtacgtacggtcgaagtaacgccggtacctaccggtacgggtaccctggacgtcgtcgttctcgtcgtacctcgtaagtcgtacgacgaaccgtaccgccctcccgtcgtaccgttcgtcggtcgggtcctacgacgtaccgttagacgagtcggacgtcgtaggtaaccgtttacttaccgtgacgttacgtcttacgtttacgttacggaccgtacgggaccgttacgttacccgttagttaccggtttccggtacgggacccggggtaaggaacccgtaaggtccgttaaccgggttacccgttaccggttaaccggaccgtaacccggtcccgaaaccgggttcccctcccggttacccccgttcccggg

SEQ ID NO: 119124 - DNA, 706 bp, Homo sapiens
  misc_feature: GYAE6OF01EOTMJ.5.86.H09.1.454.CMB.1.raw
  modified_base (169)..(169): a, c, t, g, unknown or other
  misc_feature (169)..(169): n is a, c, g, or t
  modified_base (261)..(261): a, c, t, g, unknown or other
  misc_feature (261)..(261): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcgaggcacaggtcctggcccagtctgccctgactnacgccctccctccgcgtccggtctccgtggacagtcagtcaccatctcctgcacgtcggaccagcagtgactattggtacgttataactatntctctagtaccaacaacataccaggacaaaccgacccccaaactcgtagtactttcgtagacgtcgagtaacgccggtaccccgtcggtacgggtcctgtactcgtccgtttctcgttcggaccttcgaaaggttccgtacggtaccaaacccgtccggtcccctccgtacggtacccgttcgtccgtcgggtacctcgacgtacgtaggaacggtacgtaggacgtaccgtacgtaacctttaccgtttaacgtcggtaccgtaccgttacgttaccttaaggtttccggacgtaaccggtccgtaaccggttacccgttacgtttaaccgttcggttaccgggaccggggaacggtaacccgtaagtcccggtacgttacccgtaccggtacggtacgaacccgggtacccgtaacggcccttacccgggtccccgttaccgg

SEQ ID NO: 119125 - DNA, 743 bp, Homo sapiens
  misc_feature: GYAE6OF01CB8H3.5.86.H09.1.454.CMB.1.raw
  modified_base (272)..(272): a, c, t, g, unknown or other
  misc_feature (272)..(272): n is a, c, g, or t
  modified_base (584)..(584): a, c, t, g, unknown or other
  misc_feature (584)..(584): n is a, c, g, or t
  modified_base (596)..(596): a, c, t, g, unknown or other
  misc_feature (596)..(596): n is a, c, g, or t
  modified_base (602)..(602): a, c, t, g, unknown or other
  misc_feature (602)..(602): n is a, c, g, or t
tcagatcagacacgcacgaccggtgctcgatttagtgctatagactttggggtttgggggctggggtctcaggaggcagcgctctcaggacgtcaccaccatcggcctgggcctgtctcctcctccaccctcctcactcgacggcgacgacgggtccggtcggcccgacgttctcgccctcgtactcacgtccctccctccggtcggtcccggttccgttccgtcggacgtagtcacgtcaccatccgtcctacgcgtacgtcggaccgacncgagtcgacgttagttcggttaacgttattaaactacgttcgttccgttccttacggtaacctaaaccaacgtactaccgaacgaaccgtaaaccgaaaccccctaacgtacgttgtacgttttagtcgacggttacgaagttaaccggccgtaccccgtaggtcccgggtacctcgtacgtccgtctttaccgtcgtacgtacctacgttaacgcggttacggaccgtaaccgacccgggtccccttacccgtccgtacggttccgtcgttaccggccgtacgacgtacggtgaggacgtaggtcgacgtnttacgtactgcngtactntcttacgtgccgagtccgtacgccgttaccttcggtaccgggtcggaaacggtccggaactaccggtacggtcccgaccgtttacgggacccgtacgggacccgtaccggacccgttccggtcccctcccggtcgttaccg

SEQ ID NO: 119126 - DNA, 788 bp, Homo sapiens
  misc_feature: GYAE6OF01BBMUF.5.86.H09.1.454.CMB.1.raw
  modified_base (216)..(216): a, c, t, g, unknown or other
  misc_feature (216)..(216): n is a, c, g, or t
tcagatcagacacgcacgaccggtgctcgatttagtgctatagacttgggtttgggggctggggtctcaggaggcagcgctctcaggacgtcaccaccatggcctgggctctgcctcctcctcaccctctcactcgagggcacgagggtcctgggcccagtctgccctgactcagccctccctccgcgtccggtctccgtggacagtcagtcaccntctcctgcacgtggaccagcagtgactagttggtacgtttataactattgttcctccgtaggtaacccaacaactagtaccgaggaccaaaacccggcccccctaaaacgttccggttacgtacgttttacgacggtaacggttccgaaagggttaaacgccccgggtaacccctacgggtaacccgggggtttccccgtaagtaccgttccgtccgtttccgtccgttcggacccttacgtaaaccggttcgtacggtaccgaaacccggtacccggtccccttacccggttacggtaccccggtttccgttaaccggtccggggtaccctacccgtacggtaccgtaagggtacgggtaagttacgggacgtccggttaacggtaacctttaagtttaaccggtcgtacgtacgtcttaccttagtttcggacgacggtaccgacgttacccgttattacccggtacggttacgggccggtaaccgggaaccgtacgtacccgtacggtacccgtaccgtacggtaccaccgggtaacccgacggacccttcccggccccggtttaccgg

SEQ ID NO: 119127 - DNA, 704 bp, Homo sapiens
  misc_feature: GYAE6OF01DYZDZ.5.86.H09.1.454.CMB.1.raw
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
  modified_base (507)..(507): a, c, t, g, unknown or other
  misc_feature (507)..(507): n is a, c, g, or t
tcagatcagacacgcacgaccggtgctcgatttagtgctatagacgttggggtttgggggctgggggtctcaggaggcagcgctctcagggacgtcaccaccatggcctgggctctgctcctcctcaccctctcactcgagggcacgagggtcctgggcccagtctcgccctgactcacgcctccctcgcgtccgggtctccgtggactgtcacgtccaaccnctccgtcctgccacggtacgggaaccnggccgtagtcgaactagtttgggtactttaataacttgtcgtcctaccgtaacggtaaccaaacaacactaccgaaggtaacccaaaaccggtaccccctaaagttcgtagttacgtttcgtaagacgggttacaagtacggcccgtacccgtcggaccggggtccttgacggttcctccgtttcgtgtcccggtactaccgtaaggtccgtaacgaccgtaacccgccggtcccttacccggtcgacccgtttccncgtcggcctaacgtcggacgttagaggtactaggagttcctaagtcttaacgtcgacgtatcgtcttcgtagtacggacgtgtaaccgtgacgttactacgtccggttgggaaccggtaaggaccgcgtcggttacgtcccggtaacgttgaacccgtaaccgtaacccggcttcccccgtaacgccccgttaccgg

SEQ ID NO: 119128 - DNA, 734 bp, Homo sapiens
  misc_feature: GYAE6OF01B4C7A.5.86.H09.1.454.CMB.1.raw
  modified_base (612)..(612): a, c, t, g, unknown or other
  misc_feature (612)..(612): n is a, c, g, or t
  modified_base (711)..(711): a, c, t, g, unknown or other
  misc_feature (711)..(711): n is a, c, g, or t
  modified_base (719)..(719): a, c, t, g, unknown or other
  misc_feature (719)..(719): n is a, c, g, or t
tcagatcagacacgcacgaccggtgctcgatttagtgctatagacttggggtttgggggtgctcgatttagtgctatagacttgggtttgggatctacgttgcaggtgtaggtctgggtccctgagactctcctgtgcagcctcgtggattcaccgtttactgtattttggcatgacgtgggtccgcaggctccgagggagggctggactggctctagaaatattaagtggtaaaggcaatataccaagactacaacgagaccgttccggtagaacgggtcccggttcgaaccctaccgtcgaggtaacgaccaaacctccgaagggaccgacggtagtacctaccaagactagaaccaacgccttacggaggacgccggaggaacccacgggtaccttaagtaactttagttaggtacgttagggaacggggtaaaacgttcggggggaacttaaacgtttcggacccggtacggacggggtacccggaagggtaaccccgttgggtacccgaaccggttccctccgtacgcgtcccctacccgaacccgtaacgggcccctaccggttccggttaccccttccccgtcgggcccgtccccgtggtacccncggtaccggaacgccccgaaccgtaccggacgacgtacaccgtacggcccgacgtcggctacgccgtacggtacgaccggtacgttaccgttccccggnttaccgtnccttcgacggtcggg

SEQ ID NO: 119129 - DNA, 805 bp, Homo sapiens
  misc_feature: GYAE6OF01DTG35.5.86.H09.1.454.CMB.1.raw
tcagatcagacacgcacgaccggtgctcgatttagtgctatagacttggggtttgggggctggggtctcaggaggcagcgctctcaggacgtcaccaccatggcctgggctctgctcctcctcaccctctcactcgagggcacagggtcctcgggcccagtctgccctgactcacgccctcccgtccgcggtccgggtctccgtggacagtcagtccaccatcctcctgcacgtcggaccagcagtgactagttggtacgttaactacttatcgtaccttccgtaacggtaaacccaaactaactaacctaccgaaacggtaccaaaacccgaacccccctaaacgtcggttacgttacgtttcgtaggtaccggtacaacggttaacggcccggtacccgtccggtacggggttccctagacttccgtcctttcgtcgtcgtcctacgtacggttccgtacggaccaaccggtcccgtccccttacccgtacggtacccgttcgtaccggtcgggtacctaccgaaaggtccgtaggaacggtagtcggtaacggtcgtaacgttaactttaacgttcggtacgacgttacgtcgttacgttaacgtttccgggaacgtacgggtccgtaacggttacccgtttacttacccggtttaccggttaccggggaccgggtaacccgggtaccggtaaccgggttcccggttacccgggtaacccggttacccgggtaccgggtacccggtaacccgtaacccgggtaaccccgttcccggtccccccggttccccggtttacccgg

SEQ ID NO: 119130 - DNA, 758 bp, Homo sapiens
  misc_feature: GYAE6OF01EQ3HO.5.86.H09.1.454.CMB.1.raw
tcagatcagacacgcacgaccggtgctcgatttagtgctatagacttggggtttgggggctggggtctcaggaggcagcgctctcaggacgtcaccaccatggcctgggctctgctcctcctcaccctcctcactcgagggcacagggtcctgggcccagtctgccctgactcagcctccctccgcggtccggtctccgtggacagtcagtcaccatctcctcgcacgtcggaccagcagtgactagttggttacgttataacctatcgtcctccgtacggtaaccaacaacactaccgaggaaccaaaccgacccccgtaaacgtccgtagttactttctaggtacggtacgtaacgtaacggccggcccgtcggtacggggtcctacggtactccgtcttcgtctcggtacctacgtacgtcgtcgaccaaccgtccgtccctccgtccggtaccgtcttcgtccggacttaccgaacggtacgtaggaacgggtagtacggtacggtcgttaaccgtaccgtttaacttacccggtacgtacccgtaccggtacgtttacgttacggtttcgacgggtaaccggtaccgtaccggttaccttaaccgttcccggttccgggttacccggggtaccggggtaaaccggttacccggaacgtacccggttacccggtaccccggttaccgggtaccgttacccgaacccggtacccgtaacccgggtccccgttaccccggtcccccggttacccgg

SEQ ID NO: 119131 - DNA, 750 bp, Homo sapiens
  misc_feature: GYAE6OF01COZJM.5.86.H09.1.454.CMB.1.raw
  modified_base (213)..(213): a, c, t, g, unknown or other
  misc_feature (213)..(213): n is a, c, g, or t
tcagatcagacacgcacgaccggtgctcgatttagtgctatagacttgggtttggggggctggggtctcaggaggcagcgctctcaggacgtcaccaccatggcctgggctctgcctcctcctcaccctctcactcgaggcacgagggtcctcgggcccagtctcgccctgtactcacgccctccctccggccgtccgggtcctccgtggacngtcacgtccaccatcctcctgaccacgtcgggaccagcagtgactagttcggtactttaataacttattcgtcctaccgtacggtaaccaaaacaacactaccgacggaaccaaaaccggaccccctaaaacttcggtagttaacgtttcgtacgacggtacaacgggtaacggcccggtaccccgtacggtaccgggggttccctaggtaccgttccgtactttccgtccgttcggaccttacgtaacgtcgtcggaccaaacgcccggtcccgtcccgtaccgtaccgttccgtaccggtcggtccctacgacgtacgtcgggagtagtcggacggtcttaacgtacttacgttcgacgtactacgtcgttacgttagtttacggaacgtcggaacctacgggttaccttacgttacccgttacggggtcggggaaccggtacgggtaaccgtacggcggttaaccggtacccgtaccggtaccggacccggtaaccgtacccgggacggttcccctcccggttccccgtaccgg

SEQ ID NO: 119132 - DNA, 877 bp, Homo sapiens
  misc_feature: GYAE6OF01AHUMY.5.86.H09.1.454.CMB.1.raw
  modified_base (188)..(188): a, c, t, g, unknown or other
  misc_feature (188)..(188): n is a, c, g, or t
tcagatcagacacgcacgaccggtgctcgatttagtgctatagacttgggtttgggggctggggtctcaggaggcagcgctctcgaggacgtcaccaccatggcctgggctctgctcctcctcacccctctcactcgaggcacacgggtctcgggcccagtcctcgccctgacctcagtcccctcccnccggccggtcccgggttcctaccgtggaccaggttccagtccaccattccgtccgtgccgtacgtacggggacccaggtccgtagtcgtaacgtagtttcggttacgttaactaaacgtgtctccgtccgttacggtaacctaacaacctactacccgaacggtaaccctaaacccgaacccccgttaaaccgtcggttagtaccgttttcgtaacgggtaccggttaccgtaagggtaaccggtcccgggtaccccgtaacccgggtaacgggggttccctacggtaaccgttccggttaccgtcccggtttacgcccgggtacctaaccccgtaaggtttccgacggaaacccgtaacccgtacccgggttacccccttccggtaacccgggttccgttacccggttccggtacccgggttaccccgtaccgtaacggtacccgtagggtaacggtaccggtcgggtaacgtaccggttaaccgttaccggtttaacgtttacgaacggtaccgacgttccgttaccttaggtaccgagggtacccgtaacaccgttaccgtacgttcccgtcggtaccgggtaccggtaacccgaccggtaacggtcgttaaccgggtcccgttaccgggtacgtcccggtaaccgacccgtaacccggtccgtacccccgttccgggtaccccgg

SEQ ID NO: 119133 - DNA, 756 bp, Homo sapiens
  misc_feature: GYAE6OF01AYJW4.5.86.H09.1.454.CMB.1.raw
  modified_base (254)..(254): a, c, t, g, unknown or other
  misc_feature (254)..(254): n is a, c, g, or t
  modified_base (317)..(317): a, c, t, g, unknown or other
  misc_feature (317)..(317): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattccaccttttactgtattttggctatgacgtcggggtccgccgaggcctccgaggggaaggggctggacgtggcctctacaaatattaagtaggtaaagctaatanaacaagactacacacgtccgtcggtaggaccgggtccgttacaccacctcgagaggaccaacncgagggacgaccgtcgtacctacactatacgaacgcgactacggagacgccggaagaccgacggtaccgttattaattacgttggtaggtagggaaacggggtaacggtggggtaactaacggtttcggacccggtcggtaacgggggaccctaaccgggggtaccctaccgggtaccgtacccgtcgttacccgtcgacccgtccctaccgaaccgacggtccctacgtccgtcccgtcccgtcgtccgcccgtcgcctccggacgccgtcctacccgtaccgagacccgacgaacccgacccggtccgggtacccggtccgggtcccgttaccggggccccgttaacgggggtaacccgtaaaccgggtttccccgttaacccggtttcccgggaacggtttccgtaacggttaccgtcgggtacggggtcccgggg

SEQ ID NO: 119134 - DNA, 808 bp, Homo sapiens
  misc_feature: GYAE6OF01CDY4R.5.86.H09.1.454.CMB.1.raw
  modified_base (635)..(635): a, c, t, g, unknown or other
  misc_feature (635)..(635): n is a, c, g, or t
tcagatcagacacgcacgaccggtgctcgatttagtgctatagacttgggtttgggggtgctcgatttagtgctatagactttgggtttgggatctacgttgcaggtgtaggtctgggtccctgagactctcctgtgcacgcctctggtacttcctaccttttactgtagttttggcagtgacggtcgggtcccgccgaggcctaccggaaggggaacgggcctaggacgtggcctactaacaaaattattaaagtaggtaaagactaaataataacaaacgtacctaacaacgaacgtaccgtaccggtaagggaacgggtcccgtacctaaccgaaccgtacggaagaacgaacctaaaccgtaccggaacgggaaccgtaaccggttaccgtaaaccctaacaacgaactacgaaacgacgtaccgtaggacgaacggaccggaacggaccgtaaccgggtaccttaattacgttagttggagggtaacgggaaggggtaaacggtggggtaactaagttcgggaccgcggtacggggaccgtaacgggaacccgttcggaccctaccgtcctccgtacgacgtccccgtaaccgaaccgaaccggccctacgtcccggttcccttccccgnggtcccgcccgtgaccctacgaaccgtaccgacccgtaccgtaccggacgaccggaccacggcccgacccggccggtcgggacctccgggtacccggttacggaccgtaaaccgggttaccctttacccggttcccggtagttacccgtggtaaccttccggcgggtaaccgg

SEQ ID NO: 119135 - DNA, 891 bp, Homo sapiens
  misc_feature: GYAE6OF01DT18Q.5.86.H09.1.454.CMB.1.raw
  modified_base (232)..(232): a, c, t, g, unknown or other
  misc_feature (232)..(232): n is a, c, g, or t
tcagatcagacacgcacgaccggtgctcgatttagtgctatagactttggggtttggggggctgggggtctcagggaggcagcgctctcaggacgtcaccaccatggccgtgggctctgcctcctcctcaccctcctcactcgagggcacgagggtcctcgggcccagtcgtcgccctgactcacgccctccctccgcggtccgggtctccgtggacacgtcacgtcacctntccgtcctgccacgtcgggaaccagccagtcgactgtttacggtacgttaactaacgttatcgtcctaccgtacgtaacctaaacaacctactaccgaacggaccaaaacccgaacccccctaaagttccgttagttaactttcggacggtaacggtaccgtaaaggtaaccgggtcccggtacccccgttacgggtaccggggttcctacggttaccgtcccgttccgtttaccgtccggttaccggtaccgttaacccttaacggggttcctaacgggaacccgtaaaccccgggtacccgggttcccccctttaccgggttacccgggtacccgggtttctttcccggggtaccgggtacccctaaccggtaacgggttaaccggtagggaacggttacgtacgggaacgggtttacctaaacgtttaacgtttaaagtttcccgacggtaacgtaccgttacctttacggtaaccgtttcggaccgtacgggacctacccgggttaaccttacggttaaccgtttccggggtaaccgggggacccggtaaaccggggtaacccttacccgggtacgtaccgggttacccggttaaccggaggtaccccggtaacggaaccccggacgggttcccccgtcccgtcccccggttacg

SEQ ID NO: 119136 - DNA, 711 bp, Homo sapiens
  misc_feature: GYAE6OF01DZRRQ.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcgaggcacagggtcctgggcccagtctgccctgactcacgcctccctccgcgtccgggtctccgtggacagtcagtccaacctactcctcctgccacgtcgggaccagcagtcgactagttggtacgttaataacttatcgtctccgtacgtaaccaaacaacactaccaaggaccaaaacgaccccctaaacgtcgttagtacttttccgtaggtacggttacaaggttaaacggcccggtaccccgtacggtaaccgggggttccctggtaacctccggtcctttccgtcggtcggtcccgttaaccgaaacggttccgtacggaccgaaaccgtcccgggtacccttccccggtacggtacccgttccgtccggtaccggtcctaccggacgtacgtaggacggtagtacggacggtcgttaacgtaactttacgttacgtacgtactaacgtctgttacgttcgacggacgtcgtacgttacgttacttacggtcggtacgggaacggtacgaaccgacgtacgacgtccggtacgtacgccgacgtaccgacggtccctcccgtcccgtccg

SEQ ID NO: 119137 - DNA, 732 bp, Homo sapiens
  misc_feature: GYAE6OF01CNXPH.5.86.H09.1.454.CMB.1.raw
  modified_base (239)..(239): a, c, t, g, unknown or other
  misc_feature (239)..(239): n is a, c, g, or t
  modified_base (340)..(340): a, c, t, g, unknown or other
  misc_feature (340)..(340): n is a, c, g, or t
tcagatcagacacgcacgaccggtgctcgatttagtgctatagacttggggtttgggggctggggtctcaggaggcagcgctctcaggacgtcaccaccatggcctgggctctgctcctcctcaccctctcactcgagggcacgagggtcctgggcccaggttcctcgaccctgactcacgtcctccctcgcgtccggtctcctggacagtcagtcaccatcctctgctcgtgggaccngacagtgactgttcggtacttaataactattcgtcttcctacggttaaccaaacactataccgtacggaccaaacgccccaaaacgtcgtacgtatttcgngtacggtctacggtaacgcggtccctacgacggggtccctgacgtactcgtttacgcgttcgccgtacctaacgttccgtagggaccaaccgtaccgggtcccttcccgttagtacccgttcgtaccgttcggaccgttccgagtacgtgaacggtcgtggaacggtcctacggtaacttacgtttaccgtagtacgtaacgtcgttaccgtaagtttcgacggtacggaccgttacgggtaaccgttacgttacccttccgggttacggggaccgggtaaacgggacccggttaacgaccggtttacccggtaaccggttaccgttaccggaccggtaaccgtacccccggtagggttcccgtacccccgggttcccccggttaaccgggg

SEQ ID NO: 119138 - DNA, 695 bp, Homo sapiens
  misc_feature: GYAE6OF01BB4TD.5.86.H09.1.454.CMB.1.raw
  modified_base (225)..(225): a, c, t, g, unknown or other
  misc_feature (225)..(225): n is a, c, g, or t
  modified_base (277)..(277): a, c, t, g, unknown or other
  misc_feature (277)..(277): n is a, c, g, or t
  modified_base (345)..(345): a, c, t, g, unknown or other
  misc_feature (345)..(345): n is a, c, g, or t
tcagatcagacacgcacgaccggtgctcgatttagtgctatagacttggggtttgggggctggggtctcaggaggcagcgctcgtcaggacgtcaccaccagtggcctgggctctgctcctcctcaccctcctcactcgaggcacgagggtcctgggcccagtcctcgccctgactcacgccctccctccgcggtccggtctccgtaggacacgtcagtccaccntcctcctgaccacgtggaccagcgtagtgactagttggtacttaataacttntcgttctccgtaggtaacccaacacactccgaaggacaacccgacccctaaacgtcgtgtactttcgngtacgtcgaagtacggccgtccgtacggtacggtcctgtacgttccgtcttaccgtcgtcgacctaccgtaagtcgtacgaccaccgaccggtccctacccgtacggtaccgttccgtacggtaccggacctaccggtacggtaccggtaggtaacgggtacgtaggaccgggttcttaacggaacgttttccgtaagtccgtacgacgttccgtactaaggttcccacggtaaccggcgttaccgtagtaccttccggtacgggaccggtcgggaacgtacgtacgccggtacgtcccggtacgtaccgaccggtacgtaccccggacggtcccgtcccgccggttacc

SEQ ID NO: 119139 - DNA, 591 bp, Homo sapiens
  misc_feature: GYAE6OF01EGJ60.5.86.H09.1.454.CMB.1.raw
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (445)..(445): a, c, t, g, unknown or other
  misc_feature (445)..(445): n is a, c, g, or t
tcagatcagacacgcacgaccggtgctcgatttagtgctatagacttggggtttgggggctggggtctcaggaggcagcgctctcaggacgtcaccaccatggcctgggctctgctcctcctcaccctcctcactcgagggcacagggtcctgggcccagtctgccctgactcacgcctccctcgcgtccggtctccgtggacngtcagtccacattccncctgcacgtggaccagcagtcactagttcggtacgttataactatcgtcctcgtcgtaaccaacaacactccgaggaccaaaccggccccctaaacgtcgtacgtatttcgtaggtacgtcgaaggtaacggccgcccgttcggacggggtcctgactcgtcttctcgtcgtctacaagtcgtacggacaacgtccgccctcgtcgtaccgtcgtcgtcggtccncgtacgtactggagtagtcggacgtactagtacgttattaccgtgctacgtctacgtagttcgcgtacgcgtacgtctagtcgtcggtacggcggacgacgacgtccacggtccgcgtacgccacggaccaggcctccgccgtacg

SEQ ID NO: 119140 - DNA, 661 bp, Homo sapiens
  misc_feature: GYAE6OF01B45JP.5.86.H09.1.454.CMB.1.raw
  modified_base (323)..(323): a, c, t, g, unknown or other
  misc_feature (323)..(323): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcacgcctccctccgcgtccgggtctccgtagacagtcagtcaccatctcctgcacgtcggaccagcagtgactagttcggtacttataactagtgtcctcgtaggtaccaacaacatccaggaccaaacgaccccaaagttcgtagtacttcgnggacgtcaagtacgccgtcctacggacgggttcccagactcgtcttcgcgtacgctaccagtcgacggcaacgccgtcctccgtgtaccgtctacgtacggtcctaccgtagacggtagacggagtggacggtactagttaaccttaacggttactcggacctacgtccgttacgttacgttcgacggtaccgacggttaccggtaccggttaacttccggttaccggttaccggggacggtaaccgggtaaccgtaacggtcccgacgggttaccccgtaaggtaccggtaccctaacccggaccgtacggtcccgtccccggtccccggttaccgg

SEQ ID NO: 119141 - DNA, 713 bp, Homo sapiens
  misc_feature: GYAE6OF01EL0O3.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcactggaccagcagtgacattggtcgttataactatgtctccgtcgtaccaacaacactccacggaccaaaacgcccccaaactcgtagtacttacgtggtacgtcgtaacgtaacgcccggtacccgtaccggaccggggttccccgtagtacgtccgtccttctcgtcgtacctaccgtaacgtcgtcggtaacaaccgtaccggtccctacccgtcggtacccgttcctccggtacggtccctacccgaaggtaccgttaggaacgggtgtacggacggtactacgtaacctttacgttaccgtcgactacggtcttcgttaacgttcgacgtacggaccgtacggttaccgtaacgttacccgttcgggttaccgggtaccgggaaaccgggtaccgaacggttacgtacccggttaccccggtacgttaacggacccgtaaccggaccccggaaaccggttccgtccccggtcccccgttacccggg

SEQ ID NO: 119142 - DNA, 725 bp, Homo sapiens
  misc_feature: GYAE6OF01EJAQS.5.86.H09.1.454.CMB.1.raw
  modified_base (226)..(226): a, c, t, g, unknown or other
  misc_feature (226)..(226): n is a, c, g, or t
tcagatcagacacgcacgaccggtgctcgatttagtgctatagacttggggtttgggggctggggtctcaggaggcagcgctctcaggacgtcaccaccatggcctgggctctgctcctcctcaccctcctcactcagggcacgagggtcctgggcccagtctgccctgactcagcctccctcgccgtccgggtctcctggacagtcagtccaccattcctccgtnacacgtcggggaaccagccaggtcgaactagttcgggtaccttaataactattcgtacctccgtacggttaaccaacaactaactccgaggaccaaaaccgccccctaaaacgtcgttagtacttcgtggacggtacaagtacgccggtcctaggccgggtcctagtactcgtcttactgtacggtcaccgtactcgaggaccaacgtaccggtccctcctacgtaccgtctcggttggcctacgagtacgttaggagtgtacggacgtactacgtaacttaaacttcgacacgtacgacttcgttaacgttacggaccgtacgggtactaacggtacccgttaacggttaaccgtaccggtttaaccgggaccggggtaaaaccgggtaaccggtaacgtaccgtaaccgggtaccccgttaccggttaacgggtaccgtaaacccccgggtaccgaaaccgggtccctttaacccccggggcccccgtttacccggg

SEQ ID NO: 119143 - DNA, 745 bp, Homo sapiens
  misc_feature: GYAE6OF01AFSMN.5.86.H09.1.454.CMB.1.raw
  modified_base (295)..(295): a, c, t, g, unknown or other
  misc_feature (295)..(295): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctcgccctgactcagccctccctccggcgtccggtctccgtggacacgtcagtccacgattcctcctgccacgtcgggaccagcagtcgactagttggtacgttataactgtcgtctccgtacgtaaccaacaacncgtaccgaggaccaaaccgacccctaaacgtcgtacgtacttcgtacggaggtactaaggttaacggccggtccgtacggacggggttccctaggtcgttaccgttccgttccttcggtacggtaccgttaccgtaacggttcgttacggaccctaacgtacccggtccctacccgtacgtaccgtccgtcggtcggtacctaccgacggtaccgtagggacggtacgttacggacggtcgttacgtaacgttacgttaccgtacgtacgtaccgtccgttacgtacgtttaccggacgtacggtacctacggttacccgttactaccggttacggttaccgggacggggtaacggtaacccggtacgtcccggtaaccggtcccggttaccgtaacgggttcccgacccgtaccggtaacccgtcccgtccccgtacccgggttacccg

SEQ ID NO: 119144 - DNA, 771 bp, Homo sapiens
  misc_feature: GYAE6OF01BKIVG.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcgagggcacagggtcctgggcccagtctgccctgactcacgcctccctccgcgtccggtctccgtggactgtcacgtcaccattctcctgcacgtcgggaccagcagtagactgttggttacttaagtaactagtcgttcctccgttacggtaaccaacaaccataccgacggaccaaaaccgacccccgtaaacttcggttagtacgttttccgaggtacggtactaaggtaacggcccggtacccgtcggtaccgggtcccttgacgttcgtccttctcgtccgtcctaccgtacgtcgtacggaccaaccgtccgtccctccgtcggtacccgttcgtcgtccggtacctaccgtagtacgtacggaggtaccggtaggtacggtcctaacgtaacgtttacgttactcgacgtaccgtcgttaccgtacgtttcgacgggtacggtactaccgggttacccgttacgttaccggttaccgggtccgggtaaccggggttaaccggaaccccggtacggttaccccggttaacccgggttaccccggttaccgttaaccggggaccccgtaacccgggttaccccggaacccgggttcccccggttccccccggggtttccccgtaaccccggg

SEQ ID NO: 119145 - DNA, 688 bp, Homo sapiens
  misc_feature: GYAE6OF01AGXLY.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtgggaccagcagtgactattggtacgttaataactatcgttcctccgtaggtacccaacaaccactccaacggacaaaaccgccccccaaaacgtccgtgtactttcgaggtaggtcaaggtacgccggccctcgacgggtccctggactcgtcttctcgtcgcctaccgagtcgtcgaccaacgccgtccctccgtcgaccgtcgtcgtcgggtcctccgtacgacgtaggacggtacgtacggacggcgtacgtacgttacttacgtacgcgtacgtcgttaccgtacgtttcgaccgtacggccgtacggtacccgttacgttaccgttccgggttacggggaccggggtaaccgggtaacccgaacgggtaccggtaccggtaccccggttacccggttaacggtaccgtacccggtacccgggtaacccggtccgtccccggtcccccggttacccgg

SEQ ID NO: 119146 - DNA, 667 bp, Homo sapiens
  misc_feature: GYAE6OF01C14GD.5.86.H09.1.454.CMB.1.raw
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (271)..(271): a, c, t, g, unknown or other
  misc_feature (271)..(271): n is a, c, g, or t
tcagatcagacacgcacgaccggtgctcgatttagtgctatagactttggggtttgggggctggggtctcaggaggcagcgctctcaggacgtcaccaccagtcggcctgggctctgctcctcctcaccctctcactcgagggcacgagggtcctcgggccctaggtctggccctgactcgacgccctccgtccgcgtccggtctcgtggacagtcagtcactntctcngcagtcggacagctagcgtactgtttggtacgttataacgtntcgtctcgtagtaaccaacacataccgagacaaccgaccccaatcgtagtattcgagacgtacagtacgccgcctaggacgggtccagtacgtcgtacttcgtcgtcgtcctaccgtaacgtcgacgtacgaaccgtaccggtcccttaccgacgttccgtccgtgacggtctaccgtagtacgtaggaacgtaagtacggacgtacgtacgtaacgtttacgtacgacgtacgacgtcgtacgttcgttacgggaacgttacggaccgtaacgttaccgttaacgttaccggtcgggttaccgggaaccggtaacgggacgtacggtaccggtacggtccgtacggtacgtaaccgacggtaccacgggttaccgtccccggtccccgttaacgg

SEQ ID NO: 119147 - DNA, 688 bp, Homo sapiens
  misc_feature: GYAE6OF01EYZ61.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacgagggtcctgggcccagtctgccctgactcacgtccctcccgtcgcgttccggtctccgtggacagtcagtccactatctcctgccacgtcgggaccagcagtcactgttggttacgttaactaacttatcgttcctccgttacggtaacccaaacaaactactaccgaggtaccaaaaccgaccccctaaaagttcgtagtaactttcgtaggtacggtctaaggtaacgccgggtaccctcggtacgggttccctgactcgtctttacgtcgtcgtctaccgtaagtctacggacaccgtccgtcctccgtcgtaccttcgtcgtcggtctccgagacgtaggacgtagtacggacggtcttagtaacttacgtcgtcgacgcgttactcgttaattcggacgtagtaccgtacggtaccgtaacttaccggttccggttacgggaccgggtaacggaaccgtacggtacccggttaccggttcccggtaccgtacggccctaaccggtcccgaacggtcccgtaccccgtccccggttacccgg

SEQ ID NO: 119148 - DNA, 764 bp, Homo sapiens
  misc_feature: GYAE6OF01BCSKS.5.86.H09.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
tcagatcagacacgcacgaccggtgctcgatttagtgctatagacttggggtttgggggctggggtctcaggaggcagcgctctcaggacgtcaccaccatggcctgggctctgctcctcctcaccctcctcactcagggcacgagggtcctgggcccagtctgccctgactcagccctccctccgccgtccgggtctccnggacngtcagtccaccatctcctgcacgtcgggaccagcagtgactagtttcggtacttaataactatgttacctaccgtcgtaaccaaacaacactaccgaacggaccaaaaccgacccccctaaacgttcgtacgtacttttacgaggtacggtactaacggtaacggcccggtccccgtacggtaaccgggggttccctggtactcggtcctttccgtacgtcggtacctacccgtaacgttcgacggtacccaaccgtacccggtccctcccgtacgtacccgtccgtcgtcggcctaccgtagacgtaggacggtagtacggagtacgtagtaaccgttattacgtacgtacgacgtcttaccgtagttacgaccggtacggtacgtaaccggttacgtaacgttaccgttaccgggttccggggaaccgggtaacggggtaacccgtaaccgggtacccggttaaccggtaacccccgggtttacgtaacccgggttaaccgaacccggtaaccccgggtacccggcccggttccccggttccccccggtaacccgg

SEQ ID NO: 119149 - DNA, 727 bp, Homo sapiens
  misc_feature: GYAE6OF01DC0UE.5.86.H09.1.454.CMB.1.raw
  modified_base (558)..(558): a, c, t, g, unknown or other
  misc_feature (558)..(558): n is a, c, g, or t
  modified_base (574)..(574): a, c, t, g, unknown or other
  misc_feature (574)..(574): n is a, c, g, or t
  modified_base (629)..(629): a, c, t, g, unknown or other
  misc_feature (629)..(629): n is a, c, g, or t
tcagatcagacacgcacgaccggtgctcgatttagtgctatagacttggggtttgggggctggggtctcaggaggcagcgctctcaggactcaccaccatggcctgggctctgcctcctcctcaccctctcactcgaggcacgagggtcctcgggcccagtcctcgccctgactcacgccctcccgccgtcggtccggttctccgtgggactaggtcacgtccacctatccgtaccgtgaccgtacggtcgggaaccaggtctaggtacgtacttaggtttcggttacttaaataacttgttccgtccgttaccgtacggtaaacccaaacgtaactaccgtaccgaacggaaacctaaaaccccgacccctaaagttcgttacgttactttaccggaggtacgtacgaacggtaccgccccgtacgtaccgggtaccggttccctagtacggtccttctccgtcggtccgtaccctacgacggtccgtacggaaccctaccgggtccgttcccctaccggtacgttaccgtcggtcggtccgacctagacggtacgnggtacgaggtgacgtntacgtacttacgtcgcgatcggtcttacgtgttcggagtaccgcgtacgttaacncgttacggtccggtacggacggtaaccggacgtcgtacggtacccggtaccgtcgacgtccgaccgttaccggaccgttccaccccggttccggtacc

SEQ ID NO: 119150 - DNA, 682 bp, Homo sapiens
  misc_feature: GYAE6OF01DPZ4X.5.86.H09.1.454.CMB.1.raw
  modified_base (252)..(252): a, c, t, g, unknown or other
  misc_feature (252)..(252): n is a, c, g, or t
  modified_base (283)..(283): a, c, t, g, unknown or other
  misc_feature (283)..(283): n is a, c, g, or t
  modified_base (359)..(359): a, c, t, g, unknown or other
  misc_feature (359)..(359): n is a, c, g, or t
  modified_base (519)..(519): a, c, t, g, unknown or other
  misc_feature (519)..(519): n is a, c, g, or t
tcagatcagacacgcacgaccggtgctcgatttagtgctatagacttgggtttgggggctggggtctcaggaggcagcgctctcaggacgtcaccaccatggcctgggctctgcctcctcctcaccctcctcactcgaggcaacgagggtcctcgggcccagtctcgccctgactcacgtccctcccgtccggcggtccggtctccgtgactgtcagtccacctactctccgtgctacggtcggaccagccngtgacgtagtttcggtacgttaactaacgtnttcgtccttaccgtacgtaacccaaacaacactcgaacggtaacaacccgacccctaaactcggtacttcttacgnggtaacgtaccgagtaaccgccgtccgtacgttaccgggcctagtaccgtcgtcttcgttcgtccggcctacgtacgtccgcggacacccgaccgtccctccgtcgtaccctcggtcgtcggaacccgtcgtacgtagagggtacgtagtacggacgttntacgtaaccttacgtcgtcgtaactcgtactgttacgcgtacgtacgctaacgtacttacgtccgttcggtacgggtaccgacgtaaccgtcgttaccggtacgtacccgtccgtaacggtcccgtaaacgcccggaccgttaccggccccgtcccgtacggg

SEQ ID NO: 119151 - DNA, 1044 bp, Homo sapiens
  misc_feature: GYAE6OF01EXW7B.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctcgtggattcctaccttttactgtagttttggctagtgacggtcgggtccgccgaggccgtccggaaggggaacgggtcgtacgggacgttcgggccttctaactaaaattaagtttaaaagtagggtaaaaacggactaaagttaactaacgaaacgacctaacaaccgacggtaaccgttccggtagggaacggggtcccggttaccaacccgtaaccgtacggaacgaacgaaccgtaaccgtaccgggaacgggaccgtaaccggggttaccgttaaaccccgtaacgtaaccgaagttacggaaacccgtacggtacccgtagggaaacggtaccggaacccggggaaggtaacccgtaaccgggtacccgtttaaagttaacgttttaacggttacgggttaaggggtaacggggtaaacgggggttaaaccggttcgggggttaaaccttaaacggtttccggggaaacccggtcgggttaacccgggggaaccccgttaaacccggggttaacccggttcgggttaaccccgttaccccggtttaccctaccccggttaccgaaccccggttacccccgttaaccccggaacccgggtaaacccggggtaccccccttaccggtttaccccccgggtttcccccgtttccccccgggtaccgggtccccccgtaccccggttccggaccccgtttacccgggaaaccgggtccccgtaaccccgtaccccggttaacccggaacggtaacccgcccgaaccgggtacccgggcccgggtaccccggttcggggacccccgttcgggtacccgttaacgggtaacccggtaaccgggttacccctttacccggtccggttaacggttccgtaacgtcggttcgcgggtacccgggg

SEQ ID NO: 119152 - DNA, 796 bp, Homo sapiens
  misc_feature: GYAE6OF01D8HX6.5.86.H09.1.454.CMB.1.raw
  modified_base (257)..(257): a, c, t, g, unknown or other
  misc_feature (257)..(257): n is a, c, g, or t
tcagatcagacacgcacgaccggtgctcgatttagtgctatagacgttggggtttggggggctggggtctcaggaggcagcgctctcaggacgtcaccaccatggcctgggctctgctcctcctcaccctcctcactcgagggcacgagggtcctcgggcccagtctgccctgactcacgtccctcccgccgtcggtccggtctccgtggacctagtcacgtcacctatcctcctgccacgtcgggaccagtcagtnactagttcggttacttaatactattcgtctccgtagtaaaccaacaacgtactaccgacggaaccaaacccgtacccccaaagttcgttaacggttactttcgtagggtaacgtacgtaacggttaaccgcccggtacccgtaccgggtaaccggggttcctacggtaccttccggttcctttccgttcggtcgtaccctacgtaacggtcgtaacgggacctaaccgtacccggtccccttacccggtacgtacccgttcgtaccggttccggacctcgtaacggtcgtaggaacggtacggtaggacggtcgttaacttaacgttacgtttaccgtcgtccgtacgttactcgtttaacggttcgggaaccgtacgggtacgtaaccggttacttaaccgtttccggggtccgggttccgggggaacgggaacccgggaaaccggttcgtacccgggttacccggtacccggttaccggtacggaacccggtacccggacccgaacgggttccccgtaccccggttccgttacccgg

SEQ ID NO: 119153 - DNA, 832 bp, Homo sapiens
  misc_feature: GYAE6OF01BC0YJ.5.86.H09.1.454.CMB.1.raw
tcagatcagacacgcacgaccggtgctcgatttagtgctatagacttgggtttgggggtgctcgatttagtgctatagacgttgggtttgggatctacgttgcaggtgtaggtctgggtccctgagactctcctgtgcagcctctggacttccaccttttactgtagttttggctagtcggacggttcggggtcccgccgacgggcctaccggaggggaacgggcgtacggacgttcggccttactaacgaaaattaagttaaagtagggtaaaaggactaaagtaactaacaaagactacactacgacgtccgtaggaacggtccgttacaccaccgtacggagaacgacaaccgtacggaacggactacggtacgtaacctacacatacgaaccgtacgcgtaggacgaggcccggaacggaccgaccggttacgtaacgttagttacgtttaggtaagggtagggaaacggggtaacggtggggtaacctaaggtttccgaccgggtacggttacggggaccccgaacggggtacccgtcgggtaccgtcccgttaccgttcccgtaccgtaccgtacccctaacccgaacccggtaacccgggaccctaccgttaccccgggttccccttacccccgtccgggtaccgtcccccgtaccggcccttaccggacccgaccggtacccacccggttaaccggaccgacggtaacccgacgccgggtacccgcccggttcggtcccgtcgcccggttaggtaacccgtaaccggtcccgttaacccgtcccggttacggttcctaacggtacgttccgtacgggtaccggg

SEQ ID NO: 119154 - DNA, 709 bp, Homo sapiens
  misc_feature: GYAE6OF01A2BK3.5.86.H09.1.454.CMB.1.raw
  modified_base (502)..(502): a, c, t, g, unknown or other
  misc_feature (502)..(502): n is a, c, g, or t
  modified_base (517)..(517): a, c, t, g, unknown or other
  misc_feature (517)..(517): n is a, c, g, or t
tcagatcagacacgcacgaccggtgctcgatttagtgctatagacttgggtttgggggctggggtctcagggaggcagcgctctcaggacgtcaccaccatggcctgggctctgctcctcctcaccctctcactcagggcacgagggtcctgggccctagtctcgccctgactcacgcctcccgtccgcgtccggtctcgtggacagtcagtcacctatctacctgccaacgtcggaccagtcagtcgaactgtttacggtacttaataactgtcgtccttaccgtagtaacccaacaactactccgaacggacaaaaccgtccccaaagttcgtagtactttcgaggtacgtctaaggtacgccgtacccgtcggtacggtcctaacgcgtccgttctcgtcgtacggtcctaccgtaacggtctcggacccgtaacgacccggtccctcccgtacgttaccttccgtaccggtcggtaccgtccgtaaggtcgtaacggngtaacgtaggtccgngttaacgacgttaacgttcgtaacggctaccggtcttaccgttaaggtcgtacgggtaacgccgtacttacccggttacgtaaccggtttccggaacgggtcggaaaccggtaacgtacggtccctagggtccccttaggtacctacccggtacggaccccaaagggttcccctcccggtaacccgtcccgg

SEQ ID NO: 119155 - DNA, 822 bp, Homo sapiens
  misc_feature: GYAE6OF01C7U6A.5.86.H09.1.454.CMB.1.raw
  modified_base (207)..(207): a, c, t, g, unknown or other
  misc_feature (207)..(207): n is a, c, g, or t
  modified_base (268)..(268): a, c, t, g, unknown or other
  misc_feature (268)..(268): n is a, c, g, or t
tcagatcagacacgcacgaccggtgctcgatttagtgctatagacttgggtttgggggctggggtctcagggaggcagcgctctcaggacgtcaccaccatggcctgggctctgctcctcctcaccctctcactcgagggcacgagggtcctgggcccagtctgccctgactcacgccctccctccgcgtccgggtctccgtggacngtcacgtcacctatcctcctgccacgtcgggaccagcagtgactagtttggcttaatactnttcgtcttccgtacgtaaccaaacaactctaccaaggaccaaaacccgaccccctaaacgttcggtacgttaacttttccggtaggacggttacgtaacggtaaccggccccggtacccgttcgggaaccggggttcccctaggtaccgttccgtaccgtttcgtccggtcgtacccgttacgtacggttaccgtacggtacccgaaacgtccccggtcccttacccgtaccgggttcccgttccggttcccggttccgggtccccttaccggaacgggtaaccgttagggtaacgggtacgtacgggtacgggttcgtaaccggtttaacttaacgtttaccgcggtactacgttccttacgttacgtttccggaacggtacgtaccgaacgtttccggtttaacgtccggtttacccggggttccgggaaaccggggtacggtaaccgtaaccgggttccgttacccgggtttaacccgtacccgggttaacgacccggtaacccggaaccgggtcccggtacccgttccccgggttccccccggtttacgg

SEQ ID NO: 119156 - DNA, 623 bp, Homo sapiens
  misc_feature: GYAE6OF01B75CO.5.86.H09.1.454.CMB.1.raw
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
  modified_base (472)..(472): a, c, t, g, unknown or other
  misc_feature (472)..(472): n is a, c, g, or t
tcagatcagacacgcacgaccggtgctcgatttagtgctatagacttgggtttgggggctggggtctcaggaggcagcgctctcaggacgtcaccaccatggcctgggctctgcctcctcctcaccctcctcactcgagggcacgagggtcctgggcccagtctcgccctgactcagccctcctccgcgtccggtctccgtgactgtcagtcaccntcctcctgcacgtcggaccngcagtnactagttcggtacttatactntcgtcctcgtcgtaaccaacaacactcgacggaccaaccgacccctaagtcgtacgtatttcgagacggtacaacggtacgccggtaccctacggtaccggggtccctagtaccgtcgtcttacgtcgtccgtactacgagtcgacgaccaccgtaccgtccctccgtgtacccgtcgtccgtcggtcctacacggtacgtcgagtcgnggtacggtctacgtacttagtcgtcgactactacgtctacgtcgacgtacgtctacggtaccttagtccgtccggtacgggcggtaccggaccgtacgtcgtacggtccgcgtaacgcctaaccggacgtacggccctcgtccccggtacg

SEQ ID NO: 119157 - DNA, 877 bp, Homo sapiens
  misc_feature: GYAE6OF01DSQQ8.5.86.H09.1.454.CMB.1.raw
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
  modified_base (853)..(853): a, c, t, g, unknown or other
  misc_feature (853)..(853): n is a, c, g, or t
tcagatcagacacgcacgaccggtgctcgatttagtgctatagacttggggtttgggggctgggtctcaggaggcagcgctctcaggacgtcaccaccagtcggccgtgggcttctgcctcctcctcaccctctcacgtcgaggcacgacggttccgtcggccctagtctcgccctgacctcaccgtcccttccgcggtccggtccggtcctccgtgacagtcgacgtccactntcctccgtcgacacggtcggaaccngactaggtacgtaacgttagtttcggttactttaaacttaacgtagttcgttccttaaccgttaccggttaaaccaaactaaccgtacctaccgaacggtaaacccaaaaccccgtacccctaaacggttcggtttacgttaactttccgggtaaggtaacggtacggtaaccgtaaccgggtccccggtccggttaaccgggggtaaccggttactacgggttctttaccggtttccgttccgtaaccggttacgtaccgttaaccggtaacgtccgaaacggtaccccgtaaccgtcccggttcccttaccggtcggttaccgttcgttcccgggtacgggtacccctacgaacgggttacgtaggggtaccggtaagtacgggtaccgtttcgtaaaccggtttactttacgttccggtacgccctttaaacgggttcttacgggtttaccgaacggacgggttaccccgttaggtaccccgttttaccgttaaccggttccggttcgggaaaccgggtaccggtaaccgtaaccggtcctaccggggtactaccgttccggtacggaacccgtccgaaccgggttacccncccccgggtacgttccccggtccg

SEQ ID NO: 119158 - DNA, 804 bp, Homo sapiens
  misc_feature: GYAE6OF01ACWAB.5.86.H09.1.454.CMB.1.raw
  modified_base (124)..(124): a, c, t, g, unknown or other
  misc_feature (124)..(124): n is a, c, g, or t
  modified_base (218)..(218): a, c, t, g, unknown or other
  misc_feature (218)..(218): n is a, c, g, or t
tcagatcagacacgcacgaccggtgctcgatttagtgctatagacttggggtttggggggctgggggtctcaggaggcagcgctctcaggacgtcaccaccatggcctgggctctgctcctccncaccctcctcactcgagggcacgcgggtccgtcgggcccagtctcgcccgtgactcgacgccctccctccggccgtccgggtctccgtaggacncgtcgacgtccacctatcctcctgcctacgtcggggacagcgagtcgactagttcggttacttaagtaactcttcggttcctcggtacgtaacccaactaaccgtcgtaccgaacggaacctaaaaccccgacccccctaaaggttcgtacggttacgtttagacgggtaacggttcgtaacgggtaaccggcccggttaccgtaccgggtacggggtcctaggtaccgtccggttcttaccggtcgacgtcccttaacggtacgtccggacggaccaaccggtaccctcccgtcccggtagttcccgtcgggttaccgtcgggtacccaggtcgaagggtcgaacggtacggtacgggtaccacgggtttaatacccgtttacgttccgacgggttcttaaccgtcgtttcgtaaccgttggaaacccgcggttaccgtacccgttaccgttacggttaccggttccggaacggggacccgggaggtaaaccggtccgtaccgggtaacccggttacggttaccggtacggaaccgtaccgtaccccgggttaacggcccccgttaccccgggtcccctttcggg

SEQ ID NO: 119159 - DNA, 938 bp, Homo sapiens
  misc_feature: GYAE6OF01C3VJ5.5.86.H09.1.454.CMB.1.raw
tcagatcagacacgcacgaccggtgctcgatttagtgctatagacttggggtttgggggtgctcgatttagtgctatagacttgggtttgggatctacgttgcaggtgtaggtctgggtccctgagactctcctgtgcacgcctcgtggtacttcctaccttttacgtgtagttttggactagtcggtacggtcgggtcccgccgacgggtccgtaccggaagggggaacggggtccgtgggtaacctgggtacctctaactaaaaattaagttaaaggtaagggttaaaacgactaaaattactaaacgaacgtaacctacaacgacgtaacgtccggtaggaaccgggtcccgttaccaccgaccgtacgaacgaccgaaccaaccgtacggaacgggtaacctacgggttacctaaaccctacaaccgtaagacgaaaccgacggtccgtagaacgaccgaccggaaggtaccaccggtacgttaattacgttagttaggaggtaacggggaacgggtaacggtcgggtaataaacggtttccggacggtcgggtaccgggaccgtaaccggtacccgttcggaccgtacccggtccgttacccgaccgtacccgtaccccgtaacccggtaaccgggaacccggttcccgtaacccggtttcccgggtttaaccccccgttcccccggtacgggtcccccgtcccgtttaacccgggacccgttaacccgggaaccggaccccgttacccgtaaccccgggacccggtaaccgaccgtaccggaaacccgggtccccggtcccggggttacccggtccgggtaccgtacccggggtacccggttttaacgggaacccggttaacccgggttaaccccgttccgggtttaccccggttgttaaccgttacgccgtttcgggacgggtacccgggg

SEQ ID NO: 119160 - DNA, 718 bp, Homo sapiens
  misc_feature: GYAE6OF01ATCSN.5.86.H09.1.454.CMB.1.raw
  modified_base (374)..(374): a, c, t, g, unknown or other
  misc_feature (374)..(374): n is a, c, g, or t
  modified_base (562)..(562): a, c, t, g, unknown or other
  misc_feature (562)..(562): n is a, c, g, or t
tcagatcagacacgcacgaccggtgctcgatttagtgctatagacttggggtttgggggctggggtctcaggaggcagcgctctcagggacgtcaccacatggcctgggctctgctcctcctcacctctcactcagggcacgacgggtcctcgggcccagtctcgccctgactcgacgtccctccctccggtccgtcccgggttctccgtacggactgtccacgtccacctcgttcctccgtcgacctacgtcggggaccaggccgaaggtctaacttggttaggttacttaattactattcgtccttccgtacgtaaccaaactacacgtccgaacggaccaacccgaccccaaagtcgttacgtacgttacnggacggttacgtaacggcggtaccgccttagggaccggggttctacgacgtttcctcgttctacggtacgtcctacgtacggtcgaccgtacgaccggtcctcccgtaccgtcgtaccgttccgtcgtccggactccgaacgtacggtagacggtacgtacggcgtacgttagtctttacgtatcggntaccgttcgtactaggtttccgaggtaccgtccgtacgttacctacggtccgttaggttccggggacgggacggtaaccgcggtcccggtaccctacgggttccgtaactcgggtaacccgccggaacccgtccggttcccgaacccggttccccg

SEQ ID NO: 119161 - DNA, 891 bp, Homo sapiens
  misc_feature: GYAE6OF01DEYMQ.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcgagggcacgagggtcctgggcccagtctcgccctgactcgacgccctcccgtccgccggtccggtctccgtaggactacgtaccgtacgtccaacctcttccgtccgtcgaccgtacggtacgggaaccaggaccgtagttcggaacttggttttacgggttactttaaacgttaacttcgttcggtaccgttaccgtaacgtaaacccaaactaactaccgtaccgaacggaacctaaacccgaaccccgtaaacgttcgtacgttacgtttacggtaggtacgtacgtaaggtaaccggtcccgtacccggtacgggacccggggttacctagtaccgttccggttccgtttccgtacggccggtaccgttaacgtacggtcggtacgaaccgtaaccgcccggttacccttacccgtacggttacccgttcgtccggtcgggtaccctaccggtaaggtaccgttagggaacggtacggtcgggtacggtacttacgttaacgtttacgtaccgtagtaccgtacgttcgtttaactcgggtttacaaccgggtggtaaaccgtccggtttaacccgttaccggtttaccggttaccgggttcccgggggaaaccgggtaacccggtaaacccggttacggtacccgggtttaaccccggtaccgggttaaccccgggtttagaaccccgggtacccgggtaaacccgggtacccggttcccccgtaacccccggggtttcccccggttaccgg

SEQ ID NO: 119162 - DNA, 668 bp, Homo sapiens
  misc_feature: GYAE6OF01A3DXX.5.86.H09.1.454.CMB.1.raw
  modified_base (183)..(183): a, c, t, g, unknown or other
  misc_feature (183)..(183): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
  modified_base (356)..(356): a, c, t, g, unknown or other
  misc_feature (356)..(356): n is a, c, g, or t
  modified_base (560)..(560): a, c, t, g, unknown or other
  misc_feature (560)..(560): n is a, c, g, or t
tcagatcagacacgcacgaccggtgctcgatttagtgctatagacttggggtttgggggtgctcgatttagtgctatagacttgggtttgggatctacgttgcaggtgtaggtctgggtccctgagactctcctgtgcagcctctggattcacctttactgattttggcatgacgtgggtccncaggctccgaggggaagggctggactggctctacaaatattaatggtaaagcaatatacaagactacacagactccgtagaagggccggttacaccacctcgagagacactacaggacacggtntacctanacagtagaacagctagagacgcgaggacacgcctatatatgngtggagggtaacgtggggactaagttcgaccgcgtacggggaccgaacgggtaacccgtcgggtacaacccgttccgtacctccgaacgtccccaccgaaccgtaaccgggccctacgttcgggttaccccttcccccgtaggccccgtacccgtcgtacccgtccgaaggaccgcctacccgtaccggaagaccgaccgaccncgggcccgcccggttcgggacgtcggacccgttggtaacccgaaacgggttaacccttacccgggttcccgttcggttaccttacggcttcccgtggggtaaccgggg

SEQ ID NO: 119163 - DNA, 816 bp, Homo sapiens
  misc_feature: GYAE6OF01AOMBO.5.86.H09.1.454.CMB.1.raw
  modified_base (801)..(801): a, c, t, g, unknown or other
  misc_feature (801)..(801): n is a, c, g, or t
tcagatcagacacgcacgaccggtgctcgatttagtgctatagacttgggtttgggggtgctcgatttagtgctatagacttgggtttggatctacgttgcaggtgtaggtctcgggtccctgagactctcctgtagcacgcctcgtggtacttcctaccttttacgtgtagttttggctagtgtacggtcggtccgaccgaggtaccgtaccggaaggggagggcctagggtactggtctcgtaacaaaagtttagttaaggtaagggtaaaggtactaaagttaacgaaccgtaaagaaccttaaccgacgacggtacccgtacggttaaggaacggggtcccgtttacaaccccgtaccgtacggaacgaacgtaaccaaccgtcggaacggacgtacggtacgtaaccctaacgaacagtacgaacgcgtaccgtaggacgccggaacgacggaccgtacgtaccgtagttactttgtagggtacgtaaggggaacgggtaacggtttcggggtaaccttaaaggtttccgggaccggaggggttccggaccggtaacgggacccgttcggacccgtaccgttacgtccctaccgacccggtacccctacccgggaaccggtaaccggacccgttaccgttccccgggttaccccttccccgacgggtacccctccgtccgacccgtaccggacggtcccacccgtacgtcgtacgaccgtactaccggccggtccggtacccgcgggacgtccggtaccgtttaggaacgtaccgttccgtaccggtcctagtcgntaacgtcgtgggacg

SEQ ID NO: 119164 - DNA, 792 bp, Homo sapiens
  misc_feature: GYAE6OF01DILBW.5.86.H09.1.454.CMB.1.raw
  modified_base (146)..(146): a, c, t, g, unknown or other
  misc_feature (146)..(146): n is a, c, g, or t
  modified_base (265)..(265): a, c, t, g, unknown or other
  misc_feature (265)..(265): n is a, c, g, or t
tcagatcagacacgcacgaccggtgctcgatttagtgctatagacgttgggtttgggggctggggtctcaggaggcagcgctctcaggacgtcaccacatggcctgggctctgcctcctcctccaccctctcactcgagggcacgngggtcctcgggccctaggtctcgccctgacctcacgcccttcccgtccggtcggttccgggtccttccgaggactagtcacgtaccacctactcctaccgtcgacgacgtcgggaaccnggtacgagtcgaactgtttcggtaatttaactacttagttcgtaccgttaccgttaacgtaaaccaaacgtaacgtacctaccggaacggaacccctaaacccggaacccccttaaaagtcggttattaacgtttcgacgggtacgtacgtaacggtaccggccgtaacccgtcggtaacgggtcctagtacgttccgtcttcgtacggctaccgtacgtaacggttccaacggaccgtaaaccgcccgtacccgttaccggttacgtccttaccggtccggtccggtaacctacgtaacgggttcggacgtaagggactacgggtgtaccttacgtaactttacggttcgtaccgacggtacttcgttaaacgttggttaccggacgtacgggtacctaacgttaccgttacggttacgtccgggtaacggggacggtacggaacgtaaccggtcggtaaccgtccggtaaccgtcgaacccgtaccggaacccggtaggttcccgacccggttcccgtaacccgg

SEQ ID NO: 119165 - DNA, 671 bp, Homo sapiens
  misc_feature: GYAE6OF01DI4C7.5.86.H09.1.454.CMB.1.raw
  modified_base (122)..(122): a, c, t, g, unknown or other
  misc_feature (122)..(122): n is a, c, g, or t
  modified_base (142)..(142): a, c, t, g, unknown or other
  misc_feature (142)..(142): n is a, c, g, or t
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (516)..(516): a, c, t, g, unknown or other
  misc_feature (516)..(516): n is a, c, g, or t
  modified_base (539)..(539): a, c, t, g, unknown or other
  misc_feature (539)..(539): n is a, c, g, or t
tcagatcagacacgcacgaccggtgctcgatttagtgctatagacttgggtttgggggctggggtctcaggaggcagcgctctcaggacgtcaccacatggcctgggctctgctcctcctcnccctctcactcgaggcacgnggtcctcgggcctagtctcgccctagactcacgccctccctcggccggtcggtacctcgnggaactgtcgactccacntcncctggacctacgtcgggaccagcgtacgtgaactggttcgtagttaactaattagtcgtaccgtaccttcggtaaacctaacgaactacgtaccgaaggaaccctaaaccgtaccccccgtaaatcggttacgttacttcgtacgggtaacgtacgtaacggtaaccggtcccggacccgttaacgggacccgggttcctgggtaactccgttcttacgtcgtacggctacgtcgtcgtacgacctaccaccgtccttccgacggtcctcgtacgtcgctcgaacggtgaggngtacgcggactatacctacgttnacgcgtctctagtcgttagccgataccggtcgttactaccgtaccgtggtaccgggaggtaaccgtcgaaacggtttcgaccgtacgtacgacggtcaccggatacccgcccgtccgaacccgtggtacccg

SEQ ID NO: 119166 - DNA, 615 bp, Homo sapiens
  misc_feature: GYAE6OF01E1C1E.5.86.H09.1.454.CMB.1.raw
  modified_base (266)..(266): a, c, t, g, unknown or other
  misc_feature (266)..(266): n is a, c, g, or t
  modified_base (364)..(364): a, c, t, g, unknown or other
  misc_feature (364)..(364): n is a, c, g, or t
tcagatcagacacgcacgaccggtgctcgatttagtgctatagacttgggtttggggctggggtctcaggaggcagcgctctcaggacgtcaccacatggcctgggctctgctcctcctcaccctctcactcagggcacgagggtcctgggcccagtctgccctgactcagccctccctccgcgttccgggtctccgtggactagtcagtccaccattcctccgtgacacgtgggaccagctagtgactgtttggtcttataactntcgtctccgtgaaccaacacatccaggaccaaacgccccaaatcgtgtatttcgtgagtcaaggtacgccggcctgacgggtcctaggctcgtcttcngtcgactcgtaagtcaggaccaacgtccgccctaccgtcgtaccgttcctcgttcggacctacgacgtacgtagaggtatcggaacgtctagtacctttaacgttactcgcacgtctacgttagtttcgaacgtcggacctaggtaccttacgttaccgttcggttacggacgggaaccggttaacgacgtccgtacggccgttacgtaggccgaaccgtacgaacgtcccgtcccgtccccgttaaccgg

SEQ ID NO: 119167 - DNA, 802 bp, Homo sapiens
  misc_feature: GYAE6OF01AZZII.5.86.H09.1.454.CMB.1.raw
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (661)..(661): a, c, t, g, unknown or other
  misc_feature (661)..(661): n is a, c, g, or t
tcagatcagacacgcacgaccggtgctcgatttagtgctatagactttgggtttgggggctggggtctcaggaggcagcgctctcaggacgtcaccaccatggcctgggctctgctcctcctccaccctcctcactcgagggcacgacgggtccgtcgggcccagtctgccctgactcacgccctcccgtccgcggtccgggtctccgtggacagtcacgtccaccntcctcgtncgacgtcgggaccagactagtacgactaggttcggttacgttaactaacttacttcggttccttaccggttaccgaaccaaactaactacctacccgaacggaaaccccgaaaacccgtacccccgtaaacgttccgttagtttacctttaccgtggtaaacgggtaaccgtaaggtaacccggcccggtaccgttacgggtacccggggttcctacggtaccgttccgttcttacgttccgtacgggtacccttaccggtaacgtttccgggtacgaacccgtaaccggcccgttacccccgttacccggtacgttacccgggtttaccttcgggtacccggtccgtacccggtaacgtaacgtcgggtacggtaggtacggtaccgggtacgttacgtactttaccgtgagtccaagttcctanacggttcaacgttcgggacgtacgttacccttacgttaccgacgggttaccggacggggaactaccgacggtcggttaccggaccggttccgaaacgttaccgaccggtaacccgcgtccccgtacccggtcccggttacg

SEQ ID NO: 119168 - DNA, 781 bp, Homo sapiens
  misc_feature: GYAE6OF01D4S7D.5.86.H09.1.454.CMB.1.raw
  modified_base (121)..(121): a, c, t, g, unknown or other
  misc_feature (121)..(121): n is a, c, g, or t
  modified_base (162)..(162): a, c, t, g, unknown or other
  misc_feature (162)..(162): n is a, c, g, or t
tcagatcagacacgcacgaccggtgctcgatttagtgctatagactgggtttgggggctggggtctcaggaggcagcgctctcaggacgtcaccaccatggcctgggctctgcctcctccncaccctctcactcagggcacgagggtcctgggcccagtctnccctgctcacgccctcccgtccgcgtccgggtactccgtcggatacgtcagtccacctactcgttccctgcctaacgtcgggaccaacggtcaagtcgacttagttggttaccgtttaataactattcggttcctccgtacggtaacctaacaaccgataccgaacgaccaaccgaacccctaaaccgttcgttagtactttccgaggttacggtacgtaacgtacggcccggtaccctcggtaccggggttaccctgtaccgttccgtcgtttaccgtgttcccggtactaccgtaaacgtcgtaaccggaccgtaaacccggtacccgtccccgtcccgtacgttacccgtccgttccggtccggtactccgaagttccgaggtacgtacggacggtacgggtagtaccgtacgttacgttaacgcgtaccgtacgtccttaaccttacgggttttaccggagttaacccgtccggtacggttaccggttaacgttaccgttacgggttacccggggacggaaccggtaccggacgttaccggttcccgtaaaccccggttcggtacccgtaacgaccccggtaaccgttacgtaccccgtcccgtccccggtaccg

SEQ ID NO: 119169 - DNA, 735 bp, Homo sapiens
  misc_feature: GYAE6OF01AOCT3.5.86.H09.1.454.CMB.1.raw
  modified_base (146)..(146): a, c, t, g, unknown or other
  misc_feature (146)..(146): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (276)..(276): a, c, t, g, unknown or other
  misc_feature (276)..(276): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctcctcactcgagggcacgngggtcctgggccctagtctcgccctgactcacgccctccctcgcgtccgggtctccgtgactagtcacgtccacctactcctcgtcncgtacgtcgggaccagcngtagactagttggtacttataactntcgtctccgtacgtaaccaacacactaccgacggaaccaaccgtacccccaagttccgtacgttacgtttcggaacgtacggttacgtaacggtaacggtccggtaccctacgggtaccgggtaccgtcgtaccgttcgttaccttccgtcggtacgtacctacgtacgtcgtacgaacctaccgtaccggtaccctccgtaccggtaccgtcgttccgtcgggtcctaacgacgttacgcggtaacgtcggtacgtacggttacgtacgttacttacgtaccgtacgacgtactcgtttacgtacgttccggacgtacggtacgtacccggttcttaacgtcgttaccgggccggtaacgggtacccggaacgtacggtaccttacccgggtacgttacccgggtacggtacccgtaccggtacccggtaacggccccgttcccggtaccccgtccgg

SEQ ID NO: 119170 - DNA, 708 bp, Homo sapiens
  misc_feature: GYAE6OF01BYXNG.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtctgccctgactcagcctccctcgcgtccggtctctggactgtcagtcacctatctcctgctagtcgggaccagctagtgactagttcggtcgttaactaacttacttagttccctccgttacggtaacccaaacaacactccaaggaaccaaaccgaccccctaaactcggttacgtacttttcgtaggtacggtacgaacggtaaacggcccggtacccgtacggaccggggttccctggacttccgtcgtttcgtccgtcggtccttacgagttcgacggaccgtaacgcccggtccctaccgtacgtcccgtcgtccggtcgggcctacgtagtccgtaggacgtagtcggtacgcttacgacttatccgtagcacgtcgtactttagtcgacgtagaccgtacggttaccttactaccggttcgggttaccggggacgggaaccggtaccgtaacggtaccggtaccgggttaacccggtccggtttacggaaccgtacccggtacccggtaccggtccccgtccccggtccccgggttacccg

SEQ ID NO: 119171 - DNA, 612 bp, Homo sapiens
  misc_feature: GYAE6OF01B594K.5.86.H09.1.454.CMB.1.raw
  modified_base (141)..(141): a, c, t, g, unknown or other
  misc_feature (141)..(141): n is a, c, g, or t
  modified_base (327)..(327): a, c, t, g, unknown or other
  misc_feature (327)..(327): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacngggtcctgggccagtctgccctgactcagccctcctccgcgtccgggtctccgtggacagtcagtcaccatctccgtgacacgtcgggaccaggcagtcgaactagttcggttacgttaataactagtcgttctccgtacgtaccaacaacatccgaggacaaacgaccccaatcgtgtatttcgnggtagtacagtacgccgcctcggacgggtccctgacgtctcttctcgtcggactccgaagtcgcgacaaccgccgtccctccgtcgtccgttactcggtcggcctcgacgtacgtaggacggtagtcggaggtacgtgtaacttacgttacgtcgaacgtcgtacttcgtaacgtttcgacggtacgcgtacgtaccgttacttacgttccggtacggggacggtaacgggactaggcgtaccggccgttgtacgccgaccgcgaacgtccgtccgcccgtaccg

SEQ ID NO: 119172 - DNA, 878 bp, Homo sapiens
  misc_feature: GYAE6OF01DV9QP.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgcctcctcctcaccctcctcactcaggcacaggtctgggcccagtctgccctgactcacgtcctccctccgcgtccggtctcctgacagtcagtcacatcctcctgcacgtacgggaccagcagtacgactagtttcggtacgttaacttaactattcggtccttacccgtaggtaacccaaacgaactactacgacggaaccaaaccgaaccccctaaacgttccggtagttaacttttccgaggtacggttcaacggtaaggtccccggtacccgtcgggtaaccccggggttcctacgggaacttcccgtcctttcgtcggttaccgtacctcccgtaaaggttccgtacgggaacccgaaaccgtccggttccccttacccgggaacgttccccggttccttacgggtcccgggtaccctaaccgttaacggtaacccggttacgggtaacggggtaacttccgggtacggtaccggtttaaacttacccgttaacggtttttaccgaccgttaacggtaacctcccgtttaaacttacgggtttacccggacgggtaacccggtaccgtacccgggttttaacccgtaccggttttaacccgttccccggggtttaacggggacccggggtaaaccgggtaaccgtaaccccgggttccgttaacccggggtaacccggttacccggtaaacgggtaccccctaaccggggtaaaccccgtcccggtacccggttccccccggaccccgtttaacccgggg

SEQ ID NO: 119173 - DNA, 706 bp, Homo sapiens
  misc_feature: GYAE6OF01DTP0O.5.86.H09.1.454.CMB.1.raw
  modified_base (183)..(183): a, c, t, g, unknown or other
  misc_feature (183)..(183): n is a, c, g, or t
  modified_base (366)..(366): a, c, t, g, unknown or other
  misc_feature (366)..(366): n is a, c, g, or t
  modified_base (699)..(699): a, c, t, g, unknown or other
  misc_feature (699)..(699): n is a, c, g, or t
tcagatcagacacgcacgaccggtgctcgatttagtgctatagacgttgggtttgggggtgctcgatttagtgctatagacttgggtttgggatctacgttgcaggtgtaggtctgggtccctgagctctcctgtgcagcctctggattcaccttttactgtattttggcatgacgtggtccnccaggctccgaggggaaggggctggactggcctcgtactaaattagttaagtagggtaaacggacaaatacttaacgaacgtacctaacgtacagtaccgtccggtaggaacgggtccggttaccaacccgtaccgtacgacgaacgtacaaccgtccgaaggaccgacggtacgtaccacanactagaacacgccgtaggacggacgaccggaacggacgaccggtacggttattactttagttggtggtagggtaacgggggaacgtgggggactaaggtttcggaccggtcgtcggggaccgacgggtaacccgtcggtccctacccggtctcccgtacgtcccgacccctacccgaccggaaccggcccgtaccgttccgggttccccttaccccggtcgcccgtcccgtcgccctacgacgaccgcctaccggtacacgctaccgacgcggcccggtcgcgggcgtacgtccggtagacgtacgtacgttccgttccgtcgtactgactgnggtacgg

SEQ ID NO: 119174 - DNA, 785 bp, Homo sapiens
  misc_feature: GYAE6OF01BX13R.5.86.H09.1.454.CMB.1.raw
tcagatcagacacgcacgaccggtgctcgatttagtgctatagacgttgggtttgggggtgctcgatttagtgctatagacttgggtttgggatctacgttgcaggtgtaggtctgggtccctgagactctcctgtgcagcctcgtggattccaccttttactggtattttggcagtgacgtgggtccgccgaggctccgaggggaagggctggactggctctacaaattattaagtggtaaaggctaatactaacaacgactacacacgactccggtagaacgggtccggttccaaccgtaccgtcgaagacgaaccaaccgtccgaagggaccgacggtcgtacctacgactagtagaacgacgccgtaggacgacgaccggaaggacgacggaccgttaatacgtttagttggtcggtagggaacggggtaaacggttggggaacttaaggtttacggaaccggtcggtacggggaccgtaaccggggtaacccgttcggtcccgacccggttccgttaccgtcgaccggtacccctaacccgacccgggaacgggtacccctacggttcccgggttaccccgttccccgtcgggtacccgtccccgtcggtacccgtaccggaaccggaccgtaccccgtaaccgtaccggacgtaccgaccgacgaccgggcccggttaccgggccggtccgtacggcccggtttaggacccggtaaggttaacccgttcccggttacccgtacggttaccgttaccggtctttccgggcggtaccgggg

SEQ ID NO: 119175 - DNA, 780 bp, Homo sapiens
  misc_feature: GYAE6OF01DZE39.5.86.H09.1.454.CMB.1.raw
  modified_base (99)..(99): a, c, t, g, unknown or other
  misc_feature (99)..(99): n is a, c, g, or t
tcagatcagacacgcacgaccggtgctcgatttagtgctatagacgttgggtttgggggctggggtctcaggaggcagcgctctcaggacgtcaccacntcggcctgggcttctgcctcctcctcacccttctcactcgaggcacagggtcctgggcccagtctcgccctgacctcgacgcctcccgtccgccggttccggtctccgtgggaaccagtccagtccacctattccgccttgaccacgtacgggacctagcgtagtcgacttgttcggttagttaataacttatcgttaccgtccgtacgtaaccaaacctactactacgtacggaccaaacccggtcccctaaacgttcgtagttactttcgtacggacggtcgaacgttaacggccgtcccgtaggccggtcctggacctcgttctacgtcgtacggtcctaccggtagttccggactaccgtacccgtccgtcccgtcccgttacggccggttcttcgggtcgtccccgtcgtaacggcttaagggacggttacgaacggtcgtagttacgtaactttcttaccgtcggaacttcgggtactacctttaggttaccgtacgggacgttaccggtccgttaaaccgttccgttccggttacccgggttacggggtaccccgggtaaaccgtaacccgggacgttacccgtaacggttaccccgggtaaccgttccgggtaaaccccgttaccggtccccggtaaagggtcccgttacccccggtaacccgggtttccccg

SEQ ID NO: 119176 - DNA, 810 bp, Homo sapiens
  misc_feature: GYAE6OF01EZSEG.5.86.H09.1.454.CMB.1.raw
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
tcagatcagacacgcacgaccggtgctcgatttagtgctatagacttggggtttcggggggctgggggtctcaggaggcagcgctctcaggacgtcaccacatggcctgggctctgctcctcctcaccctcctcactcagggcacagggtcctgggcccaggtctcgccctgactcngccctccnccgcgtccggtctccgtggacagtcagtccaccatcctctgctacgtgggaccagcagtcgactagttcggttacgttaataactatcgttcctccgtacggtaaccaaacaacgtactaccggaacggtaaccaaaaccccgtaccccctaaaagttcggttacgttaacgttttccggttacggaaaccgggttactaaaacgggttaaccggccccgggttacccctaccggggttaaccgggggtttacccttacgggaacctttcccggtccccttttccgtccggttacccgggtacccttaacccgggtaacggttcccgttaacgggaaaccccgtaaacccgggtaacccccgtccccgttacccgttccgggtaacccgttccgttcccggtaccgggtacctaaccgaacgtacggtaggaacgggtaggtacggaacggttagtaacgtacgttacgtacgtacgtacctacgttctaacgtttcggtccgacgtaggacctacggtaccttcttaacgtccggtaccgggacggtaccgtaaccgacgttcgaccggtccgttacgtacgtaccgaccgccggaaccggtccttccccggacccgttaccgg

SEQ ID NO: 119177 - DNA, 932 bp, Homo sapiens
  misc_feature: GYAE6OF01EON1N.5.86.H09.1.454.CMB.1.raw
  modified_base (313)..(313): a, c, t, g, unknown or other
  misc_feature (313)..(313): n is a, c, g, or t
  modified_base (787)..(787): a, c, t, g, unknown or other
  misc_feature (787)..(787): n is a, c, g, or t
  modified_base (922)..(922): a, c, t, g, unknown or other
  misc_feature (922)..(922): n is a, c, g, or t
tcagatcagacacgcacgaccggtgctcgatttagtgctatagacgttggggtttgggggtgctcgtatttagtgctatagacgttgggtttggatctacgttgcgaggtgtaggtcgtcgggtaccctgagtcctctccgtgttcgcacgtcctcgtggaacttaccgttacctttaagtgttacgtttgactacgtgtacggtccgggtacccgccgaacggtccgtaccgggaaggggaacggtcgtcggtacgtcggtctaccgtaataaattaagtttaaaggtacggtaaagactaataaacgttanaacgtaaccgaacacgtactaccgtacggtaacggtacgggtcccttaaccgaacctaccgtaccggaacgtaaacgtaaccgtaaccctacgggaaccgtaaccggtacgaaccgttaaccacggtaaaccaggtaaccgaccggtaaacgtccgtaacggacggaaacggacccggaaggtaacccgtaccggtaccgttaaattacgtttaagttcggtaacgggtggggtaaaaggtaaccgggggtttcgtaaacggttaggtaacgttcccgggtacggtaaacggggaccgttaaaaccccggggttaccgtacggttacccgtacccggtacccgtaccgttaccggtacccgaacccgtaacccgtaaacccgtccgggtaaccccgtaaccgggtccccgttcccggtttaccccgcccgggtttaccccgtacccgtaccgtccccgacgtacgggtaacccncccgttaaccgaccgtaaccggaccgacgtacccggacggtccccggaccgggtttccgacccggttccgtccggtaaccgttaaccggtccgttaccgacggttcccgttaccgacgggttccgaaacggtcgngtaacccggg

SEQ ID NO: 119178 - DNA, 726 bp, Homo sapiens
  misc_feature: GYAE6OF01A63X4.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgcctcctcctcaccctctcactcgaggcacgagggtcctcgggccctagtctcgccgtgactcacgcctccctcgccgtccggtctccgtgacagtgactccacctatccgtcctgccgtacgtacggaccagtcgagtcgagtagtttcggttacgttaacgtaacgttcgttcgttaccttaccgtaaccggtaaaccaacctaactacgtaccggaaccgaacctaaacccgtaacccctaacggttaccgttacgttacgtttcgtacgtacggttacgaacggtaccggtcccggtaccggtacggtaccggtccgtacgtctcgtcttcgtcgtcgtaccgtacgtacgtcgtacgtaccgcccgtaccgtccgtaccgtcgtccgttcgtcgtcggtacgtacgacgtacgtagtacgtacgtagacgtacgttaacgtaccgtacgttacgtcgtacgtcgtacttacgttcgtcgacgtacgtcgtaccgttacgttcgttaccggtacggtaccgggtaccggtaaccggacgtaccgtaccgtaccggtaccggttacggtcgtaccgaccggtaccgtccggtacccgtcccgtccggtccg

SEQ ID NO: 119179 - DNA, 683 bp, Homo sapiens
  misc_feature: GYAE6OF01DGDMR.5.86.H09.1.454.CMB.1.raw
  modified_base (550)..(550): a, c, t, g, unknown or other
  misc_feature (550)..(550): n is a, c, g, or t
tcagatcagacacgcacgaccggtgctcgatttagtgctatagacttggggtttgggggctggggtctcaggaggcagcgctctcaggacgtcaccaccatggcctgggctctgcctcctcctcaccctcctcactcgagggcacgagggtcctcgggcccagtctcgccctgactcacgccctcctccgcgtccgggtctcgtggacagtcagtccacactcgtcctgcacgtcgggaaccagccgtaggtcgactagtttcggttacgtttaactacttagtcgtcttccgtacggtaaccaactaacactaccgaggaccaaccgacccctaaacgtcgtagttacttcgaggacgttacgaggttaacgcccggtaccgtacgggtaccgggtcctagtacgttccgttcgttacttcgtcggtcctaacgtacggtccgtacggacctaaccgccggtcccttaccgtcggtccgtcgtaccgtcggtacctaccgacggtagtggagggtactcgggtagcgttacgtactcttacgcacggtntactcttaggttcgacgtcgacgtaacggttcctacgttaccgttcggtacgggacggttacgaccgttacgccggttacggtaccctgggtacaccgtaccgaccgtacggtccctcccggttcccgtaccg

SEQ ID NO: 119180 - DNA, 950 bp, Homo sapiens
  misc_feature: GYAE6OF01D2O66.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgcctcctcctcaccctcctcactcgagggcacacgggttcctcggggccctaggtccttcgcccctagtacctccacggtcccccttccccgtcccggtccggttccgggtccttcccggtggaccaggttccacgtccaacctacttcccgtcctagccaccggtcgggacccagcaggtcacgtagtttcggttacgttaattaaccttagttcgttaccttcccgttacggtaacccaaacaaccacgtaccgaacggaaccccaaaccgacccccctaaagttcgtagttacgtttcgaggtaggtacgtagtaacggcccgtccgtacggtacgggtccctagtacctccgttcttacgtcgttacggtactaccgtacggtccgtacggacctaacccggcccgtccccgttacccgtacggttacccgttccgttcccgggccggttaccccttaccggtaacggtacggtacgggtacggttaacgggtaccggtacggttaccgttaaccggtttaacctttaccggtttaacccgtcggtaacccgttaccggtttaactttaccgggttttaccgtttaccgggaaccgtaacggggttacccgtaaccgggtttacccgtttaccgtttaccggggttaccccgggtttaaccggggggaccccgggttaaggggaaacccccgtttaagggttaccccccgggttaaccggttacccccgggtttaaccgggtaaccggtttaaacccgggacccccggttaaaccccggggttaacccggtcccccccgggtttcccccggttccccccgggtttaaccccggg

SEQ ID NO: 119181 - DNA, 695 bp, Homo sapiens
  misc_feature: GYAE6OF01BMSNT.5.86.H09.1.454.CMB.1.raw
  modified_base (209)..(209): a, c, t, g, unknown or other
  misc_feature (209)..(209): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctcctcactcagggcacgacgggtcctgggcccagtctcgccctgactcacgccctccctccgcgtccgggtctccgtggacngtcagtcaccatctcctgcacgtcgggaccagcagtcgactagttcggtacgttaataactattcgtcctccgtacgtaaccaacaactactccgaaggaccaaaccggacccccaaaacgttcgtagttactttcgtaggtacggtacgtaaggtaacgccggtcccgtacggtaccggggtccctgactcgtcttctacgtcggctaccgtaagtcgtacgaccgaaccgtccggtccctcccgtacggtacccgttcgtcgtccggcctaccgaagtccgtaggacgacgttacggacgtcgttacgtaccttacgttacgcgtacgtaccgtcttacgtacgttcgacggtacggaccgtacgttccgttacgttaccggtcgggtaccgggtaccgggaacggtacgaacgttccgtaaccggtcccgttaccgtacggaccgtaccggacccgtacggtcccgtacccggtcccgttacg

SEQ ID NO: 119182 - DNA, 735 bp, Homo sapiens
  misc_feature: GYAE6OF01C1C3Y.5.86.H09.1.454.CMB.1.raw
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
tcagatcagacacgcacgaccggtgctcgatttagtgctatagacttggggtttgggggctggggtctcaggaggcagcgctctcaggacgtcaccaccatggcctgggctctgcctcctcctccaccctctcactcgagggcacgagggtcctcgggcccagttctcgccctgacctcacgtccctcccgtccgccggtccgggtcctccgtaggacacgtcacgtccacctntcctcctgacctacgtcgggaccagctagtnactgttcgtacttaatactatcgtctaccgtacggtaaccaacaactactaccgaacggaactaaaccgaccccctaacttcggtacttacgtttgacggacggttacacggtaaaccgtcccggtcctacggtaccggggttccctagtaccgttcggttacctttccgtcggtacggttacctaaccggtaacggttccggtaaccgggtaccctaaaccggtcccggtacccttcccggtacggtacccgttccgtaccggtccggtaccgtaccgtagtacggtacggtacggtagtcggaacggtcgtagtaacttacgtactcgactcgtactacgttagttacgacggagtcgaccgttaccgttcgtacgttcgggtaccggaggtaacccggacgtacgtacgtaccggtaccgtaccgtacgacgtaccggtaaccgcggtacctccggtccccgtaccg

SEQ ID NO: 119183 - DNA, 704 bp, Homo sapiens
  misc_feature: GYAE6OF01ALRBX.5.86.H09.1.454.CMB.1.raw
  modified_base (230)..(230): a, c, t, g, unknown or other
  misc_feature (230)..(230): n is a, c, g, or t
  modified_base (579)..(579): a, c, t, g, unknown or other
  misc_feature (579)..(579): n is a, c, g, or t
  modified_base (590)..(590): a, c, t, g, unknown or other
  misc_feature (590)..(590): n is a, c, g, or t
tcagatcagacacgcacgaccggtgctcgatttagtgctatagacttggggtttgggggtgctcgatttagtgctatagacttgggtttgggatctacgttgcaggtgtaggtctgggtccctgagactctcctgtgcagcctcgtggtattcctaccttttactgtattttggcagtgacggtgggtcccgccagggcctacgaggggaaggggctggactggctctanaaatattaagtaggtaaagcaatatacaagactacacagactcgtggaacgggtccgttacaccacctagacgacgactaaccgtccgagggacctacggtcgttaccctaacgaacacgtagaacacggcctaggacggcgaccggaggacctaccgggtactattacgttaagttggtaggtagggaaggggtaacgtggggactaaggttccgaccgggtcggtacggggcctaacggggaaccccgttggtacccgtaccggtaccctaccgtcgaacccgtccctacccgaaccgaccggtcccacgttcccggttccctccccgtccggccctcccgtcgccncggacggtacncccgtacccgtcgaacgcacccgacgaccggccggccgtgggccgtcggtcccggtagtaacgaccggtaccctcccggtaccgttcgacggtactcggttgggacggtccggg

SEQ ID NO: 119184 - DNA, 837 bp, Homo sapiens
  misc_feature: GYAE6OF01AKXUT.5.86.H09.1.454.CMB.1.raw
  modified_base (671)..(671): a, c, t, g, unknown or other
  misc_feature (671)..(671): n is a, c, g, or t
tcagatcagacacgcacgaccggtgctcgatttagtgctatagacttgggtttgggggctggggtctcaggaggcagcgctctcaggacgtcaccaccagtcggcctgggctctcgctcctcctcaccctctcgactcgagggcacgacgggtcctcgggccctaggtcctcggtccctgtacctcgaccgtcccttcccgccggtccggtccgggttcctccgaggacctacggtcacggtccaacctgttccctccgttagaccgtaacggtaccggggaacctacgacgtaggtaacgtcttaggttttacggttaactttaacgtaacttcgttcgtacccgttccgtaacggtaaccaaacaacgtctaaccggagaaccttaacccgaaccccgttaagtccgttacttacttcggtacggtacgttcgaacgggtaccgtcccggtaccgttacggccggtacttacgcttaccgttccttctacggtctacccgttaacggtacgtaccggtaccgtaaccgtaccgacccggttacccgttcccggtaaccggttccgttaccgttacgggtacccgtcccggtaaacggtaccgacggggttaataccgggtgtaaccggtcgtaccggttaactaaccggtttaactcgtacgttaaccncgttactcgttaacgtcggtacgtaccgtcgtaaccgtcggtttaccttaaccgggcgtacgggaaaccggttcgttaacggacgtttcccgggtaacgtaacccggttccggtaaacgcccgtaaaccggttcccgaccgttcccccggacgttcccggtacccg

SEQ ID NO: 119185 - DNA, 830 bp, Homo sapiens
  misc_feature: GYAE6OF01C9JO3.5.86.H09.1.454.CMB.1.raw
  modified_base (337)..(337): a, c, t, g, unknown or other
  misc_feature (337)..(337): n is a, c, g, or t
tcagatcagacacgcacgaccggtgctcgatttagtgctatagacttgagtctgggggaggcttggtacagcctgggggtccctgagactctcctgtgcacgcctctggtacttcctaccttttactgtatttttggcattggaccggttgggtccgccgaggtccgtaccgagggggaaggggcttgggaccttgggacctctaactaaaagttatttaaagagggaaaaaggcaaatactaagaagacctacacagacctccggtaggaacgggtcccgtacaccacctgagacgacaacgtcaagggacacggtgtaacctacgacatagaacngcctagagacgccgaggaccgaccggtacgtacttagttattggtcggtagggaagggtaaacggtcgggggtaactaggtttaccggaccggtggtacggggaccgtaaccggggtacccgttacggtaccgtacccgttccgtacccgtcgtaccgtaccccgtaccgaacccggaaaccgggtaccccgtacgggttcccggttacccccgtttaccccccggtcgggtccccgtccccgttccggtaccccgtaccggtaaccgggtaccgtaccccggtaacccgtaccgggtaaccgtaccggaccgaccggaacgggtccccgggtacccggttcgggtcccgttaccggtcccggttacgggtaccggtaaccggtaccgtttaacccgttcccggttcgttacgttccgtacgtacggttccggacgggtaccgggtacggtccgggacggtaacgggcccggtagaccgttagcgcgttcgag

SEQ ID NO: 119186 - DNA, 839 bp, Homo sapiens
  misc_feature: GYAE6OF01ADOI1.5.86.H09.1.454.CMB.1.raw
  modified_base (185)..(185): a, c, t, g, unknown or other
  misc_feature (185)..(185): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctcgtggtacttcacctttactgtattttggcatgcggtggtccncgagctcgaggggagggctggactggctctactaaatattaagtagggtaaacgactaatactaacgaacgactaacacgacgtaccgtccggtacggaacgggttcccgttaccaacccgaccgtaggaacgacgaactaaccgtccggacgggtaccgacggttactaacccgtacaactacgtacgaacgtacggtccgtaggaacggtacggaccggacggaccgaccggacctattaacttaagtttagttggttaggtaagggaacggggtaacggtacgggggtacttaaggttcggaaccggtcgggtaccgggaccggtaaccgggtacccgttcggtccgtacccgttcctaccgtaccgtaccgtcccgtaacccgaccggtaaacccggcccgttaccgttaccccgggtccccgtttacccccggccgggtcccccgtcccgtccggtacccgtaccgggaaccgggtacccgtacccgaccccggttacgaacggacccgaccgtaacccgggccggtacccgggcccggtacgggtacccgttccgggtaccgggttaaccggaaccggttaaacccgggtttacccgttaccccgtttcgggttacccttcggttacgttaccgttcgggacccgggg

SEQ ID NO: 119187 - DNA, 502 bp, Homo sapiens
  misc_feature: GYAE6OF02HN0QM.5.86.H09.1.454.CMB.1.raw
  modified_base (326)..(326): a, c, t, g, unknown or other
  misc_feature (326)..(326): n is a, c, g, or t
tcagatcagacacgcacgaccggtgctcgatttagtgctatagacttgggtttggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttctgaggtcagtaagcggccctnaggggtccctgatcgcttctctggctccaagtctggcaacacggcctccctgaccgtctctgggctccagactgaggatgaggctgactattactgcagctcatttgcaggcagccgtatactcttcggcggaggaccaagctgaccgtccaggtcagcccaaggctgcccctcgg

SEQ ID NO: 119188 - DNA, 504 bp, Homo sapiens
  misc_feature: GYAE6OF02ICZQX.5.86.H09.1.454.CMB.1.raw
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
tcagatcagacacgcacgaccggtgctcgatttagtgctatagacttgggtttggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactgggaccagcagtgacattggtcgttataactatgtctcctggtaccaacaacatccaggcaaagcccccaaatcgtgatttcngagtcagtaagcggccctcaggggtccctgatcgcttctctggctcaagtctggcaacncggcctcctgaccgtctctgggctccagactgaggatgaggctgactattactgcagctcatttgcaggcagccgtatctcgttcggcgagggaccaaggctgacccgttctaggtcacgcccaaggcctcgcccctcgg

SEQ ID NO: 119189 - DNA, 498 bp, Homo sapiens
  misc_feature: GYAE6OF02G0DXP.5.86.H09.1.454.CMB.1.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
  modified_base (416)..(416): a, c, t, g, unknown or other
  misc_feature (416)..(416): n is a, c, g, or t
tcagatcagacacgcacgaccggtgctcgatttagtgctatagacttgggtttggggctgggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaanaacatccaggcaaagcccccaaatcgtgatttcngaggtcagtaagcggccctcaggggtccctgatcgcttctctggctcaagtctggcaacncggcctcctgaccgtctctggctccagctgaggatggagctgactattacngcagctcatttgcaggcagccgtatactcttcggcggaggaccaagctggaccgtctaggtcagccaaggctcgcccctcgg

SEQ ID NO: 119190 - DNA, 509 bp, Homo sapiens
  misc_feature: GYAE6OF02F9WW0.5.86.H09.1.454.CMB.1.raw
  modified_base (310)..(310): a, c, t, g, unknown or other
  misc_feature (310)..(310): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaatcgtagtatttcngaggtcagtaagcggcctcacggggtccctgactcgcttctctggctccaagtctggcaacncggcctccngaccgtctctggctccagctgagntgagctgacttatactgcagctcatttgcagcagccgtatacgtctcggcgacgggaccaagctcgaccgtcctaggtcacggccaacggctccggcccctcgg

SEQ ID NO: 119191 - DNA, 540 bp, Homo sapiens
  misc_feature: GYAE6OF02IY7VI.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactggggcaattgaccgctggggccagggaaccctggtcaccgtctcctcagcctcaccaagggcccatcggtctcccctggccgccctgctccaggacgccacctccgagacgcacagcggccctgggctggcctggtcaaggactacgttcccgtgttcgatctgagcggg

SEQ ID NO: 119192 - DNA, 538 bp, Homo sapiens
  misc_feature: GYAE6OF02I0ZD9.5.86.H09.1.454.CMB.1.raw
  modified_base (415)..(415): a, c, t, g, unknown or other
  misc_feature (415)..(415): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaaccctggtcaccgtcncctcagcctccaccaagggcccatcggtcttcccctggccgccctgctccaggagccacctccgagcgcacagcggccctgggctgcctggtcaaggctacgttccgtgtctgactcgtgcgg

SEQ ID NO: 119193 - DNA, 543 bp, Homo sapiens
  misc_feature: GYAE6OF02HSM5V.5.86.H09.1.454.CMB.1.raw
  modified_base (540)..(543): a, c, t, g, unknown or other
  misc_feature (540)..(543): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaaggcaatatacaagactaacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaaccctggtcaccgtctcctcagcctccaccaaggcccatcggtcttccccctggccgccctgcctccaggacgccacctccgacgacgcacacgccggccctgggcctcgcctgggtccaagggaccttacgttcccgtgtctgatctcggagccgggctggccaaggcgcgatagnnnn

SEQ ID NO: 119194 - DNA, 504 bp, Homo sapiens
  misc_feature: GYAE6OF02IGU2G.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaaagcccccaaaatcgtgatttctgaggtcagtaagcggcctcaggggtccctgatcgcttctctggctcaagtctggcaacacggcctccctgaccgtctctgggctccagctgaggatgaggctgactattactgcagctcatttgcaggcagccgtatactcttcggcggacggaccaagctgacccgtcaggtcagcccaaggctcgcccctcgg

SEQ ID NO: 119195 - DNA, 510 bp, Homo sapiens
  misc_feature: GYAE6OF02GIBLC.5.86.H09.1.454.CMB.1.raw
  modified_base (424)..(424): a, c, t, g, unknown or other
  misc_feature (424)..(424): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgacccgtctctgggctccagactgaggatgaggctgactattacngcagctcatttgcaggcagcctatactcttcggcggaggaccaagctgaccgtccgtaggtcacgcccaaggcctcgccccctcgg

SEQ ID NO: 119196 - DNA, 525 bp, Homo sapiens
  misc_feature: GYAE6OF02F9RM3.5.86.H09.1.454.CMB.1.raw
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttcngaggtcagtaagcggccctcgaggggtccctgactcgcttcnctggctccaagtctggcaacacggcctccctgaccgtctctgggctccagactgagatgaggctgacttattactgcagctctatttcgcaggcagccgtatacctcgttcggcggtacggaccaaggctacggacccgtcgtaggtcacggacccgaaggcctacgccccgtcgg

SEQ ID NO: 119197 - DNA, 552 bp, Homo sapiens
  misc_feature: GYAE6OF02H49JF.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtaccctacacatgaacagcctgagagccgaggacacggccgtatattatgtgtgaggggaaactggggcaatttgaccgctggggccagggaaccctggtcaccgtctcctcagcctccaccaagggcccatccggtcttccccctggccgccctcgcctccacggagccacctccgacgacgccacagcggccctgggcctggcctggtcaaggacctacgttcccgtgtcctggactctgacgg

SEQ ID NO: 119198 - DNA, 502 bp, Homo sapiens
  misc_feature: GYAE6OF02HV5HK.5.86.H09.1.454.CMB.1.raw
  modified_base (308)..(308): a, c, t, g, unknown or other
  misc_feature (308)..(308): n is a, c, g, or t
  modified_base (419)..(419): a, c, t, g, unknown or other
  misc_feature (419)..(419): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttcngagtcagtaagcggccctcaggggtccctgatcgcttctctggctcaagtctggcaacacggcctccctgaccgtctctgggctccagactgagatgagctgactattacngcagctcatttgcaggcagccgtatactcgttcggcggaggaccaagctgaccgtctaggtcacgcccaggctcgcccctcgg

SEQ ID NO: 119199 - DNA, 512 bp, Homo sapiens
  misc_feature: GYAE6OF02H8W5J.5.86.H09.1.454.CMB.1.raw
  modified_base (371)..(371): a, c, t, g, unknown or other
  misc_feature (371)..(371): n is a, c, g, or t
  modified_base (423)..(423): a, c, t, g, unknown or other
  misc_feature (423)..(423): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaaagccccccaaaactcgtgatttctgaggtcagtaagcggccctcaggggtccctgatcgcttctctggctcaagtctggcaacncggcctccctgaccgtctctgggctccagctgaggatgagctgactattacngcagctcatttgcaggcagtccgtatactcgttcggcggtagggaccaagcctgacccgtctaggtcacgcccaaggctcgcccctcgg

SEQ ID NO: 119200 - DNA, 651 bp, Homo sapiens
  misc_feature: GYAE6OF02IY3IQ.5.86.H09.1.454.CMB.1.raw
  modified_base (200)..(200): a, c, t, g, unknown or other
  misc_feature (200)..(200): n is a, c, g, or t
tcagatcagacacgcacgaccggtgctcgatttagtgctatagacttgggtttggggctggggtcgtcaggaggcagcgctctcaggacgtcaccaccatggcctgggctctgctcctcctcaccctcctcactcaggcacaggtcctgggcccagtctgccctgactcagcctccctccgcgtccgggtctcctggacngtcagtcaccatctcctgcactggaccagcagtgacattggtcgttataactatgtctcctgtaccaacaacatcagcaaacgccccaaaactcgtgatttctgagtcaagtaagcggcctcaggggtcctgatcgcttctctggctccaagtctgctaacacggcctccctgacccgttctccgtcgggtccttcccgagtacccgtggacggacgttggaacggcttaggaaccttaagttaccgtagtccgaaggtcctactacgttttggaccgttacgggaccctaaggtccccgttaaagttaacccgttccggtttacccgggaccgggtaacggggtaaacccgtaacggtacccgtacgggtaacccccgtccgtttaaacgggtacccgtaaccggtacccccggtaaaggaccccgttccggtacccccccgttcccggg

SEQ ID NO: 119201 - DNA, 557 bp, Homo sapiens
  misc_feature: GYAE6OF02GKFF4.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaaccctggtcaccgtctcctcagcctccaccaagggcccatccggtcttccccctggccgccctgcctccaggacgcaccctccgacgacgcacagcggccctgggctcggccctggtccaagggtcctaccgttcccgtgtcctggactctgacggg

SEQ ID NO: 119202 - DNA, 516 bp, Homo sapiens
  misc_feature: GYAE6OF02IH6IH.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgattctgagtcagtaagcgccctcgaggggtccctgatcgcttctcgtggctcaagttctggacaacacggcctccctgaccgtctcgtggctccagactgagatgaggctgactattactgcagctctattgcagcagccgtatctcgttcggcggacggaccaagcgtacgaccggtcctaggtccacgcccgaaggcctccgcccccgtcgg

SEQ ID NO: 119203 - DNA, 575 bp, Homo sapiens
  misc_feature: GYAE6OF02JSOYV.5.86.H09.1.454.CMB.1.raw
  modified_base (265)..(265): a, c, t, g, unknown or other
  misc_feature (265)..(265): n is a, c, g, or t
  modified_base (378)..(378): a, c, t, g, unknown or other
  misc_feature (378)..(378): n is a, c, g, or t
  modified_base (424)..(424): a, c, t, g, unknown or other
  misc_feature (424)..(424): n is a, c, g, or t
tcagatcagacacgcacgaccggtgctcgatttagtgctatagacttgggtttggggctggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatctcctgcactggaccagcagtgacattggtctataactatgtctctgtaccanacatccaggcaaacgcccccaaatcgtagactttcgagacggtcagttaaagccggtccctcgaacggggtccctgactcggcttctcgtgcctcgaagtcctggacctaacnccggtaccctccgtgacccgtctcgtcgggctccgagactgacgtntgaggtctagaccttagttacctgacgtagcgttctaagtttcgctagggcctagtcccgtataccgtcgttcgggacgtacgggacaaacggtcctggtacccgttcgtacggtccacggaccctaagggtcctccggtaccccccgtgg

SEQ ID NO: 119204 - DNA, 583 bp, Homo sapiens
  misc_feature: GYAE6OF02G7RFA.5.86.H09.1.454.CMB.1.raw
  modified_base (310)..(310): a, c, t, g, unknown or other
  misc_feature (310)..(310): n is a, c, g, or t
tcagatcagacacgcacgaccggtgctcgatttagtgctatagacttggggtttgggggctggggtctcaggaggcagcgctctcaggacgtcaccaccatggccctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggacaaacgcccccaaatcgtgattcngagtcagtaagcggccctgacggggtccctgactcgcttctctcggctcagtctggcaacgcggcctcctgacccgtctcgtcgggctccagactgacggatcggacggcttacgacttacttacgtgcagtcttcgtattttcgacgtaggtctacggtccgttataccgttcgttaccgggcggtacgggacctaacggtcctacggtacccgttaccgttaacggtccgacggtacccgtaacggtccgttaccggcccccgttaccggg

SEQ ID NO: 119205 - DNA, 518 bp, Homo sapiens
  misc_feature: GYAE6OF02GF594.5.86.H09.1.454.CMB.1.raw
  modified_base (307)..(307): a, c, t, g, unknown or other
  misc_feature (307)..(307): n is a, c, g, or t
  modified_base (435)..(435): a, c, t, g, unknown or other
  misc_feature (435)..(435): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttcngaggtcagtaagcggccctcgaggggtccctgatcgcttctctggctccaagtctggcaacacggcctccctgaccgtctcgtgggcctccgagactgaggatggaggctgacttattactgcagctnatttgcagcagccgtatactcgttcggcggaggaccaagcctgacccgttcgtaggtcacgacccgaaggcctcgcccctcgg

SEQ ID NO: 119206 - DNA, 634 bp, Homo sapiens
  misc_feature: GYAE6OF02HMAYY.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgacccccaaatcgtgtatttctgaggtcagtaagcggccctcgacggggtccctgatcgcttctctgctcagtctgcaacgacgcctccgtgaccgtctcgtgggcctaccgagtactggaggtagtaggacggcttacggtacttaatttaccgtgacacggtccttactaagttttcgacgtacggccgtacggtacccgttaattaccgttccgttaccggggacggggtaacggggtacccgtaaaggtccgttacggtaaccccggttacccgttaacgggtacccaaccgggacccccggtaaagggtcccgttacccggtacccccccggttacccggg

SEQ ID NO: 119207 - DNA, 522 bp, Homo sapiens
  misc_feature: GYAE6OF02IG4GL.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaaacgcccccaaaactcgtgattctgaggtcagtaagcggccctcacggggtccctgatcgcttctctggctcaagtctggcaacacggcctccctgaccgtctcgtcgggctccagactgaggatggagctgactattactgcacgctcatttgcgtaggcagccgtatctcgttcggcggacggaccgaagctcgtacccgttcgtacggcacgcccgaaggctccgcccctcgg

SEQ ID NO: 119208 - DNA, 496 bp, Homo sapiens
  misc_feature: GYAE6OF02IVC6C.5.86.H09.1.454.CMB.1.raw
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
  modified_base (399)..(399): a, c, t, g, unknown or other
  misc_feature (399)..(399): n is a, c, g, or t
  modified_base (423)..(423): a, c, t, g, unknown or other
  misc_feature (423)..(423): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttcngaggtcagtaagcgcctnaggggtccctgatcgcttctctggctccaagtctggcaacacggcctccctgaccgtctctggctcagactgagntgagctgactattactgacagctnatttgcagcagccgtatctctcggcgaggaccaagcctgaccgtcgtaggtcagcccaggcctcgcccctcgg

SEQ ID NO: 119209 - DNA, 565 bp, Homo sapiens
  misc_feature: GYAE6OF02GI2FP.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaagtttgaccgctggggccagggaaccctggtcaccgtctcctcagcctccaccaagggcccatcggtccttccccctggccgccctgcctccgaggacgccacctccgagacgcacagccggccctgggcctcggccgtggtccaacggtaccttaccgttcccggtgttcctggacttccgtgacggg

SEQ ID NO: 119210 - DNA, 515 bp, Homo sapiens
  misc_feature: GYAE6OF02F558H.5.86.H09.1.454.CMB.1.raw
  modified_base (230)..(230): a, c, t, g, unknown or other
  misc_feature (230)..(230): n is a, c, g, or t
tcagatcagacacgcacgaccggtgctcgatttagtgctatagacttgggtttggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtatgtctcctggtaccaacaacaccccgacaaacgcccccaaactcatcatttttgaggtcactacgcgaccctcagggtccctgatcgcttctctggctccaagtctggcaacacgcctccctgaccgtctctgggctccaggctgagatgaggctgattattactgcagctcatatgcaggcagcagcagtcccatgtgatcgttcgggccgggggtaaccaaggctacggacccgttccgtaggtccacgcccgaacgg

SEQ ID NO: 119211 - DNA, 541 bp, Homo sapiens
  misc_feature: GYAE6OF02G4B90.5.86.H09.1.454.CMB.1.raw
  modified_base (511)..(511): a, c, t, g, unknown or other
  misc_feature (511)..(511): n is a, c, g, or t
  modified_base (538)..(541): a, c, t, g, unknown or other
  misc_feature (538)..(541): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaaccctggtcacgtctcctcagcctccaccaagggcccatccggtcttcccccgtggccgccctgcctccacggacgccaccctccgagacgcacagccggccctgggcctgcctggcaaggactacgttcccgtctcgtgactcgtggnggccgggctcggcaacggcgcagtagnnnn

SEQ ID NO: 119212 - DNA, 525 bp, Homo sapiens
  misc_feature: GYAE6OF02F4T5U.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcgccctcgaggggtccctgactcgcttctctggctccaagtctggcaacaccggcctccctgacccgtctcgtcgggcctccagactggaggatggaggctgacttattactgcagtctctatttgacaggcagtccgtatctcgttcggcggaggaccaagctacgacccgtcgtaggtcacgacccaggcctcgccccgtcgg

SEQ ID NO: 119213 - DNA, 626 bp, Homo sapiens
  misc_feature: GYAE6OF02GPS19.5.86.H09.1.454.CMB.1.raw
  modified_base (309)..(309): a, c, t, g, unknown or other
  misc_feature (309)..(309): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttcngaggtcagtaagcggccctcgaggggtccctgatcgcttctctggctcgaagtctggccaacgcggccctcccgtgaccgtctcgtcgggcctccgagacgtgacggatggagcttgaacttattacgtcgcagtccttacgtagtttcgccgaggtctacggtccgttacttaaccgttccgttaccggggaccgggtaacgggtaaccctaagggtcccgttacgggtaaccccggttacccggtaacgggttacccgaaccgggtacccccggtaaaggtccccggttacccggtaccccccccggttaccggg

SEQ ID NO: 119214 - DNA, 507 bp, Homo sapiens
  misc_feature: GYAE6OF02FR0Z4.5.86.H09.1.454.CMB.1.raw
  modified_base (307)..(307): a, c, t, g, unknown or other
  misc_feature (307)..(307): n is a, c, g, or t
  modified_base (422)..(422): a, c, t, g, unknown or other
  misc_feature (422)..(422): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttcngaggtcagtaagcggccctcaggggtccctgatcgcttctctggctcaagtctggcaacacggcctccctgaccgtctctgggctccagactgaggatggaggctgactattacngcagctcatttgcagcagcctatactcgttcggcggaggaccaaggctcgacccgtctaggcacgcccaaggctccgcccctcgg

SEQ ID NO: 119215 - DNA, 521 bp, Homo sapiens
  misc_feature: GYAE6OF02IZYHL.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttctgaggtcagtaagcggccctcaggggtccctgatcgcttctctggctcaagtctgcaacacggcctccctgaccgtctcgtgggctccagctgaggatggaggctagacttattacgtgcagctctatttgcaggcagccgtatactcgttcggcggaggaccaagtctaggacccgtctaggtcacgacccgaaggcctccgccccgtacgg

SEQ ID NO: 119216 - DNA, 528 bp, Homo sapiens
  misc_feature: GYAE6OF02GL56E.5.86.H09.1.454.CMB.1.raw
  modified_base (231)..(231): a, c, t, g, unknown or other
  misc_feature (231)..(231): n is a, c, g, or t
  modified_base (369)..(369): a, c, t, g, unknown or other
  misc_feature (369)..(369): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (501)..(501): a, c, t, g, unknown or other
  misc_feature (501)..(501): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccngcagtgacattggtcgttataactatgtctcctggtaccaacaacatccaggcaaacgcccccaaactcgtgatttctgaggtcagtaagcggccctcgaggggtccctgatcgcttctctggctcaagtctgcaacncggccctccgtgaccgtctcgtcgggcctccgagactgaggatgaggctgacttattacngcagtctntatttgcaggcagtccgtatcgtcgttcgggcgacgggaccaagctcgacccgttcgtaggtcncggacccgaaggcctccggcccctcgg

SEQ ID NO: 119217 - DNA, 629 bp, Homo sapiens
  misc_feature: GYAE6OF02GU3SD.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctccgtggacagtcagtcaccatctcctgcacgtgggaccagcagtgactattggtcgttataactatgtctcctggtaccaacacactccaggacaaacgacccccaaactcgtagtactttctgtacgtcaggtaacgccggcctcgacggggtcctgactcgtcttctcgtcgtctaccgtaagtcgtacggacaaccgtaccggtccctccctcgtaccgtctcgtcgggtcctccgacggactggagagtaggacggtctgtaacttattactgtcagtccttacgtaatttcgacgtaggtaccgacgtacccgttacgtaaccgttccggttaccgggacggggaacgggtaccgaacggtccgtacggtaccccgttacgtacggtacgaccggtacccgaacggtcccttcccggtccccgttaccggg

SEQ ID NO: 119218 - DNA, 542 bp, Homo sapiens
  misc_feature: GYAE6OF02FMAX4.5.86.H09.1.454.CMB.1.raw
  modified_base (537)..(537): a, c, t, g, unknown or other
  misc_feature (537)..(537): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaaatatacaagactacacagactccgtgaagggccggttcaccacctcgagagacaactccagggacacggtgtacctacacatgaacagcctgagagccgagtacacggccgtatattattgtgtgaggggaaactgggggcaatttgaccgctggggccagggaaccctggtcaccgtctcctcagcctccaccaagggcccagtccggtctccccctggccgccctcgctccaggacgcacctccgagacgcacagcgccctgggctgcctggtcaaggctacttcccgtgtctgactcngacgg

SEQ ID NO: 119219 - DNA, 557 bp, Homo sapiens
  misc_feature: GYAE6OF02JO29E.5.86.H09.1.454.CMB.1.raw
  modified_base (273)..(273): a, c, t, g, unknown or other
  misc_feature (273)..(273): n is a, c, g, or t
  modified_base (310)..(310): a, c, t, g, unknown or other
  misc_feature (310)..(310): n is a, c, g, or t
  modified_base (443)..(443): a, c, t, g, unknown or other
  misc_feature (443)..(443): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaanaacatccaggcaaacgcccccaaactcgtagatttcngacgtcagtaacgccgcctcgacggggtccctgactcgtcttctctcggctcaagtctggacaacgaccggccctcccgtagacccgtctcgtcggcctccgagactgacgatggacgtctagtacttattcngcagctacgtattcgacaggcacgtccgtatactcgtcgggacggacggaccaacggtctacggtacccgtcgtaggtaccacggacccgaggtccctaccgcccccgttacgg

SEQ ID NO: 119220 - DNA, 536 bp, Homo sapiens
  misc_feature: GYAE6OF02I2OG5.5.86.H09.1.454.CMB.1.raw
  modified_base (533)..(534): a, c, t, g, unknown or other
  misc_feature (533)..(534): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaagggctggactggctctcaaatattaatggaaaaggcaatatacaagactacacagactccgtgaagggccgttcaccacctcgagagacaactccagggacacggtgtacctacacatgaacagccctgagagccgaggacacggccgtatattattgtgtgaggggaaactgggggcaatttgaccgctggggccagggaaccctggtcaccgtctcctcagcctccaccaacggggcccagtcggtccttccccctggccgcccctgcctccaggacgcaccctccgacgcgcacagccggccctgggctcgcctggtcaacggctactcccgtgtctgctctggagcggctcggcaaggcgcagtagctnncg

SEQ ID NO: 119221 - DNA, 585 bp, Homo sapiens
  misc_feature: GYAE6OF02JUVEF.5.86.H09.1.454.CMB.1.raw
  modified_base (321)..(321): a, c, t, g, unknown or other
  misc_feature (321)..(321): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaagggctggactggctctcaaatattaatggtaaaggcaatatacaagactacacagactccgtgaagggccgttcaccacctcgagagacaactccagggacacggtgtacctacacatgaaccngcctagagagccgaggacacggcctatattagttgtgtgaggggaaacgtggggactaagttgaccgcgtggggccagggacctggcaccgtctctcagccctcaccgacggcccagtccgtccttcccgcggccnccctcgcctccgaggacnccacccgtcgacgacgccaccgacggccgccccgtgggccctacggcccgttagggccgaacggtacctaccggtttcccggtcgttccgtggacttcgtaggtaccggg

SEQ ID NO: 119222 - DNA, 528 bp, Homo sapiens
  misc_feature: GYAE6OF02HRX8C.5.86.H09.1.454.CMB.1.raw
  modified_base (370)..(370): a, c, t, g, unknown or other
  misc_feature (370)..(370): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaaacgcccccaaactcgtgatttctgaggtcagtaagcggcctcaggggtccctgatcgcttctctggctcaagtctggccaacncggccctcctcgaccgtctctcgggctccgagactgaggatggaggctgactattacngcagtctntatttgcaggcacgtccgtatacttcgttcggcggagggaccaagcctacgaccgtccgtaggtccacggcccgaaggcctcgccccgtcgg

SEQ ID NO: 119223 - DNA, 581 bp, Homo sapiens
  misc_feature: GYAE6OF02HQ7TD.5.86.H09.1.454.CMB.1.raw
  modified_base (454)..(454): a, c, t, g, unknown or other
  misc_feature (454)..(454): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcaccttttactgattttggcatgacgtgggtccgccaggctccagggaaggggctggactggctctcaaatattaatggtaaaggcaatatacaagactacacagactccgtgaaggccggttcaccacctcgagagacaactccagggacacggtgtacctacacatgaacagcctgagagccgaggacacggccgtatattattgtgtgaggggaaactgggggcaatttgaccgctggggccagggaaccctggtcaccgtctcctcagcctccaccaagggcccatccggtccttccccgnggcccgccctcgcctccgacggacgccacctccgacgacgcacgacgccggcccgtcgggctcggccgttcggtacgaacgggaccttaaccgttcccgtcggtccgtcgtacttcgtagtaccggg

SEQ ID NO: 119224 - DNA, 685 bp, Homo sapiens
  misc_feature: GYAE6OF02G3ES2.5.86.H09.1.454.CMB.1.raw
  modified_base (200)..(200): a, c, t, g, unknown or other
  misc_feature (200)..(200): n is a, c, g, or t
  modified_base (309)..(309): a, c, t, g, unknown or other
  misc_feature (309)..(309): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccggtctcctggacngtcagtcaccatctcctgcacgtcgggaccagcagtgactagttggtcgttaataactatgtctctgtaccaacacatccaggacaaacgccccaaatcgtgtatttcngagtcagtaagccgcctcgtacgggtccctgactcgtcttctcgtggccttaccgaagtcctagggaccaaccgtacccgggtccctcccgttacggacccgttctccggttcgggcccttaccgacgtacgttagggacggtagtcggacggtcgttacggtaacctttaacgttaccgtcgtaccgaaggtccttacgttacgttttcgacgtaacggtaccacggttacccgttaacgttaccgttaccggttaccggggacgggtaaccgggaaccgtaacggtcccggttaccggtacccgttacccggttaggtacccgaaccgggtacccgtaacgggtcccgttaccccggtacccccgttacccggg

SEQ ID NO: 119225 - DNA, 514 bp, Homo sapiens
  misc_feature: GYAE6OF02G6NYF.5.86.H09.1.454.CMB.1.raw
  modified_base (302)..(302): a, c, t, g, unknown or other
  misc_feature (302)..(302): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctctgtaccaacacatccaggcaaagccccaaatcgtgattcngaggtcagtaagcggccctcgacgggggtccctgatcgcttctctggctcaagtctggcaacaccggcctccctgaccgtctcgtgggctccagactgaggatgagctgtactattacngcagctnatttgcngcagccgtatactcgtcggcgacgggaccaacggctacggaccgtccgtaggcacgccgaaggtccgtcgccccgtcgg

SEQ ID NO: 119226 - DNA, 666 bp, Homo sapiens
  misc_feature: GYAE6OF02I4F5K.5.86.H09.1.454.CMB.1.raw
  modified_base (179)..(179): a, c, t, g, unknown or other
  misc_feature (179)..(179): n is a, c, g, or t
tcagatcagacacgcacgaccggtgctcgatttagtgctatagacttgagtctggggaggcttggtacagcctgggggtccctgagactctcctgtgcagcctctggattcacctttactgattttggcatgacgtggtccgccaggctccagggaagggctggactggctctcaaatnttaatggaaaaggcaatatacaagactacacagactccgtgaagggccggttcaccacctcgagagacaactccagggacacggtgtacctacacatgaacagcctgagagccgaggacacggccgtatatattgtgtgaggggaaaactgggggcaagtttgaaccgcgtggggccagggaacccgtggtccaaccgtctcctcgagtcccgtccaccgaaacggcccaagtccggtcttaccccctggccgtcccctcgccttccgacggacgccaacccgtccgacgtacgccaccgaacgccggccccgtaggggcccgttcggccccgttacgggtaccgtaaacgggaccttaacccgtttcccggtaccgttccgtacggtacttccggttacggacgggtaccccggggtcgttaccgggggtacccgttaaagggggaccccgtaccggtaacgttaaccgggtcgacgtcgtaccgg

SEQ ID NO: 119227 - DNA, 706 bp, Homo sapiens
  misc_feature: GYAE6OF02H5BXU.5.86.H09.1.454.CMB.1.raw
  modified_base (255)..(255): a, c, t, g, unknown or other
  misc_feature (255)..(255): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacaggtcctgggcccagtctgccctgactcagcctccctcgcgtccggtctctggacagtcagtcaccatctctgcacgtgggaccagcagtcgaacagttggtacgttataaactntgtctcgtagtaccaacaactactaccgaggaccaaaaccggaccccccaaaacgttccgtagttactttaccgtagacgtactaaggttaacgccggacccttacggacggggtccctgatccgcttctcgtggccttaccgaagtccgtacggacaaccgaccggtccctacctcggtacccgtcgtacgtccgggtcttacccgacgtacgtagacggtacgtaggtacggtcgttaacgtaacttacttacgtacgcgaacgtcttacctaacgtttcgaccgtaggtccgtaacggtacccgttacttaaacccgttccgtttacccggggacgggttaaccggggacccgtaaacggtacccgtcgggtaacccgttaccggtaccgttaccggaccggtacccggaaaccggttccgtaccccgggtccccccgtttacccggg

SEQ ID NO: 119228 - DNA, 582 bp, Homo sapiens
  misc_feature: GYAE6OF02J1WCS.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtagattctgagtcagtaagcggccctcgacggggtccctgactcgcttctctggctcaagtctggacaacaccggccctccgtgacccgtctccgtggctccacggtactggaggtagtagaggctagtaacttattacctgacacgtcttctatttcgcgacggctaacgccgttacgtaccttccgttacgggacgggaacggtaccgtaacggtccgtacgacccggttaccgtaaggtccgacggtacccgaaggcccgttaccgtcccccgtacgg

SEQ ID NO: 119229 - DNA, 565 bp, Homo sapiens
  misc_feature: GYAE6OF02FU7R7.5.86.H09.1.454.CMB.1.raw
  modified_base (559)..(559): a, c, t, g, unknown or other
  misc_feature (559)..(559): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaaggcaatatacaagactacacagactccgtgaagggccggttcaccacctcgagagacaactccagggacacggtgtacctacacatgaacagcctgagagccgaggacacggccgtatattatgtgtgaggggaaactgggggcaagtttgaccgctggggccagggaaccctgggtcaccgtctcccgtcacgcctccaccaacgggcccatccggtcttccccctggccgcccctgcctccaggacgcaccgtccgagacgcacagccggccctggggcctcggccctggtcaacggacttaccgttcccgtgtcctgacttcgngacggg

SEQ ID NO: 119230 - DNA, 655 bp, Homo sapiens
  misc_feature: GYAE6OF02JDDEX.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaaagcccccaaactcgtgatttctgaggtcagtaagcggccctgaggggtccctgactcgcttctctggctccaagtctggcaacaccggcctccctgacccgtctcgtcgggcctccgagaccttggaggatggacggtctggaaccttaattaaccgtgaccgtagtccttcgtagttttcggaccgtaagggccctaacgggtacccgtttaaacttaacccggttccggttttaccgggggaccggggtaacggggaaccctaaacgggtacccgttacgggtaaccccggttaccgttaacggggttcccgaaccgggtacccccgtaaaggggccccttacccgggtcccccccggttaccggg

SEQ ID NO: 119231 - DNA, 573 bp, Homo sapiens
  misc_feature: GYAE6OF02JADW2.5.86.H09.1.454.CMB.1.raw
  modified_base (307)..(307): a, c, t, g, unknown or other
  misc_feature (307)..(307): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctgtaccaacaacatccaggcaaacgcccccaaatcgtgatttcngagtcagtaagcggcctcaggggtccctgatcgcttctctggctcaagtctgcaacacggccctcctgaccgtctcgtcgggcctaccgagtacgtggaggatggaggtccttgtaacttacttactgctacgcttctatttgacgtaggactacggtccgttacttaacgtccgttccgggacgggacgggaccgtaaggccttacggtacccgttccgtaggtccacggtaccccgaaggtcccgtacccgtcccccgtaccgg

SEQ ID NO: 119232 - DNA, 562 bp, Homo sapiens
  misc_feature: GYAE6OF02FTY7C.5.86.H09.1.454.CMB.1.raw
  modified_base (306)..(306): a, c, t, g, unknown or other
  misc_feature (306)..(306): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacacatccaggcaaacgcccccaaatcgtgatttcngaggtcagtaagcgccctgaggggtccctgactcgcttctctggctcgaagtctggcaacgacggccctccctgaccgtctcgtgggcctccagtactgaggatggacggctcgacttacttacgtcgctagtcctgtactttgctaaggctacgtccgtattacgtcgttaccgggcggaagggtaccgaaggtcgtacggacccgttaccgtacggtacacggtacccgaaggtccctccggtcccccttccgg

SEQ ID NO: 119233 - DNA, 524 bp, Homo sapiens
  misc_feature: GYAE6OF02GQWTL.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgccccccaaatcgtgactttctgaggtcagtaagccggcctcgacggggtccctgatcgcttctctgctcagtctgacacacggcctcctgaccgtctcgtcgggcctccgagactgaggatgaggtctagacttattactgacagctctatttgcgaggcagccgtataccgtcgttcggcggaggaccgaagctacgaccgtcgtaggtcacgaccgaaggcctcgcccctcgg

SEQ ID NO: 119234 - DNA, 547 bp, Homo sapiens
  misc_feature: GYAE6OF02H9YQH.5.86.H09.1.454.CMB.1.raw
  modified_base (309)..(309): a, c, t, g, unknown or other
  misc_feature (309)..(309): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagccccccaaatcgtagatttcngaggtcagtaagcggcctcgaggggtccctgatcgcttctctggctccaagtctggcaacacggcctccctgaccgtctcgtgggctccagctgagatgagctgactattactgcagctcgtatttcgcaggcacgccgtataccgtcttcgggaccggtaggacccaaggtccttacggacccgttccgtacgggttccacggaccccgaagggcccgttccggccccccgttcggg

SEQ ID NO: 119235 - DNA, 545 bp, Homo sapiens
  misc_feature: GYAE6OF02FXOAS.5.86.H09.1.454.CMB.1.raw
tcagatcagacacgcacgaccggtgctcgatttagtgctatagacttgggtttgggggtgcgtcgatttagtgctatagacttgggtttgggatctacgttgcaggtgtaggtctgggtccctgagactctcctgtgcagcctctggattcacctttactgattttggcatgacgtgggtccgccaggctccagggaagggctggactggctctcaaatattaatggtaaaggcaatatacaagactacacagactccgtgaaggccggttcaccacctcgagagacaactccagggacacggtgtacctacacatgaacagcctgagagccgaggacacggccgtagtattattgtgtgaggggaaactgggggcaatttgaccgctggggccagggaccctggtcaccgtctcctcagcctccaccaagggcccatcggtcttccccctggccgccctgctccaggacgcacctccgagagcacagcggccctgggcctgcctggtcaaggacctacgttcccgtgtcctgattcctgtacgg

SEQ ID NO: 119236 - DNA, 572 bp, Homo sapiens
  misc_feature: GYAE6OF02IYYZY.5.86.H09.1.454.CMB.1.raw
  modified_base (309)..(309): a, c, t, g, unknown or other
  misc_feature (309)..(309): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctgtaccaacaacatccaggcaaacgcccccaaactcgtgatttcgngaggtcagtaagccggcctcgaggggtccctgactcgcttctctggctcagtcnggcaacncggcctcctgaccgtctcgtgggctccagactgaggatggaggtctagacttagttactcgcagtctactatttcgacaggcacgtaccgtaattacctcgttaccgggacgggtacgggaacccgaaggtccttacggtaacccgtccgttacgggtacgaaccggacccgtaacgggccttacccggcccccttaccggg

SEQ ID NO: 119237 - DNA, 583 bp, Homo sapiens
  misc_feature: GYAE6OF02I3X2N.5.86.H09.1.454.CMB.1.raw
  modified_base (330)..(330): a, c, t, g, unknown or other
  misc_feature (330)..(330): n is a, c, g, or t
  modified_base (357)..(357): a, c, t, g, unknown or other
  misc_feature (357)..(357): n is a, c, g, or t
  modified_base (450)..(450): a, c, t, g, unknown or other
  misc_feature (450)..(450): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtaccctacacatgaacagcctganagccgaggacacggccgtatatattgngtgagggaaactggggcaattgaccgctggggccagggaaccctggtcaccgtctcctcagcctccaccaagggcccatccggtcttccccgnggccgccctcgcctccacggacgccacccgtccgacgacgcacacggccgccctcgggcctcggccgtcggtaccgaaacgggtacccgttaaccgtttccccggtgttcccgtggtacttcgtcggtacggg

SEQ ID NO: 119238 - DNA, 563 bp, Homo sapiens
  misc_feature: GYAE6OF02FSAVR.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactggggcaattgaccgctggggccagggaaccctggtcaccggtctcctcagcctccgaccaagggcccatccggtcttccccctggccgccctgcctccaggacgccaccgtccgagacgccacgacgccggccctgggctcggcctggtccgaaggacctaccgttcccggtgtccgtgacttcgtgtacggg

SEQ ID NO: 119239 - DNA, 558 bp, Homo sapiens
  misc_feature: GYAE6OF02IPVH1.5.86.H09.1.454.CMB.1.raw
  modified_base (308)..(308): a, c, t, g, unknown or other
  misc_feature (308)..(308): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaccagcagtgacattggtcgttataactatgtctcctggtaccaacaacatccaggcaaacgcccccaaactcgtgactttcngaggtcagtaagcgcctgacggggtcctgatcgcttctcgtggcctcaagtctggacaacgcggcctccgtcgaccgtctcgtacggctccagactgacggatgacggtctagacttagttacgtgacacgtcttacgtagtttcgacgtacggcacgtaccgtatacgttcgtcgggacggtacggaccgtaagccgtacgtaccgtaccgtaggtcacgacccgaaggtcctaccgcccccgttacgg

SEQ ID NO: 119240 - DNA, 503 bp, Homo sapiens
  misc_feature: GYAE6OF02GKYXU.5.86.H09.1.454.CMB.1.raw
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
tcagatcagacacgcacgaccggtgctcgatttagtgctatagacttgggtttggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactgggaccagcagtgacattggtcgttataactatgtctcctggtaccaacaacatccaggcaaacgcccccaaactcgngattcngaggtcagtaagcggccctcacggggtccctgatccgcttctctgcctcaagtctggcaaacacggcctccctgaccgtctcgtgggctccagactgagatgagtcgtgacttatactgcagctcattgctagcagcctatcgtcgttcggcgaggaccaagctcgaccgtcgtagcacgccagccgtcgcccctcgg

SEQ ID NO: 119241 - DNA, 551 bp, Homo sapiens
  misc_feature: GYAE6OF02G0LZ5.5.86.H09.1.454.CMB.1.raw
  modified_base (306)..(306): a, c, t, g, unknown or other
  misc_feature (306)..(306): n is a, c, g, or t
  modified_base (410)..(410): a, c, t, g, unknown or other
  misc_feature (410)..(410): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgattcngagtcagtaagcgcctcgaggggtccctgactcgcttctctggctcaagtctgcaacacggccctccctgacccgtctcgtcgggccttccgagactgaggtangaggctcgacttagttactgcagctctatttgcaggcagtccgtatacgtcgttacgggcggacggaccgaaggtccgtacggtcccgttaccgtaggtaccgacgaccccgaaggcccttacccggacccccgttccggg

SEQ ID NO: 119242 - DNA, 605 bp, Homo sapiens
  misc_feature: GYAE6OF02IT45P.5.86.H09.1.454.CMB.1.raw
  modified_base (451)..(451): a, c, t, g, unknown or other
  misc_feature (451)..(451): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctgtaccaacaacatccaggcaaacgcccccaaactcgtgatttctgaggtcagtaagccggcctcgacggggtccctgatcgcttctctcggcctcgagtcgtcgacaacgaccggtccctcccgtacgtaccgtctcgtcgggcctaccgagtactggaggtatggacggctacgtacttacttacncgacacgtcctacgttagtttcgacgtacggcgtacgtaccgttacttacgttccgttacgggaccgggaacgggaaccgtaacggtccgtacggtacccgtaccgttacggtaccgacggtacccgacgggtcccgtcccggtccccgtccgg

SEQ ID NO: 119243 - DNA, 713 bp, Homo sapiens
  misc_feature: GYAE6OF02HCSYP.5.86.H09.1.454.CMB.1.raw
  modified_base (309)..(309): a, c, t, g, unknown or other
  misc_feature (309)..(309): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctctggtaccaacaacatccaggcaaacgcccccaaatcgtgtactttcngaggtcaagtaacgccggccctcgacggggtccctgactccgtcttctcgtcggcctaccgaagtcgtggaccaaaccgaccgggtccctacccgtcgtacccgttccgtccgtcggggccttcccgaacgtaccgtaggaacgggtacgttagggacggtcgttacggtaactttaacgttaccgtcgtaccgtaggtccttacgttaacgttttcggaccgtacgggaccgtaacggtacccgtttaacgttacccgttacgggtttcccggggacggggtaaccgggtaacccgtaaacggtcccgttaccgggtaaccccggttacccggttaacgggtacccgaaccgggtacccccggtaacgggtccccgttaccccggtaccccccgttacccggg

SEQ ID NO: 119244 - DNA, 697 bp, Homo sapiens
  misc_feature: GYAE6OF02HVNNL.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtcctccgtggacagtcagtccaccatctctgcacgtgggaccagcagtgactagttggtcgttaataactatcgtctccgtaggtaccaaacaaacataccgaaggaccaaaacgacccccaaaactcgtagtactttcgtagtaggtcaaggtaacgccggtcccgtacgaacgggggtccctaggtactccgtccttcgttcgtcggtacctcgaaagtcgtcggaacgaaccgaccggtccctcccgtccgtacccgtctccgtcgggccttccgaacgtacgtaggtaacggtagtcggacggtcttacggtaacttacgttaaccgtgacctaggaccttacgtaactttgccgtaaggaccgacgtaccgttacgtaacgttccgtcgggtaccgggtaacgggaacccgtaacggtaccgttacggtacccggttaccgtaacggtacccgtacggtaacccgtaaaccgggtccctcccgggtaccccccgtacccgg

SEQ ID NO: 119245 - DNA, 520 bp, Homo sapiens
  misc_feature: GYAE6OF02JDSLV.5.86.H09.1.454.CMB.1.raw
  modified_base (307)..(307): a, c, t, g, unknown or other
  misc_feature (307)..(307): n is a, c, g, or t
  modified_base (427)..(427): a, c, t, g, unknown or other
  misc_feature (427)..(427): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgatttcngaggtcagtaagcggccctcgaggggtccctgatcgcttctctggctacaagtctggcaacgcggcctcctgacctctcgtgggcctccgagactgaggatggaaggctagactattacngcagctcattgcagcagcctatctcgttcggcgacgggaccaaggctaggtaccctacgtacggcgacgcccaaggcctccgcccccgttcgg

SEQ ID NO: 119246 - DNA, 604 bp, Homo sapiens
  misc_feature: GYAE6OF02HRWNS.5.86.H09.1.454.CMB.1.raw
tcagatcagacacgcacgaccggtgctcgatttagtgctatagacgttgggtttggggtgctcgatttagtgctatagacttgggtttgggatctacgttgcaggtgtaggtctgggtccctgagactctcctgtgcagcctctggattcacctttactgattttggcatgacgtgggtccgcaggctccagggaaggggctgggactgggctctacaaatattaaagtggtaaaaggcaatataacaagactacacagactcgtgaagggccggttcaccacctcgagagacaactccagggacacggtgtacctacacatgaacagcctgagagccgaggacacggccgtatattattgtagtggaggggaaactgggggacaagtttgacgcgtggggccaagggaaccctggtacaccgtctcctcagcctacacccgaaggcccatcggtcttcccccgtggcccgtcccgtgcctccgaggtacgccacccgtccgacgacgtccacgacgccggacccgtgggccgtacgcccgtcggtccgaacgggtaccttaccgttccccgtcggtccgtacggtacgttcgtagtaccgggg

SEQ ID NO: 119247 - DNA, 632 bp, Homo sapiens
  misc_feature: GYAE6OF02H406Y.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctaggtaccaacaacactccaggaccaaacgaccccccaaactcgtcgtattttccgtgaggtcaaggtaacgccggccctcgacggggtcccctgactcgcttctcgtggcctacagtctggacaacgaccggcctcccgtacgtacccgtctccgtcgggtcctcgagacgtgaggatggaggtctagtaacttagttacctgactacgtccttactatttcggcgacggcgaacgtcccgttaacttaccgtccgtttaccggggaccgggtacgggtaccgaaggtcccgtacggtaacccggttacccggtaacggtccgaaccggaccccgtaagggtcccttacccggtccccccgttaccgg

SEQ ID NO: 119248 - DNA, 654 bp, Homo sapiens
  misc_feature: GYAE6OF02IDY5W.5.86.H09.1.454.CMB.1.raw
  modified_base (397)..(397): a, c, t, g, unknown or other
  misc_feature (397)..(397): n is a, c, g, or t
tcagatcagacacgcacgaccggtgctcgatttagtgctatagacgttgggtttggggctggggtctcaggaggcagcgctactcacggacgtcaccaccatggcctgggctctgctcctcctcaccctctcactcagggcacaggtcctggcccagtctgccctgactcagcctccctcgcgtcggtctcctggacagtcagtcaccatctcctggcacgtgggaccagcagtgactagttcggtacgttataactatgtctaccgttggtaaccaacaacatccgacggaccaaaagcccccctaaaattcggtagtatttcgtggacggtcaggttaacgcggcctcgacggggtccctgactcgcttctctggtctcgagtcgtcgactaacnccggtccttccgtcgaccgttctccgtcgggcctacgacgtactggacgtagtggacggtcttacggtacttagttactcgcgtaactccgttacgtagtttcgaccgtaggtccgtaacggtaccgttagttaacccggttccggtaccggggtaccgggaacgggtaacccgaacgggtaccgtacgggtaaccccgttacgttacgggtacctacgggtacccgtacggtccttaccccggtccccgttaccgg

SEQ ID NO: 119249 - DNA, 634 bp, Homo sapiens
  misc_feature: GYAE6OF02H33XB.5.86.H09.1.454.CMB.1.raw
  modified_base (403)..(403): a, c, t, g, unknown or other
  misc_feature (403)..(403): n is a, c, g, or t
tcagatcagacacgcacgaccggtgctcgatttagtgctatagacttgggtttggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactgggaccagcagtgacattggtcgttataactatgtctcctggtaccaacaacatccaggacaaaacgccccccaaaactccgttagactttcgtcgtaaggtctaaggttaagccggacccctacgaacgggggtccctggaactcgtccttctctggcctcccaagtctcggacaaaccnccggaccctccctcgacccgttctcgtgggcctccgagtacctgaggatggagtctagaacttagtactgcagtctctagtttcgacgacggccgtaagtccctaattaaccgttccgttaccggggacggtaccggggaaccctaaggtccgttacggtaccccgttacccgttagggtcccaacggtcccccgaaagggtcccgttaccccggtcccccgttacccggg

SEQ ID NO: 119250 - DNA, 654 bp, Homo sapiens
  misc_feature: GYAE6OF02HIIOE.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccgagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtggaggggaaacgtggggactaagttggaccgcgtcggggaccaacggggacccgtggtaccgtacccgtctccttcacgtccctaccgacccgaacgggccccaagtcccggttacccttccccccgtcgggccccgtccccgtcgcccttcccgaacgggtaccgacccaccccgttacccggaacgtaaccgccgaaccgtaccggacccgggcccgtgggacgtccggtaccgtcgggtaccaacgggtaccttaccgttcccggttgtcctggtactcgtaggtaccggg

SEQ ID NO: 119251 - DNA, 552 bp, Homo sapiens
  misc_feature: GYAE6OF02HNLZV.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagccccaaactcgtgattctgaggtcagtaagcggccctcgaggggtccctgatcgcttctctggctccaagtctggcaacacggcctccctgacccgtctcgtgggctccgagactgaggatgaggctgactacttactgcagctctatttcgcgtagcacgccgtataccgttccgtcggacggtacgggaccaaggtccgtacggacccgttaccgtaaggtaccacggccccgtaacggtccctccgaccccccgttacggg

SEQ ID NO: 119252 - DNA, 518 bp, Homo sapiens
  misc_feature: GYAE6OF02GU1LV.5.86.H09.1.454.CMB.1.raw
  modified_base (309)..(309): a, c, t, g, unknown or other
  misc_feature (309)..(309): n is a, c, g, or t
  modified_base (381)..(381): a, c, t, g, unknown or other
  misc_feature (381)..(381): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttcngaggtcagtaagcggcctcgaggggtccctgatcgcttctctggctccaagtctggcaacacggccctcccngaccgtctcgtgggctccagctgagatgagctgacttattactgcagctctatttcgctaggcagtccgtatcctcgtcggcgacggaccaggctacggaccgttccgtaggtcacgcccaaggcctcgcccctcgg

SEQ ID NO: 119253 - DNA, 667 bp, Homo sapiens
  misc_feature: GYAE6OF02JEDLG.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgagtcccgggtctcctggacagtcagtcaccatctcctgcacgtgggaccagccagtgacagttggtacgttataactatgtctctgtaccaacaacatccaggacaaacgccccaaatcgtagtactttcagtagtacagtaacgccggcctcgacggggtccctgactcgtcttctctcggtactacgtaacgtcgtgaccaaccgaccggtccctcccgtacgtacccgttcgtccgtcgggtccttacccgagtaccgtcggaacggtactacgggacgtcgtacgtaacttacgttacgtcgtacgtacgtcttacttagtttcgacggtacggtaccgacgttaccgtaacttaccgttcggtaccgggtaccgggtaacgggtaaccgtaacggttacctaccgggtaacccgttacccgttaaggacccgaaccggtacccgtaacgggtcccttaccccgggtcccccgttaccgg

SEQ ID NO: 119254 - DNA, 816 bp, Homo sapiens
  misc_feature: GYAE6OF02G1KGS.5.86.H09.1.454.CMB.1.raw
  modified_base (296)..(296): a, c, t, g, unknown or other
  misc_feature (296)..(296): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctcgccctgactcacgccctcccgtccgcgtccgggtctccgtggacagtcagtccaccatcctcctgcacgtcgggaccagcagtcgaactagtttggtacttaataacttatcgttcctccgtaggtaacccaaanaacactccgaaggaccaaaccgacccctaaagtcgtagtactttcgaggtacgtacgtaggtaacggccggtacccgtcggtacgggggttacctacgacgtccgttcttacgttcgtcggtaccgtaccgtaacgttccgtacggacctaaaccggacccggtcccgttacccgtacgtacccggttccgttccgggtacggtaccccgttaaccgaacggtaccgttagggaacggttacgtcgggacggttacgttacgttaaacgtttacgttacgtacgtaccgtacgttaccgttaccgttacgtttcggaccggtaacgggtacccgtaaacggttacccgttaacgttaacccgtttaccggggtttacccggggaccggggtaaaccgggtaacccggtaaacggtccccggtttaacgggtaacccccggttaccgggtttacggtacccggtaacccgggtaccccggttaaccggtcccggttacccccggtacccggttaccccggg

SEQ ID NO: 119255 - DNA, 596 bp, Homo sapiens
  misc_feature: GYAE6OF02JQG91.5.86.H09.1.454.CMB.1.raw
  modified_base (221)..(221): a, c, t, g, unknown or other
  misc_feature (221)..(221): n is a, c, g, or t
  modified_base (223)..(223): a, c, t, g, unknown or other
  misc_feature (223)..(223): n is a, c, g, or t
  modified_base (228)..(229): a, c, t, g, unknown or other
  misc_feature (228)..(229): n is a, c, g, or t
  modified_base (234)..(234): a, c, t, g, unknown or other
  misc_feature (234)..(234): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcncngacannatganatgtcgtatatatgtctctacgtacaacacactacacgacaacgacccaacctacgtcgtacttacgtgagtacgacgtacgccgccgtcgtacggtccgtcgtacgtcgtctctcgtcgtctacgtacgtcgtcgacgaccgaccgtccgtccgtcgtaccgtcgtcgtcgtcgtaccgtacgtacgtacgtaggtagtagtacgtacgtacgtacgtacgttacgtacgtacgtacgtcgtacgtacgttacgtacgtacgtacgtacgtacgtacgtacgtcgtacggtacggacggtaacgtacgtacgtacgtaccgtacgtacgtacgaccgtaccgtacggtaccgtccgtcccg

SEQ ID NO: 119256 - DNA, 675 bp, Homo sapiens
  misc_feature: GYAE6OF02GURUZ.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgacattggtcttataactatgtctcctggtaccaacaacatccaggacaaacgccccccaaactcgtgtactttctgaggtcagtaagccggccctcgacggggtccctgactcgtcttctctcggctaccgaagttcgtacggaccaaccgaccggtccctcccgtcgtacccgttcctccgtcgggtcctccgacgtacgtggaggtagtacggacggtcgttagtaaccttaacgtttaccgtacgaccacggtccttacgttacgtttcgaccgtaggacctacgggtacccgttaacttaccgttaccggttaccggggacccggggtaacgggacccgtaaggtcccgttaccgggtaccccgttaccggttaccggtaccgtaccggaccccggtaacgggtcccgtaccccggtccccccggttacccgg

SEQ ID NO: 119257 - DNA, 683 bp, Homo sapiens
  misc_feature: GYAE6OF02IOZZC.5.86.H09.1.454.CMB.1.raw
tcagatcagacacgcacgaccggtgctcgatttagtgctatagacttgggtttggggctggggtctcaggaggcagcgctctcaggacgtcaccaccatggcctgggctctgctcctcctcaccctctcactcaggcacaggtcctgggccagtctcgccctgactcacgcctccctcgcgtccggtctcctggacagtcacgtcaccatctcctgccactgggaccagcaagttcgacagtttcggtccgttaataactaactgtcctccttaggtaccaaacaactatccaggacaaaaccgccccaaaactcgtacgtactttctgacgtacaagttaacggcggtaccctcgtacgggggtccctaggtacgtcggtcttctcgtcggtacctaccgtaaacggttctacgggacaaaccgtacccggtccctccgtaaccgtaccgttccgtcgtcggggaccttccgaaagtcccgttgaaacggtagtacgtagggtccttacggtaacttactttagacgtaccgacgtcgtacgtaactttacgcgaacggttccacggtaccttagtaaccgttcgttcgggaccggtacggaaccgtaagtccgttacggacccgttaccgttaggaaccgtcgtaaccccgtaaggcccgttacccgtaccccgttcccgg

SEQ ID NO: 119258 - DNA, 670 bp, Homo sapiens
  misc_feature: GYAE6OF02ICUIN.5.86.H09.1.454.CMB.1.raw
  modified_base (308)..(308): a, c, t, g, unknown or other
  misc_feature (308)..(308): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaatcgtgtatttcngagtcagtaacgcggccctcgacggggtccctgatcgcttctctgctcagtctggcaacgccggcctcccgtgaccgtctcgtcgggcctccagaccgtggacggtagtggaggtcctagtaacttagtttacgtgtaccgtaacggtcttccgtaagttttcgaccgtaacgggtccgaacggttcccgttaacgttaacccgtttccggttaccggggaccggggtaaccggggtaacccgtaaacgggtccgttaaccggggtaaccccgtttacccggttaaggggttccccgtaaacccggtacccccggtaaaacggggtccccgttaccccgggtccccccccgtttaaccgggg

SEQ ID NO: 119259 - DNA, 557 bp, Homo sapiens
  misc_feature: GYAE6OF02IOQ59.5.86.H09.1.454.CMB.1.raw
  modified_base (265)..(265): a, c, t, g, unknown or other
  misc_feature (265)..(265): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (406)..(407): a, c, t, g, unknown or other
  misc_feature (406)..(407): n is a, c, g, or t
  modified_base (423)..(423): a, c, t, g, unknown or other
  misc_feature (423)..(423): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctctcactcagggcacagggtcctgggcccagtctgccctgactcagccctccctccgcgtccgggtctcctggacagtcagtccaccatctcctgcactgggaccagcagtgacatttggtcgttataactatgtctnatggtaaccaacaacatccaggacaaacgacccccaaactcgtgatttctgaggtcagtaacgcggccctacgagggtccctgactcgcttctctgctcagtcngcaacncgcctccngacctntctggctcagactgagnngagctgacttattacngcacgctactagtttgacgaggccacggtccgtaattaccgttccgtcgggacggacgggaaccaacggtcgtacggtacccgttccgtacggtaccaccggacccgaacggtcccgtacccggtaccccccgg

SEQ ID NO: 119260 - DNA, 633 bp, Homo sapiens
  misc_feature: GYAE6OF02FRSS2.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctctggtaccaacaacatccaggacaaacgccccaaactcgtgatttctgaggtcagtaacgcggccctcgacggggtccctgactcgtctctcgtcgtctacgtacgtcgtacgaccaaccgtaccgtcccttccgtacgtaccgtccgtcggtcggtcctaccgacgtacgtaggagtacgaggacggtcgtaacgtactttactacgtgactcgtcttacttagttcgacgtacgtacgtaccgttaccgtacttaccgttccggtcgggaccgggtaacgaaccgtacgtaccgtacccggtacccgttaccggttaaccggtacgacccggtaaccggaccggtcccgttccccggtccccggtaccgg

SEQ ID NO: 119261 - DNA, 579 bp, Homo sapiens
  misc_feature: GYAE6OF02I7TLR.5.86.H09.1.454.CMB.1.raw
  modified_base (564)..(564): a, c, t, g, unknown or other
  misc_feature (564)..(564): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcaccttttactgattttggcatgacgtgggtccgccaggctccagggaggggctggactggctctcaaatattaatggtaaaggcaatatacaagactacacagactccgtggaagggccggttcaccacctcgagagacaactccagggacacggtgtacctacacatgaacagcctgagagccgaggacacggccgtatattattgtgtggaggggaacgtggggcaagttgaccgtcgtcggggccgacgggaacccgtggtcaccgtctccgcacgccctccaccgaacggcccagtccggttaccttcccccgtggccgccctgcctccgacggcgccaccgtccgagacgcacgacgccggccgtcgggctcgcgtcggacgacggtacctccgttccggtcgttccgngtactcgtgtacggg

SEQ ID NO: 119262 - DNA, 677 bp, Homo sapiens
  misc_feature: GYAE6OF02JMQMG.5.86.H09.1.454.CMB.1.raw
tcagatcagacacgcacgaccggtgctcgatttagtgctatagacttggtttgggggctggggtcgtcaggaggcagcgctctcaggacgtcaccaccatggcctgggctctgctcctcctcaccctcctcactcaggcacaggtcctgggcccagtctgccctgactcagcctccctccgcgtccggtctcctggacagtcagtcaccatctcctgcactggaccagcagtcgacagttggtcttataactatgtctcctggtaccaacaacatccagacaaacgccccaaactcgtagtactttcagtacggtcaagtaacgcgccctcgacggggtaccctgaactcgtctctctcggctaccgaagtctggacctaacgacggcccttccgtagtacccgtctaccgtcgggtcctacccgacgtacttcggaacggtacgtacggacggtctcggtaaccgttacgttaaccgtggtaccaaggtccctagtaacgttttcggacgttacgggacctacggtaccgttaaacttaccgttcgtttaccggggacgggttaacgggtaaccccgtaagggtaccgttacggtaaccccggtttaccgtaacgggttacccaaccgggaaccccgttaacgggtccccgttaccggtcccccccggttaccggg

SEQ ID NO: 119263 - DNA, 523 bp, Homo sapiens
  misc_feature: GYAE6OF02FTCRF.5.86.H09.1.454.CMB.1.raw
  modified_base (369)..(369): a, c, t, g, unknown or other
  misc_feature (369)..(369): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgccccaaactcgtgatttctgaggtcagtaagcggccctcgacggggtccctgatcgcttctctggctcaagtctggcacncgcctcctgaccgtctcgtggcctcagactgaggatggagtctgacttattacgtgacagctactattgcgaggcagtccgtatactcgtcggcggacggaccgaagccgtgacccgttcgtaggtccacgccgaacggctccgccccgtacgg

SEQ ID NO: 119264 - DNA, 503 bp, Homo sapiens
  misc_feature: GYAE6OF02IW9J7.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaaacgcccccaaatcgtgatttctgagtcagtaagcggccctcgaggggtccctgactcgcttctctggctcagtctggcaacacgcctcctgacccgtctcgtggcctccgagactgaggatgagctagactattactgcagtctcgtatttgcaggcacgccgtatctcgtcggcggaggacaagctagccgtctgcacgccgagctcgcccctcg

SEQ ID NO: 119265 - DNA, 758 bp, Homo sapiens
  misc_feature: GYAE6OF02I36GZ.5.86.H09.1.454.CMB.1.raw
  modified_base (216)..(216): a, c, t, g, unknown or other
  misc_feature (216)..(216): n is a, c, g, or t
  modified_base (275)..(275): a, c, t, g, unknown or other
  misc_feature (275)..(275): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcnctgcacgtggaccagcagtgactagttcggtgttaataactatgtcctcgtacggtaanaaccaactactaccgaggacaaaacccgaccccctaaacgtcgtagtatttcgaggtacgtcaagtaagccggtccctaggtacggggtccctaggtacgtccgtacgttcctcggtcggtcctacgtaaacgttcgtacgggaacctaaaccggtaccgggtaccccttcccgtacggtaacccgtccgttaccggtcgggtaccgtacccgtaacgtacgtacggtaacggtacggtacggtacggtacgttacgtaaccgttaacgttaaccgtacgtacgtacgtacgtaccgttacgtttacgtacgtaacggtacgtaccgtaccggttaacgttaacccgtttaccggttacccgggtaccggggtaaccgggtaaacacgggtacccggttaaccggtaacccggttacccggttaaccgggttacccggtaaccggtaccccggtaaccgggtacccgttacccggtacccccg

SEQ ID NO: 119266 - DNA, 672 bp, Homo sapiens
  misc_feature: GYAE6OF02ILKF4.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctcgcgtccgggtctcctggacagtcagtcaccatctctgcactgggaccagcagtcgactatttgggtcgttaataactatcgtctcctggtaaccaacaacactccaaggaccaaaacgcccccctaaaactccgtagtactttctgacggtcaagtaacgccggccctacgacggggtccctgactcgtcttctcgtggccttacgaacgtctggaccaaacgacggccctcccgtcgaccgtctcgtcgggcctaccgacgacgtggacgtaagtggacggtcgtacgtacttaacgttacgtcgacacgtcttacgttaacgtttcgacgacggtacaacgtaccgttaactaccgttacggtttccgggaccgggtacgggtaacccgtaaacgggtccgttaccggaaccccggtttaccgttaaccgggacctaaccgggtaccccgtaaacgggtcccgttacccggtccccccggttaccggg

SEQ ID NO: 119267 - DNA, 527 bp, Homo sapiens
  misc_feature: GYAE6OF02F0KAK.5.86.H09.1.454.CMB.1.raw
  modified_base (524)..(527): a, c, t, g, unknown or other
  misc_feature (524)..(527): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaatttgaccgctggggccagggaccctggtcaccgtctcctcagcctccaccaagggcccatcggtcttccccctggccgccctgctccaggacgccacctccgagacgcacacgcggccctgggctgcctggtcaaggactacgtcccgtgtctgactctgcggcggctggcgaggcgcagtgnnnn

SEQ ID NO: 119268 - DNA, 517 bp, Homo sapiens
  misc_feature: GYAE6OF02ICLU4.5.86.H09.1.454.CMB.1.raw
  modified_base (295)..(295): a, c, t, g, unknown or other
  misc_feature (295)..(295): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcacatctcctgcactgggaccagcagtgacattggtcgttataactatgtctcctgtaccaacacatcagcaaacgccccaaatcgtnattctgaggtcagtaagccggcctcgaggggtccctgactcgcttctctggctcaagtctcggacaacgaccggcctcccgtgacccgtctcgtgggctccgagactgagtatgagctagacttattactgcagctctagtttcgcaggcagtccgtatcctcgtcggcgggacggaccgagtctcgaccgtcgtaggcacgccgaaggcctcgcccctcgg

SEQ ID NO: 119269 - DNA, 553 bp, Homo sapiens
  misc_feature: GYAE6OF02GLMMQ.5.86.H09.1.454.CMB.1.raw
  modified_base (371)..(371): a, c, t, g, unknown or other
  misc_feature (371)..(371): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaaatcgtgatttctgaggtcagtaagcggccctcgaggggtccctgatcgcttctctggctccgaagtctgcaacnccggccctccctgaccctctcgtcgggctccagactggagatgaggtctagtacttattacgtgcagcttctatttgcgaggcagaccgtataccttcgttcggacggacgggaccaaggtccgtacggtaccgttaccgtaggtccgacggaccccgtaaggcctaccggcccccttacgg

SEQ ID NO: 119270 - DNA, 546 bp, Homo sapiens
  misc_feature: GYAE6OF02H77EF.5.86.H09.1.454.CMB.1.raw
  modified_base (371)..(371): a, c, t, g, unknown or other
  misc_feature (371)..(371): n is a, c, g, or t
  modified_base (465)..(465): a, c, t, g, unknown or other
  misc_feature (465)..(465): n is a, c, g, or t
  modified_base (481)..(481): a, c, t, g, unknown or other
  misc_feature (481)..(481): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgatttttggcatgacgtgggtccgccaggctccagggaagggctggactggctctcaaatattaatggtaaaggcaatatacaagactacacagactccgtgaagggccggttcaccactcgagagacaactccagggacacggtgacctacacatgaacagcctgagagccgaggacacggccgtatattatgtgtgaggggaactggggnaatttgacgctggggccgagggaaccctggtcacccggtctcctcacgcctccaccaagggcccatccggtcttcccctggccgccctgcctcncggactccacctccgngacgcacagcggcctgggcctggcctggtcaaggacctaacgttcccgtggtctgactctgacgg

SEQ ID NO: 119271 - DNA, 580 bp, Homo sapiens
  misc_feature: GYAE6OF02G26XT.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattattgtgtgaggggaaactggggcaagtttgaccgctggggccagggaaccctggtcaccgtctcctcacgcctccaccgaacgggccccagtccggtccttcccccgtggccgccctcgcctccagggacgccaccctccgacgacgccacgacggccggccctgggcctcggccctcgggtcaacggtaccttaccgttcccgtcgtctacggacttcgtggtacggg

SEQ ID NO: 119272 - DNA, 568 bp, Homo sapiens
  misc_feature: GYAE6OF02FOB1E.5.86.H09.1.454.CMB.1.raw
  modified_base (315)..(315): a, c, t, g, unknown or other
  misc_feature (315)..(315): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggacaaacgaccccccaaactcgtagtatttcgnggaggtcaggtaacgccggtccctcgacggggtccctgactcgcttcnctgctcaagtcngcaacncgcctcctcgaccgtctcgtcggctccgagctgaggancggagctagacttattacgngcagtctctatttcgcgaggcacgtccgtatacgttcgttccgggacggacgggaaccgaggtccgtacggacccgttacgttaacggtccgacggtacccgaacgggtccttaccggcccccgtacgg

SEQ ID NO: 119273 - DNA, 575 bp, Homo sapiens
  misc_feature: GYAE6OF02IH1IJ.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaagggctggactggctctcaaatattaatggtaaaggcaatatacaagactacacagactccgtgaagggccggttcaccacctcgagagacaactccagggacacggtgtaccctacacatgaacagcctgagagccgaggacacggccgtatattatgtgtgaggggaaactggggacaagtttgaccgcgtggggccaggggaaccctggtcaccgtctcctcacgcctcaccgagggcccagtccggtcttccccgtcggccgcccgtgcctccgaggacgccaccgtccgagacgccacacgccgacccgtgggcctcggcctcggtacaacggtaccttaccgttcccgtcgtcgtcgacttccgtagaccggg

SEQ ID NO: 119274 - DNA, 522 bp, Homo sapiens
  misc_feature: GYAE6OF02FYY9F.5.86.H09.1.454.CMB.1.raw
  modified_base (308)..(308): a, c, t, g, unknown or other
  misc_feature (308)..(308): n is a, c, g, or t
  modified_base (364)..(364): a, c, t, g, unknown or other
  misc_feature (364)..(364): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaatcgtgatttcngaggtcagtaagcgcctcgaggggtcctgactcgcttctctggctcagtctgcacncgcctccgtgaccgtctcgtcggcctccgagacgtgagatggacgtctgacttatactgcagctctatttgcaggcagtccgtactacgtcgttcggcggacggaccgaaggctacgaccgttcgtacgtcacgacccgaaggtcctccgcccctcgg

SEQ ID NO: 119275 - DNA, 593 bp, Homo sapiens
  misc_feature: GYAE6OF02GFMIW.5.86.H09.1.454.CMB.1.raw
  modified_base (259)..(259): a, c, t, g, unknown or other
  misc_feature (259)..(259): n is a, c, g, or t
  modified_base (460)..(460): a, c, t, g, unknown or other
  misc_feature (460)..(460): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaagcaatatacaagactacacagactccgngaaagggccggttcaccacctcgagagacaactccagggacacggtgtacctacacatgaacagcctgagagccgaggacacggccgtatattattgtgtgaggggaaacgtggggctaagtttgaccgcgtggggccgagggaaccctggtcaccgtctcctcacgcctccaccgaacggcccatccggtcttcccccgnggcccgccctcgcctccgacggacgccaccgtccgacgacgcacgacgccggcccgtgggcctcggcccgtggtaccgaacggtaccgttacccgttcccgtcggttccgtcggtacttccgtgtacccgggg

SEQ ID NO: 119276 - DNA, 640 bp, Homo sapiens
  misc_feature: GYAE6OF02I2ZQH.5.86.H09.1.454.CMB.1.raw
  modified_base (506)..(506): a, c, t, g, unknown or other
  misc_feature (506)..(506): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgggaccagcagtgacattggtcttataactatgtctcctgtaccaacaacatccaggacaaccgacccccaaactcgtgtatttcgtgacggtacagtaacgcccggcccttcgaccggggttcctggactccggtcctttcgtcgtcggtacctaccgaagtcgtagggaccaaccgaccggtccctcccgttcgacccgtcgttcgtacgggtcctaccgagtacctagggaaggtagtacgggagtccttagtacttacttacgtgaccgtagtcctnttacgtttcgacgtacggaccgtagtaccgttacttacgttccgttccggggcggaacgggtacccgaaggtccgtacggtacccgttaccgtaggtccgaccgtacccggaggtccctaccgaccccggtccg

SEQ ID NO: 119277 - DNA, 606 bp, Homo sapiens
  misc_feature: GYAE6OF02IIU8G.5.86.H09.1.454.CMB.1.raw
  modified_base (599)..(599): a, c, t, g, unknown or other
  misc_feature (599)..(599): n is a, c, g, or t
  modified_base (603)..(603): a, c, t, g, unknown or other
  misc_feature (603)..(603): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaaggcaatatacaagactacacagactccgtgaagggccgttcaccactcgagagacaactccagggacacggtgtacctacacatgaacagtctgagagccgaggacacggccgtatattattgtgtgaggggaactgggggcaagtttgacgctggggccagggaaccctggtcaccgtctccgtcacgccctaccgaccaagggcccaacgtccggtccttcccccgtgggcccgtcccctcgcctcccgaggacgccacccgttccggacgtacgccaaccgacggccggacccgttggggcctcggcccgtacggtacaacgggtaccttaccgttcccgtgttcccgttgtacttccgtgaccggtcgggtcctgggaccaacgggccaccgtagtacgcncgtnacg

SEQ ID NO: 119278 - DNA, 549 bp, Homo sapiens
  misc_feature: GYAE6OF02FGZAD.5.86.H09.1.454.CMB.1.raw
  modified_base (471)..(471): a, c, t, g, unknown or other
  misc_feature (471)..(471): n is a, c, g, or t
  modified_base (489)..(489): a, c, t, g, unknown or other
  misc_feature (489)..(489): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaatatacaagactacacagactccgtgaaggccggttcaccacctcgagagacaactccaggggacacggtgtacctacacatgaacatcctgagagccgaggacacggccgtatattattgtgtgaggggaaactgggggcaatttgaccgctggggccagggaaccctggtcaccgtctcctcagcctccaccaagggcccatcggtcttccccctggccgccctgcctccaggngcaccctccgagagcacngccggccctgggctcggactggtccaaggacctacgttcccgtgtcctgactctgacggg

SEQ ID NO: 119279 - DNA, 542 bp, Homo sapiens
  misc_feature: GYAE6OF02GTYPT.5.86.H09.1.454.CMB.1.raw
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (371)..(371): a, c, t, g, unknown or other
  misc_feature (371)..(371): n is a, c, g, or t
  modified_base (429)..(429): a, c, t, g, unknown or other
  misc_feature (429)..(429): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggacaaacgcccccaaactcgtnatttcngaggtcagtaagcggccctcgaggggtccctgatcgcttctctggctcaagtctggcaacncggcctccctgaccgtctctgggcctccagactgaggatggaggctgacttattacgngcagctctagtttgcaggcacgtccgtatacttcgttcggacgggacggaccgaaggtccgtacgacccgtccgtaggtcgacgacccgacggtcctcccggtccccctccgg

SEQ ID NO: 119280 - DNA, 679 bp, Homo sapiens
  misc_feature: GYAE6OF02JJE9Z.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgtcctgactcagcctccctccgcgtccgggtctcctggacagtcagtcaccatctcctgcactgggaccagcagtgacattggtcttataactatgtctcctggtaccaacaacatccaggacaaacgacccccaaactcgtacgtactttcgtagaggtcagtaacgcggtccctacgacggggtccctaggactcgtcttctcgtcggcctaccaagtcgtacgaccaacgacggccctccctcgtacccgtcgtcgtcgggacctccgagactaggagtatcggacgctagacttatcgtagctagtcctacgtagtttcggacgacggtacctaggtacccgttaacgtttaccgtaccgttaccggggtaccgggtaaacggggtaccccgtaaagggtcccggttaacccggtaaccccgggttacccggttaacggggttacccgtaacccgggtaacccccggtaaacggggttccccgttaccccgggtacccccccggtttaaccggg

SEQ ID NO: 119281 - DNA, 604 bp, Homo sapiens
  misc_feature: GYAE6OF02IQX1V.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatcctcctgcacgtgggaccagcagtcgactagttggtacgttataactatgtctcctggtaaccaacaacactaccgaggacaaaccgacccccaaactcgtgtactttctgagtctagtaacgcgcccgtcgacggggtcctgacgtcgtcttctcgtggcctacagtcgtacggacaacgccgtccctccgtcgtacccgtctcgtcggctaccgagtactggagagtggagtctcgtacttattcgtcgtacagtctcttattcgcgtacggctacgtaccgttattccgtcgttacgggaccgggacggtaaccgacgtccgtacggtacccgtacgttacggaccgtaccgacccggaaccgtccgtacccgtccccgttaccgg

SEQ ID NO: 119282 - DNA, 577 bp, Homo sapiens
  misc_feature: GYAE6OF02HYRSA.5.86.H09.1.454.CMB.1.raw
  modified_base (319)..(319): a, c, t, g, unknown or other
  misc_feature (319)..(319): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (448)..(448): a, c, t, g, unknown or other
  misc_feature (448)..(448): n is a, c, g, or t
tcagatcagacacgcacgaccggtgctcgatttagtgctatagacgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactcgggaccagcagtgactagttggtacgttaataactatcgtctccgtgtaaccaacacatccaggacaaacgcccccaaatccgtagtatttcngagtcagtaacgcgcctgacgggtccngactcgcttcncgtgctacagtctgaccaacgcggccctccgtacgacccgtctccgtggcctacagactaggacgtatcggtagcttagtactacttacgngcagtctagtagttcgacgtagccgacgtccgtatccgtcgttacggacggacggtaccgtaagcccgtacggtacccgttccgtaggtacctaccggcccgtaacggtccctacccggccccgttacg

SEQ ID NO: 119283 - DNA, 840 bp, Homo sapiens
  misc_feature: GYAE6OF02H3AFV.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgactagttggtacgttataacttatgtcctccttggtaccaaacaacactccaaggaccaaaacgacccccctaaaatccggtagtactttcgtaggtacggtcaagtaacgcccggccctacggacgggggttcccctaggtaaccttccgtccgtttccgttaccgtcgggtacctacccgtaaacggttccgttacggggaaccaaacccgtacccgggttcccccttaccccggtaccggtaccccgtttccgtaccggtttccgggggtcccctttaccccggaacggttaaccgtacgggtaaacggggtacgttacgggtaacgggtacccgttaacggttaacctttaacgtttaacccgtcgaccgtaacggttcccttacgttaacgttttcggaaccgtacgggtaccgtacgggttaaccccgttaattaacccgtttccggtttacccggggaccggggtaacggggtaaaccctaacgggttaccggttacccgggtaaccccggtttcccggttaacggtacccggttaacccggaaccccggtaaacgggttccccgttacccccgggtccccccgtttaacccggg

SEQ ID NO: 119284 - DNA, 569 bp, Homo sapiens
  misc_feature: GYAE6OF02I4PLE.5.86.H09.1.454.CMB.1.raw
  modified_base (215)..(215): a, c, t, g, unknown or other
  misc_feature (215)..(215): n is a, c, g, or t
  modified_base (325)..(325): a, c, t, g, unknown or other
  misc_feature (325)..(325): n is a, c, g, or t
  modified_base (355)..(355): a, c, t, g, unknown or other
  misc_feature (355)..(355): n is a, c, g, or t
  modified_base (446)..(446): a, c, t, g, unknown or other
  misc_feature (446)..(446): n is a, c, g, or t
  modified_base (468)..(468): a, c, t, g, unknown or other
  misc_feature (468)..(468): n is a, c, g, or t
  modified_base (532)..(532): a, c, t, g, unknown or other
  misc_feature (532)..(532): n is a, c, g, or t
  modified_base (554)..(554): a, c, t, g, unknown or other
  misc_feature (554)..(554): n is a, c, g, or t
  modified_base (566)..(567): a, c, t, g, unknown or other
  misc_feature (566)..(567): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaaaggcaaatataacaagactanacagactccgtgaagggccgttcaaccacctcgagagacaactccgagggacacggtgtacctacacatgaacagcctgagagccgaggacacggccgtatattatgtgngaggggaaactgggggacaagtttgaccgngtgggccagggaccctggtcacggtctctcacgcctccaccgaacggccagtccggtccttccccgtgccgtccctcgcctccgacggacnccgaccctccgagacgcaccgngccggccgtcggccgtcgccgtgaccgaacggtacctaccgttccgtcgtcgtgactcgtacgnggaccggcgtggccaagggtcncgagtacgcgtnncg

SEQ ID NO: 119285 - DNA, 643 bp, Homo sapiens
  misc_feature: GYAE6OF02HCTE0.5.86.H09.1.454.CMB.1.raw
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacagtcagtcacatctcctgcactgggaccagcagtgacattggtcgttataactatgtctctggtaccaacaacatccaggcaaacgccccaaatcgtntattcngagtcagtagccggcctcgacgggtcctgactcgtcttctctcggctaccgagtcgtacgaccaacgacggtccctcccgtcgacccgtcgtccgtacgggtcctaccgacggtacgtaggacggtacgttaggacggtacgtaacggtactttaacgttaccgtacgcgtaacgtcccttacgttacgtttacggacgtacgggtaccaacgcgtaacgccgtaccgtaccccgtagttcggttacggtctttccggttacgggggacccggggtaacctacgggtccgtaccggggtacccttccggtaacgggtccgtacccggtaaccccggg

SEQ ID NO: 119286 - DNA, 770 bp, Homo sapiens
  misc_feature: GYAE6OF02HYVM2.5.86.H09.1.454.CMB.1.raw
  modified_base (317)..(317): a, c, t, g, unknown or other
  misc_feature (317)..(317): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacagtcagtcaccatctcctgcacgtgggaccagcagtgacattggtacgttaataactatgtctcctggtaccaacaacatccaggacaaacgcccccaaatcgtagtatttcgngaggtcagtaacgccggccctcgacggggtccctgactcgcttctctggtctaccgaagtcgtcggacctaacgaccggtccccttcccgtacggtaccccgttcgttaccggttcggggtaccctacccgtaacggtaccgttacgggtaacggtaacggttcgggaacgggtaccgttacggttaaccgtttaacgtttaaccgttcggtaccgtacggtacctttaccgttaacggttttacggaccgtaacgggtaccgtaaccggttacccggtttaaacgttacccgttaccgggttacccggggtaccggggtaaccgggtaacccggtaaacggtccccgttaaccgggtaacccccggttacccggttaaccgggtacccggtaaccggtacccccggtaaaccgggtccccgttacccccgggtcccccccggtttacccggg

SEQ ID NO: 119287 - DNA, 596 bp, Homo sapiens
  misc_feature: GYAE6OF02HAZ0L.5.86.H09.1.454.CMB.1.raw
  modified_base (432)..(432): a, c, t, g, unknown or other
  misc_feature (432)..(432): n is a, c, g, or t
  modified_base (459)..(459): a, c, t, g, unknown or other
  misc_feature (459)..(459): n is a, c, g, or t
  modified_base (589)..(589): a, c, t, g, unknown or other
  misc_feature (589)..(589): n is a, c, g, or t
  modified_base (594)..(594): a, c, t, g, unknown or other
  misc_feature (594)..(594): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaaggcaatatacaagactacacagactccgtgaacgggccggttcaccacctcgagagacaactccagggacacggtgtacctacacatgaacagcctgagagccgaggacacggccgtatattatgtgtgaggggaaactgggggcaagtttggaccgcgtgggggccaggggaaccctgggtccaccgtctcctcacgccctcccaccgaacgggcccaagtccggtccttcccccgnggcccgtcccctgccttccgagggacnccaccctccgagacgcacacgccggcccgtgggctcggccgtggtaccgaaggtcctaccgttcccgtgtcgtgacttcgtaggacggccggggtctcgggtccgaaagggtcccgagtaacgttacggntacgncg

SEQ ID NO: 119288 - DNA, 587 bp, Homo sapiens
  misc_feature: GYAE6OF02HMT2D.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactgggaccagcagtgacattggtcgttataactatgtctcctgtaccaacaacatccaggcaaaacgcccccaaactcgtagatttctgaggtcagtaagcggccctcgacggggtccctgatcgcttctctggctcaagtctggcaacgaccggcctcccgtgacccgttctcgtcgggccttccagtactggacggtatggacggcttaggacttacttacgtgtacacgtctacgtagtttcgccgtaggcaacgtcccgttataccgttcgttcgggacgggtacgggaaccgtaaggcccgtacggacccgttaccgtacggtacaccggacccgtacggtccgtacccgcccccgtacgg

SEQ ID NO: 119289 - DNA, 563 bp, Homo sapiens
  misc_feature: GYAE6OF02G9LG2.5.86.H09.1.454.CMB.1.raw
  modified_base (308)..(308): a, c, t, g, unknown or other
  misc_feature (308)..(308): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaatcgtgatttcngagtcagtaagcgcctcgacggggtccctgactcgcttctctcggcctcaagtctggaccaacgccggcctcccgtgacccgtctcgtcggcctccgacgtacgtggaggtagtaggacgcgttagtacttattacgtcgactacgtctctactttgacgtaggcacgtccgtactacgtccgttcgggacggacggaaccgaacgtcgtacgtaccgttccgtaggtacgacgccgacggctccgccccgtcgg

SEQ ID NO: 119290 - DNA, 622 bp, Homo sapiens
  misc_feature: GYAE6OF02G7JQ1.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaaatatacaagactacacagactccgtagaagggccggttcaccacctcgagagacaactccgagggacacggtgtacctacacatgaacagcctgagagccgaggacacggccgtatatattgtgtgaggggaaactggggacaagttgaccgcgtcggggccgacgggaacccgtcggtcaccgtcctccgtcgacgccctcaccgaacgggcccagtccggtcccttccccgcggccgccctcgcctcccgaggaccgccgtaccgtccgacgacgccgaaccgacggccgggcccgtcgggtcctcgggtcccgttacgggtacgtaaacggtacccgttaccgttcccggttcgttccgtaggtaccgttcgtacggtacggg

SEQ ID NO: 119291 - DNA, 619 bp, Homo sapiens
  misc_feature: GYAE6OF02HWOTG.5.86.H09.1.454.CMB.1.raw
  modified_base (471)..(471): a, c, t, g, unknown or other
  misc_feature (471)..(471): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactgggaccagcagtgacattggtcgttataactatgtctcctggtaccaacaacatccaggacaaacgcccccaaactcgtgatttctgagtcagtaagccggccctcgacggggtccctgactccgcttctctggcctaccgaagttccgtggaccaaccgaccggtccccttacccgtcgtacccgttcctccggttcgggcctaccgagacgtggacggagtcggaggcttaggtacttacttacgngactagcttacgtatttcggacgtaacggccgtacgtccgttactaccgttccgtcggggtacgggacggtaaccgaacggtccgtacggtaaccccgtccgttagggtaccacggtcccgaacggtccgttcccgccccccgttcgg

SEQ ID NO: 119292 - DNA, 799 bp, Homo sapiens
  misc_feature: GYAE6OF02G5Z83.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgggaccagcagtgactagttggtacgttataactatgtctccgtgtaccaacaacatccaggacaaacgaccccccaaacgtcgtagtactttcgtggtaacggtcaaggtaaacggtcccgggaccccttcgggtaacgggggttcccctaggtactccggtccttccgtcgttcgggtccttacccgtaaggttccgtacggaaccaacccgtacccggtccccttcccgtacggtacccgtccgtccggtcggggtccctaccgaaggtacctggacggtagtcggacggtcttacgtaacttacgttacgtcggtactacggtccttacgttacgtttacggaccgtaacgggtacccgtaacgggttacccggtttaaacttaacccggtttccggttaccgggggtacccggggtaaccggggtaaacccgtaaccgggttaccccggttaaccgggtaacccccgggtttaaccccggttaacggggttaccccggtaacccgggtaaccccggtaacccggggtacccccgttaccccggggtaccccccccggtttaacccgggg

SEQ ID NO: 119293 - DNA, 666 bp, Homo sapiens
  misc_feature: GYAE6OF02JFX9Z.5.86.H09.1.454.CMB.1.raw
  modified_base (304)..(304): a, c, t, g, unknown or other
  misc_feature (304)..(304): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacaggtcctgggcccagtctgccctgactcagcctccctccgcgtccgggtctcctggacagtcagtccaccatctcctgcactgggaccagccagtgacattggtcgttataactatgtctctggtaccaacaacatccaggcaaacgccccaaatcgtgattcngagtcagtaacgcggtcctcgacggggtccctagactccgcgttcctcgtcggctaccgtaagtcctacggactaaacgccggccctcctcgtacccgttcctccgtcgggccttaccgacgtacgtacggaacggtacgttacgggaacggtcctacggtaacctttacgttaaccgtcgtactaacggtccttacgtacgttttaccggacgtaccgggtacctacgggttacccgtactttaacccgtacgttacccgggacgggtaacgggtaacccgaaacggtcctacgggtaccccgttacgtacggtaccgtacggtacccgtaacgggtcctaccccggtcccccgttccggg

SEQ ID NO: 119294 - DNA, 581 bp, Homo sapiens
  misc_feature: GYAE6OF02HKV9J.5.86.H09.1.454.CMB.1.raw
  modified_base (450)..(450): a, c, t, g, unknown or other
  misc_feature (450)..(450): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcttataactatgtctctgtaccaacaacatccaggacaaacgacccccaaactcgtgtatttctagaggtcaagtaagcggccctcgacggggtccctgatcgcttctcgtcggctaccgaagtcgtaggaccaacgaccggtccctcccgtgtaccgtctcgtcgggcctccagtacgtgaggatggacgctagtactattacngcagctactagtttcgcgagcacgtccgttataccgttcgttcgggacggtacgggaccgaaggtcctacggtacccgttccgtacggtccgaccggacccgtaacgggtcctacccggcccccgttacgg

SEQ ID NO: 119295 - DNA, 603 bp, Homo sapiens
  misc_feature: GYAE6OF02FX64W.5.86.H09.1.454.CMB.1.raw
  modified_base (309)..(309): a, c, t, g, unknown or other
  misc_feature (309)..(309): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttcngaggtcagtaagcggccctcgaggggtccctgactcgcttctctggcctcagtctggcaacgcggcctccctgaccgtctcgtcgggcctccacgactgacggagtcggaggctgacttattacgtgcagtctctagtttcgactaggcacgtccgttacttaccgttccgttaccgggaccgggtacgggaacccgtaacggtccgttaccggtaacccggttacccgttaacgggtcccgaaccggtaccccggtaaacggtcccttacccgggtcccccccgttacccggg

SEQ ID NO: 119296 - DNA, 669 bp, Homo sapiens
  misc_feature: GYAE6OF02HTWQT.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacagttggtacgttataactatgtctcctggtaccaacaacatccaggacaaacgcccccaaactcgtgatttctgaggtcaggtaagccggccctgacggggtcctgactcgcttctcgtggtcctccgtaagtcgtaggacctaaccgaccggtaccctcccgtcggtacccgttctaccgtcggggtcccttaccgacggtaccgtgggaagggtagtcgggacggtccgttagtaacctttaacgtttaccgtcggactaccggttcttaccttaagtttcggaccgtacgggaccgtaacgtaccgttaacttaccgttccggttaccgggacgggtacgggaaccaacggtccgtacggtaccccgttacggtacggtaccgaccggaccccggtaagggtccccttaccggccccccgttacggg

SEQ ID NO: 119297 - DNA, 605 bp, Homo sapiens
  misc_feature: GYAE6OF02FOA8V.5.86.H09.1.454.CMB.1.raw
  modified_base (364)..(364): a, c, t, g, unknown or other
  misc_feature (364)..(364): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtgatttctgaggtcagtaacgcgccctcgacggggtccctgactcgcttctctggctcagtcnggcaacacggccctccctgacccgtctcgtcgggcctcccgagtacctggacggatcggacggtcttacggaactttaagttaccgtgtcacgtccttacgtagtttcgacgtacggcctaacgtccgttattaaccgttcgttccgggacgggtaacgggaacccgaacggccgttacggaccccgttaccgtacggtaccgacggaccccgtagggcccttccggaccccccgttcggg

SEQ ID NO: 119298 - DNA, 958 bp, Homo sapiens
  misc_feature: GYAE6OF02JZYX3.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcacgccctccctccgcggtccggtctccgtggacagtcagtccaccatcctcctgacacgtcggggaacccaggaccgtagtcggaactagttttcgggtacgttttaaataaaccttagttcggttccttaccgttacgggtaaaccctaaaaccaaactacgttacccgaacggggaacccaaaaacccggtacccccccctaaaaacgttccggttacggttaacttttccgttaggggtaacggtttaccgaaacgggttaaaaccggccccggggtacccttacccgggtaacgggggggtttcccccttagggaacctttcccgggacctttttaccgttccggttccggggttaccttaaccccgtaaacggtttaccggttacggggtaaccctaaacccgggtaacccgggtaccccgttcccccggtttaaacgggtacccccgggtttacccttccgggtttccggggtaccccgttaccccggaaacgggttacccgttaaggggtaaacgggtaacgttaccgggaaccgggttacgttaaccggtaaacccgttttaaccgttaacggttaccgtaccggtaaaccggttccgttaaccttttaaggtttccggaaccgttaaccggtacgtaacccgttacccgttaaagttcccgttaccgggttacgggggaccgaaccggggtaccgtaaacggtccgtacgggttaccccgtacggttacggaccggttaccggaccgtaacggtcccgtcccggtaccccgttcccggg

SEQ ID NO: 119299 - DNA, 582 bp, Homo sapiens
  misc_feature: GYAE6OF02FT5AZ.5.86.H09.1.454.CMB.1.raw
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
  modified_base (489)..(489): a, c, t, g, unknown or other
  misc_feature (489)..(489): n is a, c, g, or t
  modified_base (574)..(574): a, c, t, g, unknown or other
  misc_feature (574)..(574): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaggggctggactggctctcaaatattaatggtaaaggcaatatacaagactacacagactccgtgaagggccggttcaccacctcgagagacaactccagggacacggtgtacctacacatgaacagcctgagagccgaggaccaggccgtatattattgtgtggaggggaaacgtggggactaagtttgaccgtcgtggggccacgggaaccctggtccgaccgtctcctcacgccctccaccgacgggcccagtccggtccttcccccgtggccnccctgcctccgnggacnccaccgtccgagacgcacacgccggccctgggcctgcccgtggtaccgaggtaccttaccgttcccgtgtccgtcgtacgttcgnggtacggg

SEQ ID NO: 119300 - DNA, 606 bp, Homo sapiens
  misc_feature: GYAE6OF02JNTS5.5.86.H09.1.454.CMB.1.raw
  modified_base (310)..(310): a, c, t, g, unknown or other
  misc_feature (310)..(310): n is a, c, g, or t
  modified_base (383)..(383): a, c, t, g, unknown or other
  misc_feature (383)..(383): n is a, c, g, or t
tcagatcagacacgcacgaccggtgctcgatttagtgctatagacttgggtttgggggtctggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggacccagcagtgacattggtcgttataactatgtctcctggtaccaacaacatccagcaaacgccccaaactcgtgacttcngagtccagtaagcgtccctcgacggggtccctgactcgcctttcgtctgtcctaccaagttcctaggcaaacncggcctccctgacccgtctcgtacgggcttccagtactggacggtatgacggctaggtaccttattctagctacggccttcgatttcgcgacggtacacgtccggtactaccgttcgttacgggcgggtaacggacccgtaaacggtccttaacggccccgttaccgtacgggttaccaaccggtcccgaagggtcccttacccggacccccgtttacccggg

SEQ ID NO: 119301 - DNA, 599 bp, Homo sapiens
  misc_feature: GYAE6OF02HATXZ.5.86.H09.1.454.CMB.1.raw
  modified_base (308)..(308): a, c, t, g, unknown or other
  misc_feature (308)..(308): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgacattggtcgttataactatgtctcctgtaccaacaacatccaggcaaacgaccccaaactcgtgattcngaggtcagtagcgcctcgacgggtcctgactcgcttctcgtggcctcaagtctgaccaacgaccggcccttcccgtacgacccgtcgtccgtcgggctcccgagtactggaggatggacggtctagtaacttacgttactcgcacggcttacgtagtttcgagtacggcaacgtccgttaactaccgtttcgttcggggaccgggaggtaaccgaacggtccgtacggtacccgttacgtacgggtacacgggtacccgtaagggtcccgttacccggcccccgttacggg

SEQ ID NO: 119302 - DNA, 592 bp, Homo sapiens
  misc_feature: GYAE6OF02HBVTY.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaaggggctggactggctctcaaatattaatggtaaaggcaatatacaagactacacagactccgtgaagggccggttcaccacctcgagacgacaactccagggacacggtgtacctacacatgaacagcctgagagccgaggacacggccgtatacttattggtgtagaggggaaactgggggacaagtttggaccgtcgtcggggaccacggggaaccctagggtccaaccgtctccgtcgagtccctccaccgaacgggcccagtccggttccttcccccgtcggccgccctgccttccacgggacgccaccgtccgagacgccacgacgcggacccgtgggctcggcctcggtacgaacggacttaccgttcccgtgtcctgactcgtgacgg

SEQ ID NO: 119303 - DNA, 688 bp, Homo sapiens
  misc_feature: GYAE6OF02H2PTB.5.86.H09.1.454.CMB.1.raw
  modified_base (272)..(272): a, c, t, g, unknown or other
  misc_feature (272)..(272): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctcgccctgactcagcctccctcgcgtccgggtctcctggacagtcagtcaccatctcctgcacgtgggaccagctagtgacattggtcttataactatgtctctgtaccaanaacatccagacaaacgcccccaaatcgtacgtattctagagtcagtaagccgcctcgacggggtcctagactccgtcttcctcgtcggtccttaccgaagtctcgggacctaaacgacccggtcccttacccgtcgaccccgttcttccggtcgggtccttcccgaagtaccgtggaacggtgttagggacggcgttacgtaaccttacgtttaaccgtcggactaccggtcttccgttaaacgttttcggaacgtacgggtaccttaacggtccccggtttaactaccggtttacccgttaccggggacgggaccggggtaaccgtaaacggtcccgttaccgggacccgtttacccggtacggttacccgaccgaccccggtaaggtcccgttcccggccccccgtttacccgg

SEQ ID NO: 119304 - DNA, 591 bp, Homo sapiens
  misc_feature: GYAE6OF02G9O0D.5.86.H09.1.454.CMB.1.raw
  modified_base (311)..(311): a, c, t, g, unknown or other
  misc_feature (311)..(311): n is a, c, g, or t
  modified_base (374)..(374): a, c, t, g, unknown or other
  misc_feature (374)..(374): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggacaaacgcccccaaatcgtgtactttcngaggtcagtaagcgccctcgacggggtccctgactcgcttcgtctggctccaagtctgcaacncggccctccgtcgaccgtctcgtcgggctccgagtacgtgaggagtggaggtctagacttagttacgtcgactagtctctagtttcgcgaggcacgtccgttaataccgttcgttcgggacggtacgggaaccgtaaggtccgttacggaccgttccggttaacggttaccgaccggtaccccgaacgggtcccgttcccggtccccccgttacggg

SEQ ID NO: 119305 - DNA, 650 bp, Homo sapiens
  misc_feature: GYAE6OF02GX2Z8.5.86.H09.1.454.CMB.1.raw
  modified_base (275)..(275): a, c, t, g, unknown or other
  misc_feature (275)..(275): n is a, c, g, or t
  modified_base (439)..(439): a, c, t, g, unknown or other
  misc_feature (439)..(439): n is a, c, g, or t
  modified_base (460)..(460): a, c, t, g, unknown or other
  misc_feature (460)..(460): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgggaccagcagtgacagttggtacgttataactatgtctcctgtaccaanaacataccaggacaaacgaccccaaactcgtgtacttctgaggtcaagtaacgcgcctcgacggggtccctgatcgcttctctggtcctacaacgtctacggtccaacgaccggccctcccgtcgtacccgttctcgtcgggccttcccgagtacgttgaaggntggagtctagtacttattacngtcatcgttatcgtttagacgaggtacgaccgttaccgttacttaaccgttcggtttaccgggaccgggtaacgggtaaacccgaacggttaccggtacggtaaacccccggttacgttaaccgggttacccgaacccgggtaacccccggtaacgggccccggtttacccggcccccccggttaccggg

SEQ ID NO: 119306 - DNA, 655 bp, Homo sapiens
  misc_feature: GYAE6OF02GTK7V.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctctgccactgggaccagcagtgacattggtacgttataactatgtctcctgtaccaacaacactccaggacaaacgacccccaaactcgtgtatttctgaggtcagtaacgccggcctacgacggggtccctgactcgtcttctcgtcggcctacctaagtccgtaggaccaaacgaccggtccctcccgtacgacccgttcctcgtcgggccctaccgtacggacttggaaggtagtacgggacggtcttacgactttagttactcgactcgtccttacgtacgtttcgacgtacggactacgtaccgttaactaccgttccggttacgggaccggggtaacggaacccgtaacggtccgttaccgggtacccggttaccgtacggtaccgaccggtaccccgtaaggtccccgtaccccggtacccccgttcccggg

SEQ ID NO: 119307 - DNA, 584 bp, Homo sapiens
  misc_feature: GYAE6OF02GE074.5.86.H09.1.454.CMB.1.raw
  modified_base (372)..(372): a, c, t, g, unknown or other
  misc_feature (372)..(372): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgacattggtcgttataactatgtctctgtaccaacaacacccgacaaacgccccaaactcatctattttgagtcactacgccgacctcgacgggtccctgactcgcttctctggcctccgaagtcgtcggcaacnccggcctcccgtgtaccgtctcgtcggcctccgaggctggaggagtggacggtctagtaactttattacgtgactagccttctaatactcggacaggtacacgcgacgcaccgttacccagttcgtagtacggttcggttaccggggacgggggaaccctaacggccgtacgtacccggttaccgtacggacgtaccggacccgtaaccggg

SEQ ID NO: 119308 - DNA, 689 bp, Homo sapiens
  misc_feature: GYAE6OF02JD752.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaccagcagtgacattggtcgttatactatgtctcctggtaccaacaacatccaggcaaacgcccccaaactcgtgatttctgaggtcagtaagcgccctgacggggtccctgatcgtcttctcgtcggcctccgaagttccgtcggaccaaccgaccggtcccttcccgtacgacccgtcctcgtacgggccttacccgagtacctggacggtatcggaacgggtcttacggtaactttaacgttaccgtcgacctacggtccttaccgtagtttcgaccgtaacggtcctaacggtacccggttaacgttacccgtttaccggtttccgggggaccgggtaacccggggtaacccgtaaacgggtcccgttaaccgggtaaccccggttaccccggtttaaggtacccgtaccggaccccggtaaacgggttcccgttaccccggccccccgtttacccggg

SEQ ID NO: 119309 - DNA, 699 bp, Homo sapiens
  misc_feature: GYAE6OF02IZL9J.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctcgccctgactcagcctccctccgcgtccgggtctcctggacagtcagtccaccatctcctgcactgggactagcagtgacagttggtcgttataactatgtctccgtaggtaaccaaacaacactcacggacaaacgaccccaaatcgtagtattctgagtcagtaacgccggcctcgacggggtcctagactcgcttctcgtcggtactcctaagtcgcgtacaactaccggccctcctcgaccgtctcgttcgggccttaccgaggtacttagggacggtactacgggacgtcttaggtaacccttatttaacgtcgtacgtaacggtccttacgttaacttcggtaacccgtacgggtaccgaccggttaccgttaacttaacccgttcggtttaccggggacccgggtaaacggggtaacccttaacgggtaccgttaaccggggtacccgttacccggtttaagggtaccccgtaacccgggtaccccggtaaacgggtccccgttttaccccggtcccccggtttacccggg

SEQ ID NO: 119310 - DNA, 524 bp, Homo sapiens
  misc_feature: GYAE6OF02GXSUN.5.86.H09.1.454.CMB.1.raw
  modified_base (310)..(310): a, c, t, g, unknown or other
  misc_feature (310)..(310): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgggaccagcagtgacattggtcgttataactatgtctctgtaccaacaacatccaggacaaacgcccccaaactcgtagatttcngagtcagtaacgcgcctcgaggggtccctgactcgcttctctgctcagtctgcacacgcctccngacgtctcgtcggctcagctgagntgagtctgacttatactgcagtctactatttgacgtagtcgagtcccgttataaccgttcgttacggacggtacggaccgaagtctacgaaccgtcgtaggcgacgccaaggcctacgcccctcgg

SEQ ID NO: 119311 - DNA, 538 bp, Homo sapiens
  misc_feature: GYAE6OF02HM108.5.86.H09.1.454.CMB.1.raw
  modified_base (339)..(339): a, c, t, g, unknown or other
  misc_feature (339)..(339): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgattctgaggtcagtaagcggccctcgacggggtcccngatcgcttctctggctcaagtctggcaacgcggccctcctcgaccgtctcgtcgggcctccgagactgaggatggagctgactattactgcagtctctatttcgcaggcacgccgtatacgtcgttcgggcggacgggaccaaggcctacggtaccgtccgtaggtacacggacccgaacggtcctccgcccccgtcgg

SEQ ID NO: 119312 - DNA, 634 bp, Homo sapiens
  misc_feature: GYAE6OF02JWZ2Y.5.86.H09.1.454.CMB.1.raw
tcagatcagacacgcacgaccggtgctcgatttagtgctatagacttgggtttgggggctggggtctcaggaggcagtgctctcaggacgtcaccaccatggcctgggctctgctcctcctcaccctcctcactcagggcacgagggtcctgggcccagtcctcgccctgacctcacgccctccctccgcgtccgggtctccgtggacagtcagtccaccatcctcctgccacgtcgggaaccagccagtcgactagttggttacgttataactatcgtctcgtaggtaaccaacaactactaccgaggaccaaacgacccccaaatccgtagtaacttcaggacggtcaaggtacgccgtcccgtacgacggggtcctgactcgtctcgtcgtcggtcctacgaagtcgtaggacaaccgaccggtaccctcccgtacgtaccctcgtcgtccggcgtccacgtacgtgacgtacgtggacgtcgtacgtacttacgttacgcgactacgtcgtacttagttccgagtcggactacgtccgtattccgtacgtcgggacggaggtaccgagtcgtacggtacccgtacgttacggctacgggtacccgaggtcccgttaccgccccggttacg

SEQ ID NO: 119313 - DNA, 743 bp, Homo sapiens
  misc_feature: GYAE6OF02J1UYU.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcacgtccacatctcctgcacgtgggaccagccagtcgactagttggtacgttataactattcgtcctctcggaccaacactatccaaggaccaaacgtacccccaaactcgtagtactttccgtggacggtacaaggtacggccggccccgtcggtacggggtccctggtactccggtcctttactacgttcgggacctaccgtaaggttccgtacggaccgaaaccgtcccgggtaccccttacccgtacggtaccccggttctccggtacgggtaccttacccgaacggtcgttacgggaacgggtagttacgggaacggtaccgttaacggtaacctttaaccggtttcaccgccgtaacgttcccgtttacgttaggtttacgaccgtaaccggggctaccgggttacccgttaattcccggttaccggttccggggaggtacccgggtaaccacggtcccgttacggaccccggttaccgtagggttcccaccgggaccccgtaagggccttaccccggcccccggtttaccgg

SEQ ID NO: 119314 - DNA, 692 bp, Homo sapiens
  misc_feature: GYAE6OF02ILTX8.5.86.H09.1.454.CMB.1.raw
  modified_base (320)..(320): a, c, t, g, unknown or other
  misc_feature (320)..(320): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtcaccatctcctgcacgtgggaccagcagtgactagttggtacgttataactatgtctccgtggtaccaaacaacactcaggacaaaacgcccccaaatcgtagtatttcngtacggtacaggtaacgccggtccctacggacggggttccctaggtacgtccgttccttcgtccgttcggacctaccgtaagttcgtacggaccaaaccgtccggcccttacccgtcgacccgttcgtccggtacgggccttacccgaacgtacgtaggacggtagttaggacggtatacgtaacgttacttacgtcgactacgtccttacttagtttcgcgtaggtccgtaacgtaccgtaaacttccgttacggttccgggacgggtaaccgggacctaaggtccgtaccggtaaccccgttacccggttacggtacccgaccggtaacccgtaaccgggtccccggttacccgtaccccccggttcggg

SEQ ID NO: 119315 - DNA, 557 bp, Homo sapiens
  misc_feature: GYAE6OF02JSEWZ.5.86.H09.1.454.CMB.1.raw
  modified_base (123)..(123): a, c, t, g, unknown or other
  misc_feature (123)..(123): n is a, c, g, or t
  modified_base (144)..(144): a, c, t, g, unknown or other
  misc_feature (144)..(144): n is a, c, g, or t
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
tcagatcagacacgcacgaccggtgctcgatttagtgctatagacgttgagtctggggaggctttggtacagcctgggggtccctgagactctccgtgtgcagcctctggattcacctttacngatttggcatgacgtggtccncaggctccagggagggctggactggctctcaaatattaanggaaaagcaatntacagactacanagactccgtgaacggccgttcaccactcgagagacaacgtccagggacaggtcgtacctacgacctagtacgaacagccctgaacgacgcccgaaggacacggccgtatattagtgtgtgagggaactggggactaagttgaccgngtgggcaggaccngtcacgtcncgtnagcctacacgacggccacgtccgtcctccccgtgcccgccctacgcctcncggacnccaccgtccgagccgacacacgccgccgtggccgtcgaccgttgacctaacggccttacctccggtatccgtacgtactcgtaggtacgtcggctcggcgtacgcgtcgacgngcgnganc

SEQ ID NO: 119316 - DNA, 576 bp, Homo sapiens
  misc_feature: GYAE6OF02FQ20T.5.86.H09.1.454.CMB.1.raw
  modified_base (378)..(378): a, c, t, g, unknown or other
  misc_feature (378)..(378): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggacaaacgcccccaaactcgtgtatttctgaggtcagtaagcggccctcgacggggtccctgactcgcttctctcggctaccaagtctggccaacnccggccctccctcgaccgtctcgtgggcctccagactgaggatggaggctgacttattacngcganctctatttcgcaggcacgtccgtataccgttcgttccgggacggtacgggaaccgtaaggtccgtaccggtacccggttccgtacgggtaccacggaccccgaaggtcccgtacccggtccccccgttacgg

SEQ ID NO: 119317 - DNA, 640 bp, Homo sapiens
  misc_feature: GYAE6OF02IV9OB.5.86.H09.1.454.CMB.1.raw
tcagatcagacacgcacgaccggtgctcgatttagtgctatagacgttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactgggaccagcagtgacattggtcgttataactatgtctcctgtaccaacaacatccaggacaaacgcccccaaatcgtgtactttctggacggtcaagtaacgccggcctcgacggggtccctgactcgtcttctctcgctcaagtcaggacaacgaccggccctccgtacgacccgtctccgtcgggtcctccgacgacgtgtaggtagtcggacggtcttacgtaacttacttacgtcgtactacgtccgttacttacgtttcggacgtacgggtacgacggtaccgttaacgttaccgttacgggttaccgggacgggtaacggaaccgtaacggtaccgtaccggtaacccgttaccgtaacggtaccgaccgtacccggtaacggtcccgttacccggtcccccgttaccgg

SEQ ID NO: 119318 - DNA, 631 bp, Homo sapiens
  misc_feature: GYAE6OF02IZYX9.5.86.H09.1.454.CMB.1.raw
  modified_base (270)..(270): a, c, t, g, unknown or other
  misc_feature (270)..(270): n is a, c, g, or t
  modified_base (306)..(306): a, c, t, g, unknown or other
  misc_feature (306)..(306): n is a, c, g, or t
  modified_base (341)..(341): a, c, t, g, unknown or other
  misc_feature (341)..(341): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcacgcctccctccgcgtccggtctcctggacagtcagtcaccatctcctgcacgtggaccagcagtgacagttggtcgttataactatgtctctgtacaanacatcagacaaacgccccaaactcgtagtacttcgngagtcagtaacgcgtcctcgtacgggtcctaggtntccgcttctcgtcgtctacgaacgtcgtacgacaaaccgcggccctcccgtcgtaccgtcgtctcggcctacgacgtactaggaggtacgtcggacggtctacgtactttacgtacgtcgactagcttacgtagtttacgacgacgtacgtacgtaccgttacttaaccgttccgttaccgggtacgggaccgggtaaccgtaacggtcccgttacggtacccgtaccgttaacggtaccggtaaccggacccgtaaaccgggtccgtccccggttcccccgttaccggg

SEQ ID NO: 119319 - DNA, 633 bp, Homo sapiens
  misc_feature: GYAE6OF02HKPYH.5.86.H09.1.454.CMB.1.raw
tcagatcagacacgcacgaccggtgctcgatttagtgctatagacttggggtttgggggctggggtctcaggaggcagcgctctcaggacgtcaccaccatggcctgggctctgctcctcctcaccctcctcactcagggcacgagggtcctgggcccagtctgccctgactcagccctccctccgcgtccgggtctccgtggacagtcagtcaccatctcctgcacgtgggaccagcagtgactattggtacgttataactatgtctccgtggtaaccaacaacataccaggacaaaccgacccccaaacgtcgtagtactttcgtagacggtcaaggttaaacgccggtccctcggaacggggtccctagactccgtcttctcgtcggcctaccgaagtcgtaggacaacgaccggtccctcccgtgacccgtctccgtgggcctaccgagtactggaaggtatggacggcttacgtacttaattactgacagtctactacgtttgacgtaggcacgtccgtaacttacgtcgttcgggacgggacggaccgtaaggcctacggtacccgttaccggtaaggttccgaaccggtacccgaaacgggtccttcccggaccccgtttaccggg

SEQ ID NO: 119320 - DNA, 537 bp, Homo sapiens
  misc_feature: GYAE6OF02HSAO7.5.86.H09.1.454.CMB.1.raw
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (431)..(431): a, c, t, g, unknown or other
  misc_feature (431)..(431): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgccccccaaactcgtgatttctgaggtcagtaagcggccctcgaggggtccctgatcgcttctctggctcaagtctggcaacncggccctccncgaccgtctccgtgggcctccgagactgaggatgaggctgacttattacngctagctctatttcgcacggcacgccgtatacgttcgttcgggcggacggaccgaagcgtacggaccgtccgtagtccgacgcccgaaggcctccggtcccctcgg

SEQ ID NO: 119321 - DNA, 688 bp, Homo sapiens
  misc_feature: GYAE6OF02IVS4E.5.86.H09.1.454.CMB.1.raw
  modified_base (265)..(265): a, c, t, g, unknown or other
  misc_feature (265)..(265): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgccgtccgggtctccgtggacagtcagtccaccatctcctgcacgtgggaccagcagtgactagttgtcgttataactagtntctccgtacgtaaccaaacaacactaccgaggaccaaaaccgccccccaaaactcggtagtacttttcgtaggtacggtacgaagtaacggcccggtccctcggacggggttccctgtacttcgtcttctcgtcggtcctacgtagtcgtggaccaaccgaccggtccctacccgtggacccgttctccgtcgggcctaccgtacggacgtaggtagggactacggacggtcgttacgtaacttacgttaacgtgcctagtcttctagttcgacgtagactacgttaccgttagttacccgttccgttacggggaccgggaaccggtaaccgtacggtacccgtacggttacccggtaccggttaaccgaccggtacccggtacccggtaaccgggtcccgtccccggttaccccgtacccgg

SEQ ID NO: 119322 - DNA, 622 bp, Homo sapiens
  misc_feature: GYAE6OF02I0FV4.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcacgtgggaccagcagtgacattggtcgttataactatgtctcctgtaccaacaacatccaggacaaacgcccccaaactcgtagtacttctgagtcagtaacgccgccctcgacggggtcctgactcgtcttctcgtcgctacaagtcgtggcaaccgacggtccctcccgtcgtaccgtcgtcgtcgggtcctccgagcgtggacggtagtcgacggtctacgtacttaagttactggtaccaggtccttaccgtagttttcgacgtacggcgtacgtaccgttaacttaccgttccggttacggggaccgggtaacgggtacccgaacgtccggtacggtaccccgttaccgttaacggtacccacggtacccgaagggtccctcccggcccccgttcgg

SEQ ID NO: 119323 - DNA, 789 bp, Homo sapiens
  misc_feature: GYAE6OF02JT8CH.5.86.H09.1.454.CMB.1.raw
  modified_base (181)..(181): a, c, t, g, unknown or other
  misc_feature (181)..(181): n is a, c, g, or t
  modified_base (197)..(197): a, c, t, g, unknown or other
  misc_feature (197)..(197): n is a, c, g, or t
  modified_base (216)..(216): a, c, t, g, unknown or other
  misc_feature (216)..(216): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcacgggcacagggtcctgggcccagtctgccctgactcagcctcccncgccgtccggtctccnggacagtcagtcaccatcnctgcactgggaccagcagtcgactattcggtacttaataactatcggtacctccgtcggttaacccaaacgtaactaacttcccgaaggtaccaaaaccggtccccccctaaaactcggtactaactttcgaacggtacggttaccaaggtttaacgccggccctacggtacggggtcccctgtaactcggtacctttccgtaccgttcggacttacccggtaacggtccttcggggaccaaacccgtacccggaccttccccgtacggacccgttcgtactcgggtaccttccgaacgttacgtacggagtacgtaggtacgggtaccttcggtaaacccttgttaaaccgttccgtacggaaccggtccgttacttacggtttaccgaccggtaaaccggccgtaacccggttaccggttaaacgttcccgttaccgtccggggttacggggaacccggggtacctaaacggggtacccgttacgggaaacccccgttttggaaaaccgggtttccgaaacccgggacccgttaccggggaaccgttccccgggtaccccccggttaccgg

SEQ ID NO: 119324 - DNA, 650 bp, Homo sapiens
  misc_feature: GYAE6OF02HEH0N.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcacgtggaccagcagtgactagttggtacgttataactatgtctctagtaccaacaacatccgagacaaacgacccccaaactcgtgtactttctagacggtacaagtaacgccggtccctcgtacgggtccctgactcgtcttctctcggactaccgaagtcgtacgacaaccgacggccctcccgtacgtaccgttcgtaccgtgggtacctccgacgtaacgtaggacggagtcggacgtactacgacttactttaactgtacgactcttctaagtttcgacgtacggtacgaccgtccgtaacttaaccgttcggttaccggaccgggtaacgggaacccgtaaggaccgttacggtaacccgttaccgtacgggtaccaccggtaacccgtaaccgggtcctaccccggtacccccgttaccgg

SEQ ID NO: 119325 - DNA, 533 bp, Homo sapiens
  misc_feature: GYAE6OF02JCM6I.5.86.H09.1.454.CMB.1.raw
  modified_base (305)..(305): a, c, t, g, unknown or other
  misc_feature (305)..(305): n is a, c, g, or t
  modified_base (405)..(405): a, c, t, g, unknown or other
  misc_feature (405)..(405): n is a, c, g, or t
  modified_base (425)..(425): a, c, t, g, unknown or other
  misc_feature (425)..(425): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctgtaccaacacatccaggcaaacgccccaaatcgtgatttcngagtcagtaagcgccctcgacggggtccctgactcgcttctctgctcaagtctagcaacaccggcctccctgacccgtctcgtcggctccgagctgacgntggacgctagacttattacncgacagtctctagttcgcaggcagtccgtatcgtcgttcggcgacggaccgaagtcctacgaccgtccgtaggtaccgacgacccgaaggcctaccgccccgttacgg

SEQ ID NO: 119326 - DNA, 710 bp, Homo sapiens
  misc_feature: GYAE6OF02IW2KF.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgtattttggcatgacgtggtccgccaggctccagggaaggggctggactggctctcaaatattaatggtaaagcaatatacaagactacacagactcgtagaacgggccgttacaccactgagagacactccgagggacacggtagtaccctacgacatagaacacgcctgaacgagccggaaggaccaccggccgtaattacttattcggtagtaggaacgggggtaaacgtgggggactaaacgtttcggaacccgtggtcggggaccgaacggggtaaccctggggtacctaccggttcctaccgtcgaacgtcccgtaccgaccggtaaaccgggccctaacgttcccggtccgttcccccgtgggtcccgtccctcgtacccgtaccgaacgggttacccgacccgtaaacccgtcccgggaacgaccgtaccgaacggtaacccggccggccccgttagggcctccggtccggtacggtaccgaaccggttaccgttaccccgttaccggttacgtaccgttacggtaacttcggtcgaccgggg

SEQ ID NO: 119327 - DNA, 840 bp, Homo sapiens
  misc_feature: GYAE6OF02JJ6N4.5.86.H09.1.454.CMB.1.raw
tcagatcagacacgcacgaccggtgctcgatttagtgctatagacttgggtttgggggcgtggggtcgtcaggaggcagcgctctcaggacgtcaccaccatggcctgggctctgctcctcctcaccctcctcactcagggcacagggtcctgggcccagtctcgccctgacctcacgcctccctccgccggtccgggtctccgtggacacgtcacgtccaccatcctcctgcctacgtcggggaacccagccgtagtcgactagtttcggtacgttaactaactatgttctccgttacggtaaccaactaaactactaccgaacggtaccaaaccgacccccctaaaagtcggtacgtaacgtttccgtaggtacggttaccgaaaggttaaccggcccggtacccgtacgggtaccggggggttcccctaggtaccgtccggtacctttccgtccggttcggacccttacgtaaccggttcgttacgggaaccaaaccggccgggtacccctttacccgtccggtacccgttcccgtccgttaccgggtcccttacccgtaacgtaccggtacggtacgggtacgtacggtacggtccgtacgttaaccgttaacgttaccgtacggtcgaacgttccgttaacctagttttacggaccgtacggtaccgtaaccggtaccgttacgttaacccggttcgtttaccggggaccgggtaaccgggtaaccggtaaccgggttaccgtaccgggttacccgttacccgggttaccggttacccggaaccgggtaacccggtaaccgggtaccgtacccccgggtccccggttaccccggg

SEQ ID NO: 119328 - DNA, 596 bp, Homo sapiens
  misc_feature: GYAE6OF02IROFS.5.86.H09.1.454.CMB.1.raw
  modified_base (141)..(141): a, c, t, g, unknown or other
  misc_feature (141)..(141): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacngggtcctgggcccagtctgcccctgactcagcctccctccgcgtccggtctcctggacagtcagtccaccatctcctgccacgtcgggaccagcagtgactagttgggtacgttataactatgtcttcctggtaaccaacaacactccagacaaacgacccccaaactcgtagtatttctgacggtacagtaacgcggcctcgacgggtcctgactcgtcttctcgtcggctcagtctaggccaacaccggtcctcccgtacgaccgtctccgtcggctccgagtactggaggagtgacggtctacgtacttagttacctgacgtcgtctctagtttcgcgtagcgtacgtcgttactaccgtcgttacgggaccgggtaggaccgaagtccgttaccgaccgttaccgtaggtaccgtaccggacccgaagggtccctaccggtccccgttccg

SEQ ID NO: 119329 - DNA, 579 bp, Homo sapiens
  misc_feature: GYAE6OF02JUI40.5.86.H09.1.454.CMB.1.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
  modified_base (386)..(386): a, c, t, g, unknown or other
  misc_feature (386)..(386): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacngtcagtcaccatctcctgcactgggaccagcagtgactagttggtcttataactatgtctccgtgtaccaacaacatccaggaccaaagcccccaaatcgtagactttcgnggacgtcaagttaagccgcctacgaggggtcctagactcgacttcgtcgtacgctaccaagttctcgactaacnccgacctccagtacctcgtccgtcggctaccgacgactcgtagactggacgcgtacgtacttagttacagctacgtctacgtatcgacgacggtctacgtaccgtatacgttcgtacggcggacggtaccgacggtaccgtcggtaacccgtccgtaggtctacggccgtaagtccgtccgtaccccgttcgg

SEQ ID NO: 119330 - DNA, 499 bp, Homo sapiens
  misc_feature: GYAE6OF02IWYEN.5.86.H09.1.454.CMB.1.raw
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
  modified_base (434)..(434): a, c, t, g, unknown or other
  misc_feature (434)..(434): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactgggaccagcagtgacattggcgttataactatgtctcctggtaccaacaacatccaggcaaacgccccaaactcgtgatttctgaggtcagtaagccggcctcaggggtccctgactcgcttctctcgctcaagtctgcaacncggcctccctgaccgtcncgtggctccagactgacgatgagctgattagtctgcagtctctagttgcnggcagcgtatactcgttcggcgaggaccagctgaccgtctacggtcacgccaggcctcgccctcg

SEQ ID NO: 119331 - DNA, 638 bp, Homo sapiens
  misc_feature: GYAE6OF02FR68W.5.86.H09.1.454.CMB.1.raw
  modified_base (425)..(425): a, c, t, g, unknown or other
  misc_feature (425)..(425): n is a, c, g, or t
  modified_base (633)..(633): a, c, t, g, unknown or other
  misc_feature (633)..(633): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaagtttgaccgcgtggggccaggggaaccctggtccaccgtctcctcagccctccaccaagggcccagtccgtcctcccctggccnccctcgcctccaggacgccacccgtccgagacgccaccgaggcccggcccgtcggggcctcggcccgttagggtccgaaacggggtaccttaacccgtttccccggtacgttcccgttggtacgttccgttcggggtaacgggtccgggggtacccgttcgggggacccgtaaacggggccggtacccggtaagttaacggcgtacgngtacg

SEQ ID NO: 119332 - DNA, 621 bp, Homo sapiens
  misc_feature: GYAE6OF02GA5YK.5.86.H09.1.454.CMB.1.raw
  modified_base (448)..(448): a, c, t, g, unknown or other
  misc_feature (448)..(448): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgactattggtcgttataactatgtctctgtaccaacaacatccaggacaaacgacccccaaactcgtagattctgagtcagtagccggcctcgacgggtcctgactcgcttctctggctcgaacgtcgtacggacaacgaccggtccctcccgtgtacccgtctcgtcgggcctccgagacgtgaggagtggaggtctagacttagttacngactagtcttctagtttcgacgaggtacgacgtaccgttacttaccgttccgttaccggggaccggtacgggaaccgtaaccggtccgttaccggtaacccgttaccggtaaccggtaccgtaacccggtacccggaaacggtccccgttcccggtaccccccgttacccggg

SEQ ID NO: 119333 - DNA, 588 bp, Homo sapiens
  misc_feature: GYAE6OF02GSNNC.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcaccttttactgattttggcatgacgtgggtccgccaggctccagggaaggggctggactggctctcaaatattaatggtaaaggcaatatacaagactacacagactccgtgaagggccggttcaccacctcgagagacaactccagggacacggtgtacctacacatgaacagcctgagagccgaggacacggccgtatattatgtgtgaggggaaactgggggcaagtttgaccgctggggccgagggaaccctggtcaccgtctcctcagcctccaccaagggccccagtccggtaccttcccccgtggccgccctgcctcccgaggacgccacccgtccggagacgccacacggccggcccgtgggcctcggccgtgggtaccaacgggaccttaccgttccccggtgttccgtggtacttccgtgtaccgggg

SEQ ID NO: 119334 - DNA, 661 bp, Homo sapiens
  misc_feature: GYAE6OF02GCAZS.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcacgtgggaccagcagtgactagttggtcgttataactatgtctctggtaccaacacatcagcaaacgccccaaacgtcgtgtattcgtgagtcaagtacgccgcctcgacggggtccctgacgtcgtcttctcgtcggcctacaacgttcgtacgggtaccaaccgacccggtccctaccccgtacgtacccgtccgttacgtcgggacctccgacggtacgtacggaggtaagtaggacggtcgttagaacctttaagttacctcgcgtacgtaccttacgttaagtttcgacgtaacggtcctaacggtccgtttacgtaccgttccgggttaccggaccgggtaaccggaaccgtaacggtccgtaccggtacccgttacgtccggttacgaccggtacccggtaaccggtcccgttcccgtcccccgtacccgg

SEQ ID NO: 119335 - DNA, 515 bp, Homo sapiens
  misc_feature: GYAE6OF02FVJWH.5.86.H09.1.454.CMB.1.raw
  modified_base (305)..(305): a, c, t, g, unknown or other
  misc_feature (305)..(305): n is a, c, g, or t
  modified_base (330)..(330): a, c, t, g, unknown or other
  misc_feature (330)..(330): n is a, c, g, or t
  modified_base (424)..(424): a, c, t, g, unknown or other
  misc_feature (424)..(424): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgggaccagcagtgacattggtcttataactatgtctcctggtaccaacacatccaggcaaacgccccaaatcgtgattcngagtcagtaagcgcctgagggtccngactcgcttctctgctacagtctggcaacgcggcctccctgacccgtctcgtcggcctaccgagactgagtatggagtctagtacttattacgngcagctatagtttgacagcgagcctatctcgttcggacgacggacagtctcggaccgttcgagcacgccgtaaggcctccggtccccgtcg

SEQ ID NO: 119336 - DNA, 515 bp, Homo sapiens
  misc_feature: GYAE6OF02F92KO.5.86.H09.1.454.CMB.1.raw
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctctgtaccaacaacatccaggcaaagcccccaaatcgtgatttctgaggtcagtaagcggccctcacggggtccctgactcgcttcnctggctccaagtcngcaacacggcctcccngaccgtctcgtgggcctccagactggagatgagcttgacttattactgcagctcatttgcgagcagccgtatactcgtcggcgaggaccaagctacgaccgtcgtacggtcacgacccgaaggcctccgccccgtcgg

SEQ ID NO: 119337 - DNA, 579 bp, Homo sapiens
  misc_feature: GYAE6OF02GRCH1.5.86.H09.1.454.CMB.1.raw
  modified_base (350)..(350): a, c, t, g, unknown or other
  misc_feature (350)..(350): n is a, c, g, or t
  modified_base (576)..(576): a, c, t, g, unknown or other
  misc_feature (576)..(576): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaaggcaatatacaagactacacagactccgtagaagggccgttcaccacctcgagagacaactccagggacacggtgtacctacacatgaacagcctgagagccgaggacacggccgtatattattgtgtgaggggaaactgggggcaatttgaccgngtggggccagggaaccctggtcaccgtctcctcacgcctccaccaacgggcccacgtccggtaccttcccccgtggcccgtccctcgcctccgtacggacgccaccctccggacgacgcacgcgccggcctcgggcctgccgtggtcaacgggtccttaccgttccgtagtctcgacttcgtaggtcggccggtcgtcggacgaacgggccgacgtagtacggatngtc

SEQ ID NO: 119338 - DNA, 721 bp, Homo sapiens
  misc_feature: GYAE6OF02HUMHW.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcaggcacagggtcctgggcccagtctgccctgactcacgcctccctccgcgtccggtctcctggacagtcagtcaccatctctgcacgtgggaccagcagtcgactagtttggtacgttataactatcgtctctcggtaaccaacaacactcgagaccaaaccgacccccaaacttcgtgtactttcgtgtacgtactaacgtaaaccgccctacggtacggggtcccctagtacgttccgtccgtttccgtcgtcggtccttaccgtaagttccgtacggaccgtaaccgtacccggtcccttcccgtacggtaccccgttccgttaccggtccgggtccctaccggtaacgtacgtaggaacggtacgttacggacggtctacggtactttaacgttcgtacgacgtacgtccttacgttacgtttaggaccgtacggtacgtaccggttaccgttacgttaccgttccgggttaccgggaccgggtaccgggaccgtacggtccggtaccggtaccggttaccggtacggtaccgaccggtacccggaccggtcccgtacccggttcccccgtacgggttaccc

SEQ ID NO: 119339 - DNA, 516 bp, Homo sapiens
  misc_feature: GYAE6OF02GHCOJ.5.86.H09.1.454.CMB.1.raw
  modified_base (370)..(370): a, c, t, g, unknown or other
  misc_feature (370)..(370): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaacgcccccaaactcgtagatttctgaggtcagtaacgcgccctcgaggggtccctgatcgcttctctggctcaagtctgcaacncgctccctgaccgtctcgtggcctccagactgaggatgaggctgacttattactgcaggcttcattgcaggcagcctatcgtctcggcgtagggaccaagctacgacccgttctaggtcacgccgaaggcctaccgccccctacgg

SEQ ID NO: 119340 - DNA, 573 bp, Homo sapiens
  misc_feature: GYAE6OF02G9SUD.5.86.H09.1.454.CMB.1.raw
  modified_base (442)..(442): a, c, t, g, unknown or other
  misc_feature (442)..(442): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacatttggtcgttataactatgtctcctggtaccaacaacatccaggacaaacgcccccaaactcgtgatttctgaggtcagtaacgcggccctcgacggggtccctgactcgtcttctctggctcaagttctcggcaacgccggcctcccgtgaccgtctcgtgggcctccgagactggaggagtgagtcgtgacttattacgngcagtctctatttgacgaggtcagtccgtattaccgtcgttcgggcgggaacggtaccgaaggtccgtacggacccgttaccgtaggtaccgacggtacccgaacggtcccgtaccggtcccccgtaccgg

SEQ ID NO: 119341 - DNA, 653 bp, Homo sapiens
  misc_feature: GYAE6OF02IJLPL.5.86.H09.1.454.CMB.1.raw
  modified_base (237)..(237): a, c, t, g, unknown or other
  misc_feature (237)..(237): n is a, c, g, or t
  modified_base (403)..(403): a, c, t, g, unknown or other
  misc_feature (403)..(403): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccggtctctggacagtcagtcacatctcctgcactgggaccagcagtgacngttggtacgttaataactatgtctcctcggtaaccaacaactactaccgaaggaccaaaacgacccccctaaacttcgtagtactttcgtgacggtacaagtaacgccggtacctacggacggggtcctgactcgtcttctcgtgtacctacgagtctagacaacnccgtcctccgtacgaccgttcgtcggtcggtcctacgaacgtcgtaggaaggtacgtaggacgggtcttacgtaacttacgttacgcgtactacgtctacgtattcgacgtacggcacgtaccgttattaccgtccgttacgggacggtacgggaaccgtacggtacccgttcgggtaaccccgttaccgttaacgggaccaaccgggtacccgtaacgggtcccgttaccccggtcccccggttaccgg

SEQ ID NO: 119342 - DNA, 586 bp, Homo sapiens
  misc_feature: GYAE6OF02F427I.5.86.H09.1.454.CMB.1.raw
  modified_base (398)..(398): a, c, t, g, unknown or other
  misc_feature (398)..(398): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
tcagatcagacacgcacgaccggtgctcgatttagtgctatagacttgagtctgggggaggcttggtacagcctggggggtccctgagactctcctgtgcagcctctggatttcaccttttactgattttggcatgacgtgggtccaccaggctccaggggaaggggctggactggctctcaaatattaatggaaaaaggcaatataacaagactaacacagactccgtgaacgggccggttcaccacctcgagacgacaactccagggacacggtgtacctacacatagaacagcctgagagccgaggacacggccgtatattatgtgtgagggaaacgtgggggactaagttgaccgcgtggggccgaacgggaaccctggtcgaaccggtctccncacgcctccaaccaagggcccagtccggtccttcccccgtgccgccctgcctccgacggcgccacctccggagacgacacacgcggacccgtgggctcgccgtcggtaccaaggacgttaccttccgtcgttacgtgtactcgtacggcggtacggtcgtacggcgaacggtcgacgtataggnagna

SEQ ID NO: 119343 - DNA, 785 bp, Homo sapiens
  misc_feature: GYAE6OF02F239Q.5.86.H09.1.454.CMB.1.raw
  modified_base (233)..(233): a, c, t, g, unknown or other
  misc_feature (233)..(233): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctccgtggacagtcagtcaccatcctcctgcacgtgggaccngcagtgacagttggtcgttataactatgtctcctaggtaaccaacgaacactccgacggaccaaacgaccccctaaacgtcgtagtactttcgtaggacggtactaaggtaacggccggtccccgtcggtacgggggtccctaggtactccgtaccttcgtcgtcggtaccttacccgaacgttcgtcggaccaaccgacccggtccctcccgtagtacccgttcgtcggtcgggtcctaccgacggtacgtcggaacgggtacgtacggacgggtacgttacggtaacctttaacgtttaccggacggtacctacggttaccttaccgttacgttttacggaccgtaacgggtccgttaaaccggggtacccgttaacgtttaacccgggttaccgggtttaccggggaccgggggtaaaccgggtacccggtaaacgggtacccgttaaccgggtaaccccgggtttcccggttaaacgggttccccgaaacccgggttaccccggtaaccggggtccccgttaccccgggtaccccccgtttacccggg

SEQ ID NO: 119344 - DNA, 552 bp, Homo sapiens
  misc_feature: GYAE6OF02GI58F.5.86.H09.1.454.CMB.1.raw
  modified_base (542)..(542): a, c, t, g, unknown or other
  misc_feature (542)..(542): n is a, c, g, or t
  modified_base (548)..(550): a, c, t, g, unknown or other
  misc_feature (548)..(550): n is a, c, g, or t
  modified_base (552)..(552): a, c, t, g, unknown or other
  misc_feature (552)..(552): n is a, c, g, or t
tcagatcagacacgcacgaccggtgctcgatttagtgctatagacttgagtctgggggaggcttggtacagcctgggggggtccctgagactctcctgtgcagcctctggattcacctttactgattttggcatgacgtgggtccgccaggctccagggaaggggctggactggctctcaaatattaatggaaaaggcaatataacaagactacacagactccgtgaagggccgttcaccacctcgagagacaactccagggacacggtgtacctacacatgaacagcctgagagccgaggacacggccgtatattattgtgtgaggggaaactgggggcaagtttgaccgcgtggggccagggaaccctgggtcaccgtctcctcagcctccaccaacgggcccagtccggtccttccccccgtggcccgtccccgtgcctccgacggacgccacccgtccgagacgcacacgccggccctgggctcgccgtgtccaaggactacgttccgtgtctgatctgcggcggctggacgagggcncagtgnnngn

SEQ ID NO: 119345 - DNA, 575 bp, Homo sapiens
  misc_feature: GYAE6OF02H3546.5.86.H09.1.454.CMB.1.raw
  modified_base (242)..(242): a, c, t, g, unknown or other
  misc_feature (242)..(242): n is a, c, g, or t
  modified_base (353)..(353): a, c, t, g, unknown or other
  misc_feature (353)..(353): n is a, c, g, or t
  modified_base (479)..(479): a, c, t, g, unknown or other
  misc_feature (479)..(479): n is a, c, g, or t
  modified_base (543)..(543): a, c, t, g, unknown or other
  misc_feature (543)..(543): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctccgtggacagtcagtcaccatctcctgcacgtgggaccaggcagtgacngttggtacgttataactatcgtctcctggtaccaacaacatccaggacaaacgacccccaaatccgtgtattcgtgtacggtcagtaacgccggccctggacggggtcccngtatcgtccttctctggcctacgaagtctggacaaccgacggccctacctcggtaccgtcctacgtcgggcctcgacgtacgtggaggagtgaggtctagtacttattacgtgctagcttacgttnttcgctacggcaccggtacgtattccgtcgtcgggacggacggtacaagtcgtcgaccgttcgnggcgacgccgaacggtctcccgcccttccggg

SEQ ID NO: 119346 - DNA, 771 bp, Homo sapiens
  misc_feature: GYAE6OF02F7QKK.5.86.H09.1.454.CMB.1.raw
tcagatcagacacgcacgaccggtgctcgatttagtgctatagacttgggtttggggactggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgggaccagcagtgacagttggtcgttataactatgtctctagtaccaacacatccaggacaaaccgcccccaaactcgtagtactttctggaggtacaagtaacgccggccctcggacggggttccctagactcgtcttcgtcgtcggtacctaccgtaacgttccgtacgggtacccaaacccggtacccggtcccccgttaccccgttacgggtaaccccggtttcccgttaccggttccggggtaccccttacccggtaacggtaacccgttacgggaacgggtacgttacgggaacggttccgttacgggttaaaccttttaacgtttaaccgtcgtacccgtacggttacccgttacgttacgtttttacggaccggtaacgggtaccgtaaccggttacccgttaacgttaccggttccgttaccgggggaccgggaacgggtaacccgtaagggtcccgttaaccgggtaacccgttcggtaaccggttaccgaaccggtacccgaacggtcccggtacccccgtaccccgttacccgg

SEQ ID NO: 119347 - DNA, 843 bp, Homo sapiens
  misc_feature: GYAE6OF02GTB3A.5.86.H09.1.454.CMB.1.raw
tcagatcagacacgcacgaccggtgctcgatttagtgctatagacttgggtttgggggctgggggtctcaggaggcagcgctctcaggacgtcaccaccatggcctggggctctgctcctcctcaccctcctcactcagggcacagggtcctgggcccagtctcgccctgactcacgccctccctccgcgtccgggtctccgtggacagtcacgtccacctatcctcctcgccacgtcgggaccaggactagtgaactgttcggttacgttaactaactagttcggtccttccgtacggtaaccaaacaacctactaccgaacggaccaaaccgacccctaaacgtcgtacgtactttaccgtaggtacggttacaacgggttaacgcccgggtcccttaccggtacgggggttcccctaggttaccgtccggttcctttccgttcggtccggtacctacccgttaaacggttccgtaacgggtaccgtaaacccggtcccgggttaccccgttaccccgggtttaccggtaaccccggtttcgtttaccccgggtcgggggtaccccttaccccggtaacgggtaaccggttacgggtacgggtaccggtacgggtaccggggttaccttaacgggttaacccgtttaacgttaacccggtgtaccgtacggttccgtacgttacgtttacggacgtacggtaccgtaccgttaccggtttacttaccgttccggttacgggaccggtaccgggtaaccgtcggtccgtaaccgggtaccccgttagtaccgggtacccaaccggtacccggtaggtcccggtacccgccccggttaaccgg

SEQ ID NO: 119348 - DNA, 721 bp, Homo sapiens
  misc_feature: GYAE6OF02I85P2.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactgggaccagcagtgacagttggtcgttataactatgtcctccgtcggtaaccaacaacataccgaggacaaaaccgacccccaaacgtcgtgtactttctggacggtacaaggtaacgccggtaccctcgacgggggtccctggacttccggtccttctccgtcggtccttacccgtaaaggttcctacggaccaaacccgacccgggtccccttccccgtacgtacccgttcctccggttcggggtccctaccggaacggaccgtagggaacggtacgtgggacggtcgttaacgttaacgttaacgttacctcgtaccaacgtccttacttacggtttacgccgtagggaccgtaacggttacccgttaacgtttaccgtacggttaccgggaccgggtaacgggacccgtaaaggtccgttaccggtacccggtaccggtaccggtaccgaccggtaccccgtaacggtcccgttcccggtcccccgttacccggg

SEQ ID NO: 119349 - DNA, 613 bp, Homo sapiens
  misc_feature: GYAE6OF02JP5S2.5.86.H09.1.454.CMB.1.raw
  modified_base (143)..(143): a, c, t, g, unknown or other
  misc_feature (143)..(143): n is a, c, g, or t
  modified_base (219)..(219): a, c, t, g, unknown or other
  misc_feature (219)..(219): n is a, c, g, or t
  modified_base (449)..(449): a, c, t, g, unknown or other
  misc_feature (449)..(449): n is a, c, g, or t
  modified_base (486)..(486): a, c, t, g, unknown or other
  misc_feature (486)..(486): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacgngggtcctgggcccagtctgccctgactcacgcctccctccgcgtccggtctccgtggactgtcagtccaccatccncctgcctacgtcgggaccagcagtcgactagttcggtacgttatactatcgtctccgtagtaccaacacactaccgagacaaaccgaccccaaacgtcgtacgtacttcgagtacgtacagtaacgccgtacctcggtacgggtacctgtacgtccgtcttctcgtcgcctcgaagtcacggacacgccggtccctcgtacgcccgtctcgtcggtcctacgacgtacgnggacgtgtacggcgtcgtacggtacttagtacgtacnctacgtactagttacgtcgacgtacgacgtacgtcgtactccgtcgtacggcggtaacgggacacggtcgtaacgtcccgttacggacgtaccgtacggaccgtacgtccgtcccgtacccggtccg

SEQ ID NO: 119350 - DNA, 601 bp, Homo sapiens
  misc_feature: GYAE6OF02F3BXT.5.86.H09.1.454.CMB.1.raw
  modified_base (202)..(202): a, c, t, g, unknown or other
  misc_feature (202)..(202): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcacgtgggaccagcagtgacagttggtcgttataactatgtctcctggtaccaacaacatcaggcaaacgcccccaaactcgtgatttctgaggtcagtaagccggccctcgacggggtcctgactcgcttctctggctcaagtctgacacacgcctcccgtgtaccgtcgtcgtcggtcctaccgtagacgtggaggactggacggtctacgtacttacttaacgtgtacagtctctagtttcgacacggtcacgtaccgttactaccttcgttaccgggtccgggaagggacccgtaacggtccgttacgggaaccccggttccgttaacgggtccgacggtccccgtaagggcccttacccggtccccgttacccggg

SEQ ID NO: 119351 - DNA, 708 bp, Homo sapiens
  misc_feature: GYAE6OF02HWYKQ.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactgggaccagcagtgacattggtcgttataactatgtcctcctaggtaccaacaacatccaggacaaacgcccccaaatcgtgtatttcgtgacgtcaagtaacgccggtccctcgacggggtccctgactcgcttctcgtcggcctaccgaagtcgtggaccaaaccgaccggccctcccgtcggtacccgttctccggtcgggccttacccgacggtacgttaggaacggtacgtcgggacggtaccgttacggtaactttaacgtttaccgtacgtaccgtacggtccttacgttaacgtttcggaccgtacgggaccgtacggttacccgttaacttaccgtttccgttaccggggaccgggtaacggggtaacccgtaaacggtacccgttaccgggttaacccggttacccggttaacgggtcccgtaaccgggtaccccggtaacgggtcccgttaccccggtccccccggttaaccggg

SEQ ID NO: 119352 - DNA, 653 bp, Homo sapiens
  misc_feature: GYAE6OF02JIIN9.5.86.H09.1.454.CMB.1.raw
  modified_base (215)..(215): a, c, t, g, unknown or other
  misc_feature (215)..(215): n is a, c, g, or t
  modified_base (316)..(316): a, c, t, g, unknown or other
  misc_feature (316)..(316): n is a, c, g, or t
  modified_base (385)..(385): a, c, t, g, unknown or other
  misc_feature (385)..(385): n is a, c, g, or t
  modified_base (457)..(457): a, c, t, g, unknown or other
  misc_feature (457)..(457): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacagggtcctgggcccagtctgccctgactcagcctccctccgcgtccgggtctcctggacagtcagtccaccatcncctgcactggaccagcagtgacattggtcgttataactatcgtctcctggtaaccaacaacatccaggtacaaaacgcccccaaaactcgtacgatttcgngtacggtcagttaacgccgtacctcgacggggtccctgactcgcttctctgctccaagtctggacaacncgcctcctgaccgtctcgtacggcctccgagtctagacggtatcggacgtctagtaaccttagtttacccgngtacctacggtcttacgttaaacgttttcggacctaagggtacccgtaacgttacccggtttaacgtaacctttccggggtttaccgggaccgggtaacgggaacccgtaacggtaccgttccggtacccgttaaccgttacggttaccgaccggtaccccgtaagggccccgttacccggcccccggtttaccgg

SEQ ID NO: 119353 - DNA, 625 bp, Homo sapiens
  misc_feature: GYAE6OF02G6Y3F.5.86.H09.1.454.CMB.1.raw
  modified_base (388)..(388): a, c, t, g, unknown or other
  misc_feature (388)..(388): n is a, c, g, or t
  modified_base (451)..(451): a, c, t, g, unknown or other
  misc_feature (451)..(451): n is a, c, g, or t
  modified_base (621)..(621): a, c, t, g, unknown or other
  misc_feature (621)..(621): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccagggaaggggctggactggctctcaaatattaatggaaaaggcaatatacaagactacacagactccgtgaagggccggttcaccacctcgagagacaactccaggacacggtgtacctacacatgaacagcctgagagccgaggacgacggccgtatattagttgtgtggaggggtaaacgtggggactaagtttgaccggtcgtggggccaggggaaccctggtcaccgtcncctcacgcctccaccaacggcccagtccgtccttcccccgtggccgtccctgcctccgaggcnccaccctcgacgacgaccaccgacggtccggcccgtcgggccgtccggccgttacgggtaccgtaacggtacccgttaccgtttccccggttcgttcttcgtacgttcgtcggtacgggccgggtcgttcgggaccgtaacgggtcccggacggtaacgtacggctacgntacg

SEQ ID NO: 119354 - DNA, 596 bp, Homo sapiens
  misc_feature: GYAE6OF02JHGA2.5.86.H09.1.454.CMB.1.raw
  modified_base (308)..(308): a, c, t, g, unknown or other
  misc_feature (308)..(308): n is a, c, g, or t
  modified_base (392)..(392): a, c, t, g, unknown or other
  misc_feature (392)..(392): n is a, c, g, or t
  modified_base (542)..(542): a, c, t, g, unknown or other
  misc_feature (542)..(542): n is a, c, g, or t
  modified_base (589)..(589): a, c, t, g, unknown or other
  misc_feature (589)..(589): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtgggtccgccaggctccagggaagggctggactggctctacaaatattaataggtaaagctaatatacaagactacacagactccgtagaaggtccgttcaccgacctcgaagagacaactcgaggacacggtntacctacacagtacgaacagcctagagacgccgagacacggcgtatatactgtgtagagggtaacgtgggactaagttgaccgngtcgggacgacggaccgtgtccgaccgtcgtcctcgacgtcctccgaaccgacggccacgtccggttaccgttccccgtcgtcccgtcccgtgcccgtaccgcggacgtaccgaccgtaccgacgacgctacgacgtccggccgcggtcncggtccgacggtacgacggtacctaccgtccggtatccgtgactcgngtaccgg

SEQ ID NO: 119355 - DNA, 539 bp, Homo sapiens
  misc_feature: GYAE6OF02FRDDA.5.86.H09.1.454.CMB.1.raw
  modified_base (445)..(445): a, c, t, g, unknown or other
  misc_feature (445)..(445): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgggaccagcagtgacattggtcgttataactatgtctcctggtaccaacaacatccaggcaaacgcccccaaatcgtgatttctgaggtcagtaagcggccctcacggggtccctgactcgtcttctcgtgctccaagtcgtagacaaccgacggccctccctgacccgtcctcgtcgggctccagtactggaggtatggacggctagaacttattaccngacatctcagtttgcgaggtcacgtccgtatcgttcgtcggacggacggacacgtctacgaccgtcgtagcacgcccaaggctccgcccctcgg

SEQ ID NO: 119356 - DNA, 609 bp, Homo sapiens
  misc_feature: GYAE6OF02H9MEH.5.86.H09.1.454.CMB.1.raw
  modified_base (309)..(309): a, c, t, g, unknown or other
  misc_feature (309)..(309): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtccaccatctcctgccacgtgggaccagccagtgacattggtcttataactatgtctctgtacaacacatcagcaaacgccccaaactcgtagtatttcgngtaggtcagtaagccggcctacgacggggtcctgatcgtcttctctggcctacaagtctggaccaacgaccggcctcctcgaccgttctcgtcgggcctaccgagtactggacggagttcggaacggtctacggtactactttaaccgtgactacgtcgttcttacgtttcgacgtaacggtcgacggttcctaagttcctcggttcgggacgggtaacggaaccgtaaggtccgttacgtacccggttaccgtaggaccaccggacccgtaacggtccgttacccggccccgttaccgg

SEQ ID NO: 119357 - DNA, 731 bp, Homo sapiens
  misc_feature: GYAE6OF02H3Z3C.5.86.H09.1.454.CMB.1.raw
  modified_base (322)..(322): a, c, t, g, unknown or other
  misc_feature (322)..(322): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtccaccatcctcctgccactgggaccagcagtcgactagttggtacgttataactatcgtcctcctggtaccaacaacatccaggacaaacgacccccaaactcgtagtactttcngaggtcagtaagccggcctcgacggggtccctgactcgtcttcgtactcggcctaccgaacgttcgtaggaccaaccgaccgggtcccttccccgtacggacccgttacgtccgttacgggtccctaccgacggtaaccgtgggaacgggtagttacgggacggttaccgttaggtaacctttaacgttaaccgtcgaccgtagttaccttcgttacgttttcggaccgtaacggtaccgtaaccggttccgttaaacgttacccgttacggttacccggggacgggtaaccggggtaacccgaacgggtacccgttaccggttaaccccggttaccgttaacgggtacccgtaaccggtacccccgtaaacgggtccccgttacccccggtacccccggttacccggg

SEQ ID NO: 119358 - DNA, 668 bp, Homo sapiens
  misc_feature: GYAE6OF02H71QN.5.86.H09.1.454.CMB.1.raw
  modified_base (500)..(500): a, c, t, g, unknown or other
  misc_feature (500)..(500): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctccgtggacagtcagtcaccatctctgcacgtgggaccagcagtgactagttggtcttaataacttagtgttcctacgtaggtaaccaaacaacacgtccgaggacaaaaccgaccccctaaagttcggtactaattttccaggacgtacaaggtaacgccggtaccctgacggggtccctaggtactccgtccttctcgtggtcctacgtaacgtcgtaggaccaaaccgccggtccctccgtacgtccgtcgtcgtcggcctacgcgtacgtgaggtagtaggacgtcgtaagtacttacttacgngtcgactctacgttaagttcggacgtacgacgtacgtaccgttaactccgttcgttaccgggacgggaacggtaaccgtaacggtccgttaccggtaacccgttacggtacggtaccgtacccggtacccggtaacggtcccggtacccggtaccccgttaccccggg

SEQ ID NO: 119359 - DNA, 790 bp, Homo sapiens
  misc_feature: GYAE6OF02IA4N7.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctcgggcccagtctgccctgactcacgcctccctccggcgtccgggtcctccgtcggacacgtcacgtccacctattcctccgtgactacgtcggggaacctacggccaagtcggactagtttggtacttaagtaactatcgttactccgtaggtaccaacaactactaccgaggaccaaccgacccccaaacgtcgtcgtacttccgtaggaacggtctaacggtaacggccggtacccgttccggtacgggggttacccacgtacgtccgttaccgttttccgcggttacgtaccgttacccgtaacggttcgtcggggtaaccaaacccgggtacccggtccccgtttacccggtaccgggttaccccgtttacccgttccgggtccggggtaaccccttaccgggtaacggtacccggttagggtaaaccgggtcggtaggtacgggtaccgttacgttacttaacgttaccgttcgactacgtcctcgttacgttcgcgtaacggtccgtacgtcgttactcgttaccggttacgggaccgggttacgaacggtacggtacccgttcgtaccccggttaacccgtgggttaccacccggttaccggaaccggttccctccccggacccgttacccgg

SEQ ID NO: 119360 - DNA, 557 bp, Homo sapiens
  misc_feature: GYAE6OF02FISI1.5.86.H09.1.454.CMB.1.raw
  modified_base (313)..(313): a, c, t, g, unknown or other
  misc_feature (313)..(313): n is a, c, g, or t
  modified_base (463)..(463): a, c, t, g, unknown or other
  misc_feature (463)..(463): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcactagggtcctgggcccagtctgccctgactcagcctccctccgcgtccgggtctcctggacagtcagtcaccatcctctgcactgggaccagcagtgactattggtcgttataactatgtctcctggtaccaacaacatccaggcaaacgacccccaaactcgtgtatttcngaggtcagtaagcggccctcgacggggtccctgactcgtcttctcgtcggtcctaccaagttcgtcggacaaccgaccggtcccttcccgtcggacccgtctcgtcgggtcctccgagtactggaggatggaggtctagacttattaccngcagctgtattcgcaggtcagtccgtatcgtcgtcgggcggacggacgagcgtacgaccgtcgtagtcacgaccgaggtcctccgccccgtcgg

SEQ ID NO: 119361 - DNA, 749 bp, Homo sapiens
  misc_feature: GYAE6OF02HVMS2.5.86.H09.1.454.CMB.1.raw
tcagatcagacacgcacgaccggtgctcgatttagtgctatagacttgggtttgggggctgggggtctcaggaggcagcgctctcagggacgtcaccaccatggcctgggctctgctcctctcaccttcctcactcaggcacagggtcctgggcccagtctgccctgactcagcctccgtccgcgtccgggtctccgtggacagtcagtcacatctctgcacgtcggacagcagtcgactagttggtacgttataacgtatcgttctcccgttagaacctaacaacgacgtaccgaaggtacctaaaacccggtccccctaaaacgttcggttaacgttacttttacgtacggtaacggtaccgtaaggtaaccggtccgtaccgtacggtaccgggtaccctgtacgtcgtcttacgtcgtacgtactaccaagtcgtacggacacgtacgcctacgtacggtacctcggtcgtacgggcctacgacggtacgtcggtaaggacgttagggacgtacgttacggtaacttacgttacgacgttacacgttcgttacgttaacttcggaaccggtacggtaccgtaaccgttaccgttaaaccgttaccgggttccgggttacgggacccgggtttaacgggaaccgtaacggtcccggttaaccgtcccggttaacccggttacggtaaccgaacccggttaaccccggtaagggtcccccgtttacccggacccccggtttaccggg

SEQ ID NO: 119362 - DNA, 697 bp, Homo sapiens
  misc_feature: GYAE6OF02JCUFP.5.86.H09.1.454.CMB.1.raw
  modified_base (238)..(238): a, c, t, g, unknown or other
  misc_feature (238)..(238): n is a, c, g, or t
  modified_base (310)..(310): a, c, t, g, unknown or other
  misc_feature (310)..(310): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcacgtcgggaccagcagtnacattggtacgttatactatgtctcctcggtaccaacaacatccaggcaaacgccccaaatcgtagatttcngagtcagtaacgcgcctgacgggtcctgactcgtcttctcgtcggctacgacgttctcggtaccaaccgaccggtcccttccccgtcggtacccgttccgttccgtaccgggtaccctaccgtacggtacgttacgggaggtacggtaggtaccggtacgttacggtaaccgtttacttaccggttcgaccgtacgtaccgttacgtacgttttacggacgtaacggtaccgaacggtaccgtttaaccgttaccgttaccggttaccggggtaccgggtaacgggtaaccggtaacggaccggttacccggtaacccggttaccggttaacgggtaccgaaccggtacccggtaacggtcccggtacccgtccccccggtttacgg

SEQ ID NO: 119363 - DNA, 795 bp, Homo sapiens
  misc_feature: GYAE6OF02H6W4H.5.86.H09.1.454.CMB.1.raw
tcagatcagacacgcacgaccggtgctcgatttagtgctatagacttgggtttggggctggggtctcaggaggcagcgctctcaggacgtcaccaccatggcctgggctctgctcctcctcaccctctcactcagggcacagggtcctgggcccagtctcgccctgactcacgcctccctccgccgtccggtctcctggacagtcagtcaccatctcctgctacgtcgggaccagaccgtagtcgactagttggttacgttaataacgttatgtctccgttaggtaaccaacaacataccaggaaccaaaccgcccccaaattccggttacgtacttacgtagtacggtactaacggtacgtaccggtccctacggtaccggggttccctaggtacgtaccgtccgttacgtacgtcggccttaccggtaacggttccgtggtaacccgaaaccgtaccccggttcccgttacccgtacccggtaaccgtcgttccggtaccgggtacccgttacccgaaacggttacggtaaggtaacggggtacgtacggggtaccggtagttaaccggttaagttaaccttacgtacgtacgacgtcgttacgtaacgtttccgacggtacggtaccgtacggtacccgttaacgttaccgttacggtaacccgggtaccgggtaaacggggtaaccgtaccgtaccgggttaaccgtaaccccgggttaccgttaacccgggttccgaaccccgggaacccgtaaccgggttaccgttacccccggtcccccggttaccgg

SEQ ID NO: 119364 - DNA, 593 bp, Homo sapiens
  misc_feature: GYAE6OF02G5251.5.86.H09.1.454.CMB.1.raw
  modified_base (240)..(240): a, c, t, g, unknown or other
  misc_feature (240)..(240): n is a, c, g, or t
  modified_base (475)..(475): a, c, t, g, unknown or other
  misc_feature (475)..(475): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacnttggtcttataactatgtctcctggtaccaacaacatccaggcaaacgccccccaaactcgtgactttctgaggtcagtaacgccggccctcgacggggtccctgactcgtcttctcgtggcctcaagtctaggcaacaccggccctaccctcgtacccgtctccgtcgggtcctccgagaccgtgaggagtcggaggcttgtaacgtacttacgtcgctacgtctctatttcgngtacggtcacgtaccgtactaaccgttcgttccgggacggacgggaaccgtaacgccgtacggtacccgttccgtacggtaccacggcccgtaacggtccgtaccgcccccgttacgg

SEQ ID NO: 119365 - DNA, 838 bp, Homo sapiens
  misc_feature: GYAE6OF02JO9TM.5.86.H09.1.454.CMB.1.raw
  modified_base (142)..(142): a, c, t, g, unknown or other
  misc_feature (142)..(142): n is a, c, g, or t
  modified_base (247)..(247): a, c, t, g, unknown or other
  misc_feature (247)..(247): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcaggcacngggtcctgggcccagtctgccctgactcagcctccctccgcgtccgggtctcctggacagtcagtccaccattcctcctagcctacgtcgggaccaggccaggtnactagttcggtacgttactaacgtatcgtctccgtggtaaccaacaacgtactaccagtaccaaccgaccccaaactcgtacgtattcctacgacggtcagtaacgcggaccctacgtacggggtccctgtactcggtcttcgtctcgtactccgtattacgcgacctaacgaccggtccctccggtcgtacccgttccgtccgtcggggtaccctaccgtacggttacccgtagggtaccggttaacgtacgggtaaccggttcggttaccgtaaaccgtttaacggttaccgttacgtaccggtaaccggttaacttcccgtttacggtttaccggtacccggtacgggttaacccggtaaccggttaaccggttttaacccgtttacccgggtttaaccgttacccgggggggggtttaacccgggaaccgggggtaaaccccggtaccgggtttacccggtaacccgggtttaaccccggggtttaaccccgggttaagggggttacccctaacccggggggttacccccgtaacgggggtttcccccgggttaccccccggttaccccccgggggtttaccccggg

SEQ ID NO: 119366 - DNA, 760 bp, Homo sapiens
  misc_feature: GYAE6OF02FJ2D9.5.86.H09.1.454.CMB.1.raw
  modified_base (202)..(202): a, c, t, g, unknown or other
  misc_feature (202)..(202): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgcccctgactcagcctccctccgcgtccgggtctcctggacngtcagtcaccatcctcctgcactgggaccagcagtgacattggtcgttataactatgtcctccgtggtaaccaacaacatccaggacaaacgaccccccaaactcgtagtacttttacgtggtaggtctaagggtaaacgtcccggtccccgttcggtaaccgggggggttcccctagggtacgttccggtcctttcctccggttcggtacccgttacccgaaacggttccgtacgggtacctaaaccgaccgggtccccttccccgtcgtacccggttcttccgtcgggtcctaaccgaacggtactgggtacgggtagtacgggtacgtaccgttgtaaccgttacgtttaaccgtcgtaccgaacgttccttacgttagttttacgccgtaacggggcctaacgggtcccttaacgtttaccgtccgggtttaccgggaccgggaacggggtacccgaaacggtccgttaacccgggtaaccccggttacccgttaacgggtcccaaccggtaccccggtaacggtccccttacccggtccccccgttacccggg

SEQ ID NO: 119367 - DNA, 700 bp, Homo sapiens
  misc_feature: GYAE6OF02I83PE.5.86.H09.1.454.CMB.1.raw
  modified_base (521)..(521): a, c, t, g, unknown or other
  misc_feature (521)..(521): n is a, c, g, or t
  modified_base (556)..(556): a, c, t, g, unknown or other
  misc_feature (556)..(556): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcgagggcacgacgggtccgtcggggcccagtctcgccctgacctcagtccctccctccgcggtccgggtctccgtggacacgtcacgtccacactcctctcggacacggtcggacagctaggtcactagttggtactaataactagtcgtctcgtcgtaaccaacacgactaccgacgaactaaccgacccctaaacgtcgtacgttactttcgacggtaacggtacacggttaaacggcccggtaccctcggtacggggttccctaggacttcgtccttacgtcgtcggtaccttaccgagttcgtacggacctaaccgtaccgggtcccttaacccgtcggtacccgtccgttaccggtcggtacctaccgtacgacggttacggngtaacggtcggacgttcgacgttactattccgtancgtagtctgttacgttcgacgtacgtacgcgtaccgttactaccgttcgtacgggacggtaaccggtacgacggtaccgtcggtaaccgtaccgtacggtaccgtaccggtaccgtacggtccgtcccggttaccccgtccggg

SEQ ID NO: 119368 - DNA, 711 bp, Homo sapiens
  misc_feature: GYAE6OF02GFJCD.5.86.H09.1.454.CMB.1.raw
  modified_base (195)..(195): a, c, t, g, unknown or other
  misc_feature (195)..(195): n is a, c, g, or t
  modified_base (244)..(244): a, c, t, g, unknown or other
  misc_feature (244)..(244): n is a, c, g, or t
  modified_base (707)..(707): a, c, t, g, unknown or other
  misc_feature (707)..(707): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtggtccgccaggctccagggaagggctggactggctctcaaatattaataggaaaagnaatatacaagactacacagactccgtagaaggccgttcaccacctcganagacaacctccgaggacacggtacgtacctacaccatacgaacacgcctgagacgccgagacacggcgtatagttattggtgtaggaaggggaaacgtgggggactaagtttcggaccgtcgtcggggaccgaaggggtaacccgtggtaccgtaacccggttcctacccggtactaacggtcccctacccgaacccggaacggggtccccctaacgttcccgggttccctttacccccgtcggaccccgtccccgtcggcccgtaccgaacgggaccgccctaccccgtacggacgtacgaccaaccgacggcccggtacccgtcgggttaccgtccggtcccgtacggtaccgaaacggttcccgttaacccgttcccgttaacggtccttaagtccgtccggtacggtaccggtcgggccgtacggtacggtaccgggactaccggtaagttcggatcgngtac

SEQ ID NO: 119369 - DNA, 623 bp, Homo sapiens
  misc_feature: GYAE6OF02HIA8L.5.86.H09.1.454.CMB.1.raw
  modified_base (304)..(304): a, c, t, g, unknown or other
  misc_feature (304)..(304): n is a, c, g, or t
  modified_base (444)..(444): a, c, t, g, unknown or other
  misc_feature (444)..(444): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctgtaccaacaacatccaggcaaagccccaaatcgtgattcngaggtcagtaagcggcctgacggggtccctgactcgcttcgtctcggcctacgaagtctaggacaaacacgggccctcccgtgacccgtctcgtgggctcccgaagacctgaggtatcgaggcttaggacctagttacgngcaacgctaccttaagtttcgaccaagggtacccgacggtcccggttaaacttaccgttaccggtttcgggacgggtaacgggacccgtaaaggtcccgtagggaaccccgttcccggttaaggtcccgtaaccgggcccgttaaaccggggcctttacccggccccccgttaaccggg

SEQ ID NO: 119370 - DNA, 833 bp, Homo sapiens
  misc_feature: GYAE6OF02HF9Q5.5.86.H09.1.454.CMB.1.raw
  modified_base (204)..(204): a, c, t, g, unknown or other
  misc_feature (204)..(204): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctcctccgcgtccgggtctcctggacagtcngtcaccatcctccgtgctacgtcgggaccagtcagtgactagtttcggtcgttaataacgtatcggtacttccgtggttaaaccaacaaacctataccgtaacggaccaaaaacggtaccccccaaaacgttccggtagtacgtttccgtaggacgggtttaccaaaggttaacggcccggacccgttacggtaaccgggggttcccctaggtaacgttacccggtccgtttcgttccgtacgggtaccttacccgtaaacggtttccggttaccgggaacctaacccgtaccgggttaccccctttaccccggtacggttaaccccggtttccctacccgggttacggggttacccctacccggtaacgggttaacccgttcggggtaaacgggtaaggtccgggtaacggggtacctttaaccggggaaccttttacggttaaaccgttcggtaacctacggtttaccgtaccgtttaggttaccgtaccgaggtcctaaacggtccgttaacgtaccgttcgttccggggacgtacggggaaccctaaggtcccgggttacgaacccggttaccgtaaggtccccgtaggtaccccgtaagggtccctacccggcccccgttacgg

SEQ ID NO: 119371 - DNA, 692 bp, Homo sapiens
  misc_feature: GYAE6OF02FTNGL.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacaggtcctgggcccagtctgccctgactcagcctccctccgcgtccggtctcctggacagtcagtcaccatcctcctgcacgtcgggaccagcagtgactattggtcgttataactatgtctctgtaccaacacatccaggcaaacgccccaaatcgtgtattctgaggtcagtaagcggcctcgacggggtccctgactcgcttctctcggctaccgtaagtctggaccaaccgaccgtccctcccctacgtaccgtccttacgtcggtcctacccgagtaccgtggtaaggtacgtaggaggtaccttgtaacctttacttaaccgtgtcctaacggtccttacgtagtttttaccggacgtacgggtacctacgttacccggttaactttaacccggttccgttaccggggaccgggtaacggggtaacccgaacgggtaccgttaacccgggttaacccccggttaccggtttaacgggtacccgttaaccggaccccggtaaaccgggtcccggttacccccggtaccccccggtttaaccccggg

SEQ ID NO: 119372 - DNA, 770 bp, Homo sapiens
  misc_feature: GYAE6OF02IKU98.5.86.H09.1.454.CMB.1.raw
  modified_base (209)..(209): a, c, t, g, unknown or other
  misc_feature (209)..(209): n is a, c, g, or t
tcagatcagacacgcacgaccggtgctcgatttagtgctatagacgttgggtttgggggtgctcgatttagtgctatagacttgggtttggatctacgttgcaggtgtaggtctgggtcctgagactctctgtgcagtcctctggacttccacctttatgtattttggcatggacgtggtccgcgtaggctccgagggagggctggacngctcgacaaattataagtaggtaaagcaaatatacgaagactacagagacgtccgtaggaacgggtacccgtcaccgacgtagacgtagaaccaacgtccggaaggaccacggttacgtacctaacacaagtacaaacgtccgcgtacgacggaacgacccggaaggaccgacgggtacctaagttaacgttgtacggtgtaacggggacgggaaggttcggggtactaaggttcgacggtcgtacgggaccgtacgggtactacggacgtacgtccgttaccgctacgccctaccggaccgaacgggccctacgttccggtaccccttcccgtcgaccggttacccgtcggcccgttacggaacggcccgtaacccggtaccccggtaccggacgtaacggacccccgaacggtacccgggcccggtaccgttcggggcccgtaaccggggttcccggttacggttaaccccggtaaaagggtcccccgtttaacccgggttttccccggtacgtttaccccggacgtttacccgggtcccggttacggggtaacccggg

SEQ ID NO: 119373 - DNA, 632 bp, Homo sapiens
  misc_feature: GYAE6OF02HODIQ.5.86.H09.1.454.CMB.1.raw
  modified_base (263)..(263): a, c, t, g, unknown or other
  misc_feature (263)..(263): n is a, c, g, or t
  modified_base (494)..(494): a, c, t, g, unknown or other
  misc_feature (494)..(494): n is a, c, g, or t
  modified_base (515)..(515): a, c, t, g, unknown or other
  misc_feature (515)..(515): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtctgccctgactcagcctccctccgcgtccggtctccgtggacagtcagtcacctatctcctgccacgtgggaccagcagtgactgttggtacgttaataactntgtcctcgtacggtaaccaactaacactaccgaggaccaaaccgccccccaaaacgttcgtagtatttcgtcgaggtcgaagtaacgccggtccgtcggcggggttccctgtatccgtccttcgtcgtcgcctaccagtctgaacctaacgccggtccctaccgtcgacccgtctccgtcgggcctacgtacgtactaggaggtactggacggcttagtacttacttacgngactcgtactactagttccgngacggtcgtacgtccgttaatccgttacgtcgggtacgggaacggtacgtaacgtcggtacgtacccgttacggtacggtaccgacgaccgtacggtcccgtaccgcccccgttacg

SEQ ID NO: 119374 - DNA, 750 bp, Homo sapiens
  misc_feature: GYAE6OF02GFYX1.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcaccttttactgtattttggcatggacgtgggtccgccaggctcgagggagggctggactggcctctacaaattattaagtaggtaaaggcaaatataacaagactacaacagactccggtaggaacgggtccgttaccaccaccgtcgaagacgaccaactccgaggacacggtctaaccacacatacgaacacgcctagagacgccggagacaccggctattattagttgtagtaggaacgggtaacggtcgggggacttaaggttacggaccggtccggtacggggacccggtacgggtaacccgtcgggtacccgaacccgttcctaccgtaccgtaccgtcccgtacccgaaccggtaaccgggtaccctacggttcccggttccccgttacccgtcggtacccgtcccgtcgtcccgtaccggaccggaccgtaccccgtaccgtaccggaaccggtaccgtacccgaaccggtaccgggcccggtcccggtacggggtccgtaccgggtaccggtccgggtaaccgtaaaccggttacccttacccggttcccggttacggttccgtacggttacctacggttacggaccgggg

SEQ ID NO: 119375 - DNA, 888 bp, Homo sapiens
  misc_feature: GYAE6OF02IJ3MG.5.86.H09.1.454.CMB.1.raw
  modified_base (207)..(207): a, c, t, g, unknown or other
  misc_feature (207)..(207): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtcctcctggacagtcngtcaccatctctgcacgtcgggaccagcaggtcgactagtttggtacgttataacctattcgtacttccgtacggtacccaaacaacactccgtaaggacctaaaaccggaccccccaaaacgttccggttacggtattttaccgtacggtaacgggtttaccaacggggtttaaaccggaccggggtacccccgttaccgggtaaccgggggggtttaccccgttacgggtaacggttcccgtccgttttacctcccggtttacgggaccctttacccggtaaacggtttccgttacgggtaaccctaaaacccgggtaacccgggtccccccgttacccgtaccggtaaccccggtttccgttaccggtcgggggtaccccttacccgtaacggtaaccgttacggaacggggtacgttacgggaacggtacgttacgggtaactttaacgttaaccgtcggtaccgaacggttcccgttattaacggttttcgaccggtacgggtaccgtacggttaacccgttaacgttaacccggttaccggtttaccggggacccggggtaaacggggtcccggtaaacgttccggtaaccgggtacccggtttacccggtaacggttaccgaccgggtaccccggtaaccgggtcccgtacccggtacccccccggttcccggg

SEQ ID NO: 119376 - DNA, 656 bp, Homo sapiens
  misc_feature: GYAE6OF02JHYBI.5.86.H09.1.454.CMB.1.raw
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (383)..(383): a, c, t, g, unknown or other
  misc_feature (383)..(383): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccaggtctgccctgactcagcctccctccgcgtccgggtctcctggacagtcagtcaccatcncctgcactcgggaccagcagtgacctnttggtcttataactatgtctcctcggtacaacaacactccaggaccaaacgaccccaaactcgtgtattctcgaacggtcagtaacgcggaccctcgacggggtcctgactccgccttcgtcgtcgctaccgaagttcncggtacaacgaccggtccctccgtcgtacccgtctcgtcgggcctccagtacncggtggatcggnggtcctaagtactttacgttacacggtccgtactacttactacgtttcggacgaaccgggtctaaccggtccgttaaactccggttcggtaccgggaccgggaacgggtaacccaaccgggttccggttaccggtaacccggtttacccggtacgggtaccaacccggtacccggaacgggacccgttcccggtacccccggttccgg

SEQ ID NO: 119377 - DNA, 672 bp, Homo sapiens
  misc_feature: GYAE6OF02G0DUZ.5.86.H09.1.454.CMB.1.raw
  modified_base (266)..(266): a, c, t, g, unknown or other
  misc_feature (266)..(266): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagttcctgccctgactcacgcccttccctccgcgtccggtctcctggacagtcagtccaccatctcctgcacgtggaccagcagtgactgttggtacgttataactatntctcctagtaaccaacaactatccgacggacaaaccgacccccaaactcgtgtactttctagacggttacaaggtaacgccggtcctcggacggggtccctaggtactccgtccttcgtcgtcggtcctaccgtagtccgtcgaaccacgaccgtccctccgtacgtacccgttctccgtcgggtcctacccgaggtctaggacgtacgtggacggtctacgtaacttacgttacgagtacacgtcttacgtacgtttcgacgacggtacgtacggtacccgtttactaacgttccggtcgggaccggtacgggaaccctaggtacccggttacggaccccgttacgtaacggtccaaccgggtaccccgtaaggtccccgttacccggtacccccgttacccggg

SEQ ID NO: 119378 - DNA, 784 bp, Homo sapiens
  misc_feature: GYAE6OF02H3LYL.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacgagggtcctgggcccagtctgccctgactcagcctcctccgcgtccggtctccgtggacagtcagtcaccatctctgcacgtcgggaccagcagtgactagttggtacttagtaactatcgttactccgttacggtaaccaaacaacgtactccgaacggaccaaaccgacccccctaaatcggtacgttaactttccgtaggtacggtacgtaacgtaacgggtcccggaccccgttaccggacgggggttcccctaggtaacgttccggtaccttttccgtacggtcggtcccttaacccgtaaacggttcgtacgggtacccaaaaccgtcccggtccctaccccgttaacgtacccgttcgtaccggttcggccttacccgacggtacgtacgggtacgggacgttacgggaacgggttaccttacggtaaacgtttacgtttaccgacgtaccgcgttactacgttacgtttaccggacgaaccgtaccggtaaccgttccgttaaacgttcccggttacgggtttaccggggacccgggttaacggtacccggtaacgtcccggtacggtaacccgttaccgaacggttcccaacggtaccccggtaacggtacccgttcccgtaccccgttaccgg

SEQ ID NO: 119379 - DNA, 549 bp, Homo sapiens
  misc_feature: GYAE6OF02GPYO6.5.86.H09.1.454.CMB.1.raw
  modified_base (308)..(308): a, c, t, g, unknown or other
  misc_feature (308)..(308): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttcngaggtcaagtaacgccggccctcgacggggtccctgactcgcttctctggctccaagtctggcaaacgaccggccctcccgtgacccgtctcgtgggcctccgagtacctgaggatggacggtcctagacttattacctgccagctctatttgcgaggcagcctatactcgttcggcggacggaccaaggctacggacccgtccgtaggtccacggtacccaaggccttcgcccccgtcgg

SEQ ID NO: 119380 - DNA, 702 bp, Homo sapiens
  misc_feature: GYAE6OF02HIB68.5.86.H09.1.454.CMB.1.raw
  modified_base (342)..(342): a, c, t, g, unknown or other
  misc_feature (342)..(342): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcgaggcacagggtcctgggcccagtctcgccctgactcacgccctcccgtccgcgtccgggtctcctggacagtcagtcaccatcctcctgccacgtcgggaccagctacgtcgactagttggttacgttaataactattcgtcctccgtacggtaaccaacaacactaccgacggaacaaccgaccccaaactcgtagtactttacngtagtacaagtacgccgtaccgtcgacggggtcctggactccgtcttctcgtcggtcctacaagtcgtcggaccaaccgtaccggtccctccgtacggtcctccgtccggtcgggccctacgacggtacgtcggaggacgtcggaacggtcgttacggtacctttacttacgtgtaccgtcgtacttacttacgtttcgaccggacggtaccgtacggttaccggttacgttaccgtttaccggttccggggaccgggtacggaaccggtaacgtccggtaaccggtaacccggttaccggtaccggtcggtaaccgtacccggtaacccggtccggttaccccggccccggttacccgg

SEQ ID NO: 119381 - DNA, 718 bp, Homo sapiens
  misc_feature: GYAE6OF02HDFMD.5.86.H09.1.454.CMB.1.raw
tcagatcagacacgcacgaccggtgctcgatttagtgctatagacgttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccggtctcctggacagtcagtcaccatctcctgcacgtggaccagctagtgactagttggtacgttataactatgtctctaggtaaccaacgaacactacaggtaccaaacgcccccaaagtcgtagtactttctaggacggtcgagtaacgccggtcctcggtacggggtcctgacgtcgtcttcgtcgtacggtcctacgtaacgtcgtacggacctaaccggaccggtccctcccgtagtacccgtctcggtcggcctaccgagtcgtaggacggtatcgggaacgtcttaacgtaacctttaacgttccgacgtaccgtacgttaccgttacgttaacggtttcggaacccggttacgggaaccgttaaccggtacccggtttaacgtaccggttacccgggttaccggggacggggtaaacccggaaccggtaggttcccgtaaccgggttacccggtacccgttaacggtaccccgacggtaaccccgtaaccggggtcccttacccccggtcccccgttaaccgg

SEQ ID NO: 119382 - DNA, 681 bp, Homo sapiens
  misc_feature: GYAE6OF02GY3BV.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctctgcacgtgggaccagcagtgactattggtcgttataactatgtctcctcggtaaccaacaacatccaggacaacgaccccaaactcgtgtattctgagtcagtaagccgcctcgaggggtccctgactcgtcttctctcggctacgtaagtctcggacaaccgaccggtccctacccgtcgacccgttcctacgtcgggtcctaccgagtaccgtaggtacggtagtacggacggtcttacggtaactttacgtttactcgacctagtccttacgttactttcggacgttacggaccgtacgtacccgttaacttacgtcccggttacgggaccggggtaacggtaacccggtaacggtacccgtttacgggtaacccccggtttaccggtaaccgggtttacccggaaccggttaccccggtaacgggtccccgttaccccggtaccccccgtttacccggg

SEQ ID NO: 119383 - DNA, 688 bp, Homo sapiens
  misc_feature: GYAE6OF02I4Z3K.5.86.H09.1.454.CMB.1.raw
  modified_base (345)..(345): a, c, t, g, unknown or other
  misc_feature (345)..(345): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctcgccctgactcagccctccctcgccgtccgggtctccgtggacagtcagtcaccatctcctgcacgtcgggaccagcagtcgactagttggtacgttaataactagtcgtctaccgtcggtaaccaactaacactaccgaggtaccaaaaccgaccccctaaaacttcgtacgtacttttccgnggtaacggtacaacgttaacggccggtaccccgttacggaccgggggttccctaggtaccgttccggtaccttccgtaccgtcggtaccttaccgtaacgttcgtacggacctaaccggtccggtccctacccgtcgtacccgttcgtacggtcggtaccctaccgtagtaccgtcggacgagtacggtacggtactacgtaacttagttacgtcgacctagtccttattacgttcgacgtacgtccgtacgtaccgtacgtcgtacggtacggacggtaacggacgtacgccgtacgtccgtacgacgtcgacgtaccggacgtccgtcccgtcccgtacgg

SEQ ID NO: 119384 - DNA, 703 bp, Homo sapiens
  misc_feature: GYAE6OF02HWAXI.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtctcgccctgactcagcctccctccgcgtccgggtctcctggacagtcagtcaccatctcctgccacgtcgggaccacgcagtcgactagttggtacgttataacttatcgtctccgtagtaaccaacaactactaccgaaggtaccaaaaccgtacccccctaaaacgtcggttacgtacttttcgtaggtacgtcgaaggtaaccgccggtacccttcgggacggggtccctagtacgtccgtcttcctcgtcgcctaccgtagtcgtcgacctaacgaccggtccctccgtacgtacccgttcgtaccgtcggcctaccgtaacgtacgtaggagtacgtcggtacggtacttacggtaccttacgtttactacgtccgtaaacgtccttagttacgtttcggaccgttaacggccgtacgtaccgttaacgtccgttccgttaccggggaccgtaacggtaccgtaacggtccgtacggtaccccgttacgtacggactaccggtaccctaacggtccgttacccggtccccgttaccgg

SEQ ID NO: 119385 - DNA, 800 bp, Homo sapiens
  misc_feature: GYAE6OF02I0VOP.5.86.H09.1.454.CMB.1.raw
  modified_base (218)..(218): a, c, t, g, unknown or other
  misc_feature (218)..(218): n is a, c, g, or t
tcagatcagacacgcacgaccggtgctcgatttagtgctatagacttgggtttgggggctggggtctcaggaggcagcgctctcaggacgtcaccaccatggcctgggctctgctcctctcaccctcctcactcgaggcacagggtcctgggcccagtctgccctgactcgacgccctcccgtccgcgtccgggtctccgtgacagtcagtccaaccncttcctcgtcgcctacggtacggaccagccaggtagtaaccgtagtttgggttaccgtttaaacttaaacgttagttccgttctcccgttacggtaaacccaaacaactactaccgacggaacctaaaacccggaaccccctaaacgttcgtagtttactttcgtacggtacggtacgtaaggtacggccccgtcccgtacggtaacggggttccctagtcgtaccgttcttacgtcgtaccgtctaccgtaacgtcgtaccgacgaaacccgtccggtacccttcccgtaacgtcccggttcgtaccggtcgggtacccctaccggtaaacgccgttaagggtaacggtacgtaccggggtaaggtaccggttaacggtaacgttttaaccgttaaccggtcgtacgtaaccgttcgttaaccttacggtttagaccggtaacggtaccgtacgtaccgttaacgtccgtttcgggtacggaccgggtaccgaaccggtcggtaccgtttaccggtccggttaaccgtaccggtactaccccgggaaccggttaacgtccccggtccgtacccccgttcgg

SEQ ID NO: 119386 - DNA, 649 bp, Homo sapiens
  misc_feature: GYAE6OF02JAECA.5.86.H09.1.454.CMB.1.raw
  modified_base (240)..(240): a, c, t, g, unknown or other
  misc_feature (240)..(240): n is a, c, g, or t
  modified_base (394)..(394): a, c, t, g, unknown or other
  misc_feature (394)..(394): n is a, c, g, or t
  modified_base (629)..(629): a, c, t, g, unknown or other
  misc_feature (629)..(629): n is a, c, g, or t
  modified_base (631)..(647): a, c, t, g, unknown or other
  misc_feature (631)..(647): n is a, c, g, or t
  modified_base (649)..(649): a, c, t, g, unknown or other
  misc_feature (649)..(649): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacaggtcctggcccagtctgccctgactcagcctccctccgcgtccggtctcctggacagtcagtcaccatctcctgcactgggaacccagcagtcgacngttggtcgttaataacgtatgtcctccttaggtaccaactaaccataccgacggacaaaacgtacccccaaaactccgtagtactttcgtgaggtacaggtaacgccggccctacgacggggtccctgactcgtcttctcgtagctaccagtcnggacctaacgacggtccctccgtgtacccgtctcgtccggactcccgtacgacgtacggaacggtagtacgacggtaccgttcggtaactttaaccgtttaccgtacggtacccgtaaacggttcccgtttacccgggttaaaacgtttttttcccgggaccccggtttaaaccggggaacccccgtttaaaaacccggggggtttaaaccccccccggggttttaaaaaccggncnnnnnnnnnnnnnnnnncn

SEQ ID NO: 119387 - DNA, 728 bp, Homo sapiens
  misc_feature: GYAE6OF02JE0TW.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcactcgggaaccacgctagtgactagtttggtaccgttaataacttatcgtctccgtggtaacccaaacaacactccgaaggacaaaccgcccccaaactcgtgtacttctgagtcaaggtacgccggccctacgacggggtcctgacgtccgtacttcttcgtcggtcctaacccgtaaggttcctacggaccgtaacctacccgggtccccttacccggttcgtaacccgttcgttacccggtccgggtccttacccggaagtaccgtaggacggtaagttcgaggtccgtagtaacctttacgtttaacgcgtaccgaccgtccttacgttacgtttcgaccgtaaggtcctaaccgggttacccgttaacttaaccgttccggttaccgggggcggtaaaccgggtacccgaaacgggttcccttaaccgggtaccgtacccggttaacggtccgaacccggtacccgaacgggttccctaccccggttcccccgtaacccgg

SEQ ID NO: 119388 - DNA, 725 bp, Homo sapiens
  misc_feature: GYAE6OF02H7FT4.5.86.H09.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcgagggcacgacgggtcctcgggccctggtcctcggccctggactcgacgccctcccgcgcgtccgggtctcgtgacngtcagtcaccactctaccngctacgtacggaccagtacaggtnacgtagtttcggtacgttataacttctcgtctcgtacggtaaccaactacatccgaggacaaccggaccccaacgtcggtactactttacgcggtaagtaccgtaaggtacggccggtcctacgggtaccgggggtcctcggtacgtcggtcctttcgcgtcggtccaccgttaagttcgcgaaccaacggtccgtccccgtaccgtcgtacccgttcgtccgtccggtacctccgtacgacgttacggacgggtactacgggtacggtcgttaacgtaccgttactacgtcgtacgtaccgtcgttacgttacggttcacggtacgtcgtaccgtccgttaacgtaccgttccggttaccgggaccgggtaacgggtaccgtaacgggtcccgtaacgggtacccggttaccggtacggttccgaaccggtaccgtaaccgggtcccgtacccggtcccgttacccggg

SEQ ID NO: 119389 - DNA, 712 bp, Homo sapiens
  misc_feature: GYAE6OF02GZ4FW.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacgagggtcctgggcccagtctcgaccctgactcacgccctccctccgcgtccgggtctccgtggactagtcacgtccacctatcctcctgcctacgtcgggaccagcagtcgactagttcggtacgttactaactatcgtctccgtacgtaaccaacactatccgaggacaaccgacccctaaagtcgtatactttcgtaggacgtcacggtaacgccggtccctcggaccggggtccctgtacctccgtcttctccgtacggtacctacgtacgttccggacggtaaccctaaccggacccgtccctcccgtacggtacccgttccgtccggtcggcccttacgacgggtaactgggaacggtacggttcggacggtcttaacgtaccttaacgttcaggtaccacgttcctacgttacgttcgacgtaccggtaccgtccgtaaccgtttaccgttacgttccgggttccgggacggttaccggaaccggtcgtacccggacggttacccgtaccggttaccgttacgacccggtacccgaccggtacccctccggttaccccgtcccgg

SEQ ID NO: 119390 - DNA, 700 bp, Homo sapiens
  misc_feature: GYAE6OF02HHSX4.5.86.H09.1.454.CMB.1.raw
  modified_base (308)..(308): a, c, t, g, unknown or other
  misc_feature (308)..(308): n is a, c, g, or t
  modified_base (387)..(387): a, c, t, g, unknown or other
  misc_feature (387)..(387): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctcctcactcacgggcacacgggtcctcgggcccagtcctgccctgactcacgccctccctccgccgtccgggtcctccgtcggacacgtcagtccacctatcctcctgcctacgtcggggaccagccaggtcgacagtttggtacgttaataactatcgtctcctacggtaaccaacaacnctaccgaagacaaaccgacccctaaatcgtatacttcgtacgtacgtacacggtacgccggtccgtacgacggggtccngtacgtccgtctttaccgcgttcggacctacgtaacgttcgtacggacctaaaccgacccggtcccttacccgtacgtacccgtccttcggtccgggtcccgtaccgtaacggtacgtcgggtaacggtacgtcggtacggtacgttacggtaacctttacgtaccgtcgtaccgtacgtcctttaacgtcgttaccggacgcgacgtaccgtaaccgtactaccgtcgttaccgggaccggtacggacctaggaccgttcgtacccgtacgtacgacgtaccgacggtacgtccgtacccgcccgttaccgg

SEQ ID NO: 119391 - DNA, 726 bp, Homo sapiens
  misc_feature: GYAE6OF02I2TD0.5.86.H09.1.454.CMB.1.raw
tcagatcagacacgcacgaccggtgctcgatttagtgctatagacttggggtttggggggtgctcgatttagtgctatagacttgggtttgggatctacgttgcaggtgtaggtctgggtccctgagactctcctgtgcagcctctggattcaccttttactgtattttggcatgacgtgggtccgcaggctccgagggaaggggctggactggctctacaaatattaatggtaaaggcaatatacaagactacacagactccgtgaagggccggttcaccacctcgagagaccaactccgagggacacggtgtaacctacacagtagaacacgcctgagacgccggaggacgacggaccgtatattattgtggtaggaacggggtaacggtgggggactaagtttcggaccggtcggtacggggaccgtacggggtaacccgtgggtaccgtacccgtcccgtcccgtacgaccgtcccctacccgaacccgtaaccggggcccctaacgttcccggttcccgtttccccccgtcgggtccccgtaccccgtcggcccgtacccgacggaccgccctaacccgtcccgaacggtaccgaccgaccgaccgggcccgggtacccggtcgggtccgtccggtcccgttacggggtacgtaaccgggtacccgttacccggtttccccggtcggtttccggttacggtacgtttccggaggtaccggg

SEQ ID NO: 119392 - DNA, 843 bp, Homo sapiens
  misc_feature: GYAE6OF02IJCCD.5.86.H09.1.454.CMB.1.raw
  modified_base (214)..(214): a, c, t, g, unknown or other
  misc_feature (214)..(214): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacgagggtcctgggcccagtctgccctgctcacgcctccctccgcggtccggtctccgtggacagtcagtcaacntctcctgcacgtcggaccagcaggtcatgttggtacgttataacttatcgttcctccgtacggtaaccaaacaacactaccgaacggaccaaaaccgaccccccgtaaaacgttccggtacgttaacttttcgtacggtacggttacgaacggttaaaccggcccggtacccgttacggtaaccgggggttcccttaggtaaccgttcccggttcctttaccgtttcgtcggtaccgttacccgtaaacggtttccgtacgggtaccctaaacccggtacccgggtacccccttccccgttacgtaccccggtttacgttacccggtcggggccccttaaccggtaacggtaccgttacgggaacggtacgtcgggtaaccgtagttacgtaaccgtttaacgttacgtcggaccctacgttcttaccgtttaacgttccgtacggaacgtaccgtaccgttacccgttaacgtttaacccgttcgggttaaccggggaccggggtaaaccggtaccggtaaaccgggttcccgtaaccggggttaaccccggtttaccggttaacgggacccgtaaccggttaccccgggaacggttaccccgttcccccggtacccccggttacggg

SEQ ID NO: 119393 - DNA, 690 bp, Homo sapiens
  misc_feature: GYAE6OF02I3ZCS.5.86.H09.1.454.CMB.1.raw
  modified_base (506)..(506): a, c, t, g, unknown or other
  misc_feature (506)..(506): n is a, c, g, or t
tcagatcagacacgcacgaccggtgctcgatttagtgctatagacttgggtttggggggctggggtctcaggaggcagcgctctcaggacgtcaccaccatggcctgggctctgctcctcctcaccctctcactcagggcacagggtcctgggcccagtctgccctgactcacgcctccctccgcgtccgggtctccgtggacagtcagtccaccatcctctgcacgtcgggaccagcaggtcgactagtttcggtacgttaataactattgtcctccgtacggtaaccaaacaaccactaccgacggaccaaaccgacccccaaacttcggtacgtattcgtaggtacggtacaaggtaacgcccggtcctcggacgggtcctgactcgtcttctcgtcgtacctacgtaacgttcgtacgggaccaaaccggtcccggtccccgtacccgtacggacccgtttcgtccggtcgggtaccctaccggagtaccggtggaacggtntacggaggtcgtagtaacttacgttacgtcgactacgtcttacgttacgtttcggacgacggtccgtacgttaccgtaacttaccgttggtaccgggacgggtaccggtaaccgaaggtccgtaccggtaaccgttcggtacggtacgacgtacccggtacggtcccgtcccggtacccgtcgg

SEQ ID NO: 119394 - DNA, 610 bp, Homo sapiens
  misc_feature: GYAE6OF02F771I.5.86.H09.1.454.CMB.1.raw
  modified_base (454)..(454): a, c, t, g, unknown or other
  misc_feature (454)..(454): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaaacgcccccaaactcgtgtatttctggaggttcaagttaacgcggccctcgacggggtccctgactcgcttcgtctggctccaagttctggcaaacgaccggccctcccgtgacccgtctcgtgggcctccgagtactggaggatcggaggtcttagacttattacgngactgacttcgtaatttcgccgtacggcacggtaccttacgttaccgttcgttaccgggcgggtaacgggtacccaacggccgttacggtacccgttccgttaagggtccgaaccggtaccccggaacggtcccgtacccggtcccccgttaccgg

SEQ ID NO: 119395 - DNA, 716 bp, Homo sapiens
  misc_feature: GYAE6OF02FXDAD.5.86.H09.1.454.CMB.1.raw
  modified_base (205)..(205): a, c, t, g, unknown or other
  misc_feature (205)..(205): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtcctgccctgactcacgcctccctccgcgtccggtctccgtggacngtcagtccaccatcctcctgccacgtcgggaccagcagtcgactagttggtactttaataactattcgtccttccgtacggttaaccaaactaacactccgaacgggtaaccaaacccggaccccccaaaacgttccggtagtacgtttccgtagggtacggtacgaaggttaaaccggccggtacccctacgggaccggggttccctaggactcgtcttcgtcgtcgtcctcgtagtcgtcggacaaccgccggtccctacccgtcgtaccgttcgtccggtcggcctccgtacgtacgtaggacggtagtacggacggtccgttaggtacttacgttaacgtcgacgtacgtccgtacgttacgtttcgacgtacggaccgtacgtaaccgttacgtaccgttcggttaccgggacggtacggtaaccgtacggtcggtaccggtaccccgttacggtaacggtcccgacggaccccgaacggtcccggtacccgtacccccgttccgg

SEQ ID NO: 119396 - DNA, 558 bp, Homo sapiens
  misc_feature: GYAE6OF02ILPA8.5.86.H09.1.454.CMB.1.raw
  modified_base (420)..(420): a, c, t, g, unknown or other
  misc_feature (420)..(420): n is a, c, g, or t
  modified_base (448)..(448): a, c, t, g, unknown or other
  misc_feature (448)..(448): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccggtctccgtggacagtcagtcaccatctcctgcacgtgggaccagcagtgactagttggtcttaataactatgtctccgtgtaaccaacaacatcaaggacaaacgcccccaaactcgtagtacttctgagtcagtaagccgcctgacggtcctgatcgtctctcgtcgctacagtctagaccaacgacggtcctcccgtcgaccgtctcgtcggtcctcgagactggagngtagaggctgtactattactgcagtctntattgactagcagtctataccgtcgttcggacggaacggaccaaggtccgtaggtacccgttacgtacgtacgaccgtacccgaacggtcccgtaccgtccccgttacgg

SEQ ID NO: 119397 - DNA, 719 bp, Homo sapiens
  misc_feature: GYAE6OF02GEQM6.5.86.H09.1.454.CMB.1.raw
  modified_base (514)..(514): a, c, t, g, unknown or other
  misc_feature (514)..(514): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctccttgtgcagcctctggattcacctttactgattttggcatgacgtgggtccgccaggctccgagggaaggggctggactggctctacaaatattaataggtaaagcaatatacaagactaacacagactccgaggaaggccggtcaccaccacgagagacaactccgagggacacggtctacctacacagtagaacagcctgagacgacgaaggacgacggaccgtattattattggtgtaggaaggggtaaacgtggggactaagttcgaccgcggtgggaccgaacgggaacccgtgggtaccctaccgtcctaccgtcgaccgtccctaaccgtaaccgaaccgggtcccaacggtttccggtaccccgtttacccccgnggtaccccgtccccgtacgtacccgttcccgaacgggtaccgacccgtacccgtcccggaagaccgtacgaaccggaccgggacccgggtacccggtacgggccgttacgggaaccggttacgggttaacccgaacgggttaaccctttacccggtttaccccggtgtttaacccggtggttaaccgttcggtacggtaccgggg

SEQ ID NO: 119398 - DNA, 644 bp, Homo sapiens
  misc_feature: GYAE6OF02I9ZFA.5.86.H09.1.454.CMB.1.raw
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (258)..(258): a, c, t, g, unknown or other
  misc_feature (258)..(258): n is a, c, g, or t
  modified_base (318)..(318): a, c, t, g, unknown or other
  misc_feature (318)..(318): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcaggcacaggtcctgggcccagtctcgccctgactcacgcctccctcgccgtccgggtctccgtggacagtcagtcacntctctgctactggaccanctagnacagttggtcgttaatactatntactcgtcgtacctaacaacactcgagactaaaccgaccccaaactcgtagtactttcgngtacgtcagtaacgcgtcctacggtcggtacctagtacgtccgtccttcgtcgtcggtacctcgtaaacgtcgtacgacctaccgaccgtcctaccgtcgtaccttcgtacgtcgggacctcgacgttacacggagtacgtcgagtcgtacgtacttacgttacgtgactacgtctacgtaacgtttcgaacgtaggcctaagtcccgtttaacgccgttaggttaccgggaccggaacggtaccctacggtacctacggtaacccgtaccgttaccggtacgaccgttacccgtacgggtaccccttccggtccccggttaccgg

SEQ ID NO: 119399 - DNA, 737 bp, Homo sapiens
  misc_feature: GYAE6OF02GA6HL.5.86.H09.1.454.CMB.1.raw
  modified_base (555)..(555): a, c, t, g, unknown or other
  misc_feature (555)..(555): n is a, c, g, or t
  modified_base (736)..(736): a, c, t, g, unknown or other
  misc_feature (736)..(736): n is a, c, g, or t
tcagatcagacacgcacgaccggtgctcgatttagtgctatagacttgagtctgggggaggcttggtacagcctggggggtccctggagactctcctgtgcagcctctggattcacctttactgattttggcatgacgtgggtccgccaggctccagggagggctggactggctctcaaatattaagtggaaaaggcaatatacaagactacacagactccgtagaagggccgttacaccacctcgagacgacaactccagggacacggtgtacctacacatagaacacgcctagagagccgagacacggcgtactagttatgtgtaggaggggaaacgtcgggggactaagtttcggaacccggtcggtcggggacccgacgggggaacccgttcgggtcccgtaaccggttccttccctacgacgtcccttcccgaacccgaacggggcccctagtcccgggtaccctttcccccggtcggtcccgtaccccgttcgcccgttcccgacgggtaccgacccgtacccgtaccggaacggaccgaccgtaaccncggtaccccgggtcccgttcgggggccttaccgggtcccgtacggggttacccgtaaaccgggtacccgtttaaccccgtttcccggttacgttaccgttacgtacgtttcgtacgggacggggtacccgggtcggttaccgggacgtaaccgggccgtaacgtaacgtaggcttacgcgng

SEQ ID NO: 119400 - DNA, 738 bp, Homo sapiens
  misc_feature: GYAE6OF02H43YW.5.86.H09.1.454.CMB.1.raw
  modified_base (209)..(209): a, c, t, g, unknown or other
  misc_feature (209)..(209): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacgagggtcctgggccctagtcctcgcccttgactcacgccctcccgtccgcgtccggtctccgtggacngtcacgtccactatctcctgccacgtcgggaccagcagtcgactagtttggtacttaataactatcgtcctccgtagtaaccaacaacgtctccgacgacctaaacgacccccctaaagtccgtagtacttttcgacggtagtacgaaggtaacgccggtacccgtcggtacggggtcctgacgtccgtacttcgtacgtcggctaccgtaagtcgtacggaccaacgccgtccctccgtacgtaccgttgtccggtacgtccctaccgaggtaacgttcgggaaaggtctagggtaacggtacgttcggttaacctttacgtacgtacggctaaccggttctacgtttaacggtttcgaaccggttacggacgtacccgttacgttaaacgtttaccggttcgggtaccgggtacggggtaaccgtaccggtaacggtacccggtacggtaaacccgtttcggtaaccgggtacctaaccggggtacctaacccgggttcccggtacccggttccccgttaaaccggg

SEQ ID NO: 119401 - DNA, 763 bp, Homo sapiens
  misc_feature: GYAE6OF02F004G.5.86.H09.1.454.CMB.1.raw
  modified_base (208)..(208): a, c, t, g, unknown or other
  misc_feature (208)..(208): n is a, c, g, or t
tcagatcagacacgcacgaccggtgctcgatttagtgctatagacttggggtttggggggctgggggtctcaggaggcagcgctctcaggacgtcaccaccatggcctgggctctgctcctcctcaccctcctcactcagggcacagggtcctgggcccagtctcgccctgactcacgcctccctccgcgtccgggtctccgtggacngtcagtcaccatcctcctgcacgtcgggaccagcaggtgactagttggtcgtttaataactatggttcctccgtacggtaccaaacaactactccgaggaccaaaccgaccccctaaactccgtagtactttcgtacggtaggtacgtaacggttaacggcccggtacccgtacggacggggttccctaggtactcgtcttcgtcgtcggtcctacgaacgtcctacggacctaaccgtacccgggtccctcccgtacggtacccgttcgtccgtcggggtccctacccggtagtaacgttgggaggtacgtacgggacggtccggttagtaacccgtttagtaccgtcgtacgtacgttacttacggttacgtttacggaccggtagggcccgttaacgggtaccgttaacgttccggttaccgttccggggaccgggtaaccgggtaccgaacggttacccggtaaccgggtaccccggttaccggttaaccgggtaccgtaaccgggtaaccccgacgggtcccgttaccccggtacccccggttaaccggg

SEQ ID NO: 119402 - DNA, 629 bp, Homo sapiens
  misc_feature: GYAE6OF02I1C3M.5.86.H09.1.454.CMB.1.raw
  modified_base (282)..(282): a, c, t, g, unknown or other
  misc_feature (282)..(282): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcacgcctccctccgcgtccgggtctcctggacagtcagtcacatctcctgccactgggaccagcgagtgaccattggtacgttataactatgtctcctggtaccaacaacanctaggacaaacgacccccaaactcgtgtatttcgtgtaggtcaggtaagccggccctcgacggggtccctgactcgcttctctacggctaccagtctggacaacgtacggcccttccgcgtacctcgtctcgggcctcctagactgaggtacnggacgtntcgtactttactacgtcgacacggttcctcgttaacgtttcgcgtacggaccgtacggtccgtttaactaccgtttcgtaccggggacgggtaacgggtaacccgtaacggtcctacgggtaccccgttcggtaaccggtaccgaccggtcccgaacggcccgtttaccccggccccgttacccggg

SEQ ID NO: 119403 - DNA, 775 bp, Homo sapiens
  misc_feature: GYAE6OF02HFALB.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtccaccatctcctgcacgtcgggaccagcagtcgactagtttggtacgttaataacgtatgtccttcgtcggtaaccaaacaacactaccgaggaccaaaacgacccccaaactccgtagtacttttcgtaggacggtacgaaggttaacggcccggtacccgtcggacgggggttccctggactcgtcttcctacgtcggccttacgaacgttccgtacgggaccaaaccgtaccggtccccttacccgtaggtaaccccgttccgttaccggtcgggtccctaacccgtaggtaacgttagggaacgggtacgtagggtacggtaccgttaggtaacctttaacgtttaaccgtcgtaccgtaacgttccttacgttaacgttttccggacgtaacggggtacctaaccgggttacccgttaacttacccggtttacccgggttaccggggtaccgggtaacgggaaccccgtaacggtaccgtaccgggtaacccggttaccggtaaccggtaccgaacccggtaccggaccggtaccggtaccccggtcccccgttaccggg

SEQ ID NO: 119404 - DNA, 833 bp, Homo sapiens
  misc_feature: GYAE6OF02GV1T7.5.86.H09.1.454.CMB.1.raw
  modified_base (224)..(224): a, c, t, g, unknown or other
  misc_feature (224)..(224): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcacccttcctcactcgagggcacgacgggtcctgggcccagtctcgccctgacctcacgtcctccctccggtcggtccggtctaccgtggacagttcagtccncctatcctcctgcacgtggaccaggcagtgactagttcggtacttatacttatcgtctaccgtgtaacctaacgaacactcgaacggtaccaaacccgacccctaaacgtcgttaagtacgttttcgacggtacggtacctaaggtaaccggcccgtaccgttccggtaccggggttccctaggaaccttccggttcttacgtccgtaccggtacgttacccgtaacggttccgtacggtaacccgtaaccggtccccggtcccttacccgtaccggttaacccgttccgttccgggtacccggtttaccccgaccggttaacggacccggttaggtaacggtaaccggtagggtcccggttaactaacggtttaaaccgtttaacggttcccgtacgtacggtaccgttccgttaacgtttacgtttccgggacccgttaagggtacccacgggttttaacccgttaacgtacccgggtttaccgggttacccgggaccgggtaccgtaacggtacgtacccggttacccgggtaccgttacccgggtacgtaacccgaccggtaacccggtacccggtttccgtaaccccggttcccgttaacccgg

SEQ ID NO: 119405 - DNA, 766 bp, Homo sapiens
  misc_feature: GYAE6OF02GZ175.5.86.H09.1.454.CMB.1.raw
  modified_base (250)..(250): a, c, t, g, unknown or other
  misc_feature (250)..(250): n is a, c, g, or t
  modified_base (760)..(760): a, c, t, g, unknown or other
  misc_feature (760)..(760): n is a, c, g, or t
  modified_base (762)..(762): a, c, t, g, unknown or other
  misc_feature (762)..(762): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccgagggaagggctggactggctctacaaatattaatggaaaaggcaatatacaagactacacagactccgtgacgggccggttcaccacctcggganaccaactccgagggaccacggtgtacctacgacactagaacacgcctgagacgccgaggaccacgggaccgtatattattggtagttaggagggggtaaacgtgggggctaagttttggacccggtcgtacgggggccgaaggggaaccccgttgggtaccgaacccggtccttcccgtcgtaaccgcccttacccgaacccgtaaaccggggaccccctaagttccccgggttacccttttcccccccgggtgggtaccccggcccccgttacggcccttacccgggtaacggtaccgttacccgaccccggttcccggacgtaaccgtccgaaccgacgggcccggtaccccggttcggggacccgtttcgggcccgttacgggtacccgtaaacgggttacccgttacccggtttaccccggtacggttaccttacggtaccttccgttcgggaacgggtcccgggtaccgttccgggacgtaacgggtcgtaccgagtccggtacncngcgc

SEQ ID NO: 119406 - DNA, 632 bp, Homo sapiens
  misc_feature: GYAE6OF02IPQX9.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactgggaccagcagtgactattggtcgttataactatgtctcctggtaccaacacatccaggacaaacgcccccaaatcgtgtattctgagtcagtagccggcctgacggggtccctgactcgtcttctcgtggcctcaagtcgtgacaacgtaccggtccctcccgtcgacccgtctccgtcgggcctccgacgtacgtgaggagtggagtcgtacgtaacgttacttacgtacgccagtcgtaccttatttcgacgtaggtacgacgtacccgttacgttaaccgttccgttaccgggaccgggtaacgggtaacccgtaagggtaccgtaccgggtacccggttacccggtaacggtaccgaccggtacccggtaaccgggtccgtccccggtacccccgttacccggg

SEQ ID NO: 119407 - DNA, 759 bp, Homo sapiens
  misc_feature: GYAE6OF02HA5L7.5.86.H09.1.454.CMB.1.raw
  modified_base (266)..(266): a, c, t, g, unknown or other
  misc_feature (266)..(266): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctcgccctgactcagcctcccgtccgcgtccgggtctccgtggacagtcagtccaccatctccgtgcacgtgggaccagcagtgactagttcggtacgttaataactnttcgtctccgtacgtaaccaactaactactaccgaacggaaccaaaccgaccccctaaagttccggttacgtacttttcgtacggtacggtacctaaacggtaaccggcccggtaccccttacgggtaccggggttccctagtacgttccgtcttaccgtcgtcggtaccttacgtaacgtcgtacggaccaacccggtccggtccctacccgtcgtacccgtcgtccggtccggtaccttaccgacgttacggagggacggtacgtgggacgtacgttcgtaccttacgtacgtcgcctacgtccgtacggttacttacggccgtaacgggtccgtaaaccggttccgttaaacggttccgggttaccgttaccgggggaacggtaccgggaacctacgggttaccccggttaccgtaacccggttcccgtaacgggtcccgtacccggaccccggtaccggttccccgtaccccggtacccggttacccgg

SEQ ID NO: 119408 - DNA, 817 bp, Homo sapiens
  misc_feature: GYAE6OF02J154R.5.86.H09.1.454.CMB.1.raw
  modified_base (368)..(368): a, c, t, g, unknown or other
  misc_feature (368)..(368): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggacttcaccttttactgtattttggacatggacgtgggtccgccaggcctccgaggggaaggggctggactggctctacaaatataagtcggtaaagcaattataacaacgactacacaagactccgtaggaacggtccggttccaacctaccgtgagacgaacctaaccgtccgaaagggtaccacggtacgtaccctaaccgacagtacgaacacggtccngaacgcggaaccggaaggacgtacgggtaccgtaattaatttacgttggtaggtacgggtaaacggggtaaacggagggggtactaacggtttcggtaaccgggtccgggtacggggaaccccgggtaaacggggtaccccgttaggggtacccgtacccggtccgttaccccgttacccgacgggttacccctacccggaacccgtaacccgggtcccgtaccggttacccgttaccccggttaccccgtccgggtccccgtccctccggtcccgtaccgtaccggaccgtacccgtacccgtaccggtaaccgaccgacggacccgtaccgggtcccggccggttccgggcgttcccgggtaacccggttcgggttaaccggtaccgttaacccgtacccgggtttccgttaccggtcgttacggtacgtccggttacgggaccggg

SEQ ID NO: 119409 - DNA, 553 bp, Homo sapiens
  misc_feature: GYAE6OF02HYID0.5.86.H09.1.454.CMB.1.raw
  modified_base (205)..(205): a, c, t, g, unknown or other
  misc_feature (205)..(205): n is a, c, g, or t
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
  modified_base (390)..(390): a, c, t, g, unknown or other
  misc_feature (390)..(390): n is a, c, g, or t
  modified_base (442)..(442): a, c, t, g, unknown or other
  misc_feature (442)..(442): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtcctgccctgactcacgcctccctccgcgtccgggtctcctggacngtcagtcacatctcctgcacgtcgggaccagcagtgactagtttggtacgttaataacttatgtctcctggtaaccaaacaacactccgaggaccaaacgccccaaatcgtntattctgtagtcagtacgcgcctcgacgggtcctgactcgcttcntcgctcgagtcgacgacacgcgcctccncgtcgtctcgtcggcctcacgtcgtagagtagtggagtctagtatacttacngacactcgtctagttcgcgacgcgtacgtcgttactcgttcgtcggacgggacggacgtacgcgtaccgtcgtaccgtgccgacgaccgacggtccgtcccgtacccgtcg

SEQ ID NO: 119410 - DNA, 673 bp, Homo sapiens
  misc_feature: GYAE6OF02I05FW.5.86.H09.1.454.CMB.1.raw
  modified_base (237)..(237): a, c, t, g, unknown or other
  misc_feature (237)..(237): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccagtctcctgcactgggaccagcagtnactagttgtcgttataaccttatcgtctcctgtaaccaacgaacataccaggaccaaaccgaccccctaatcgtgtactttactgaggtactagtaacggccgtaccctcggaccgggtcctagactcgtcttctccgtcggacctaccggaagttccgcggacaacgaccgggtacccctccgtcgtacccgttctaccgtcggtcctcgtaccgtacgttgagggtatacggtaggcttagtacttaagttctacgtactacgtcttacgttaacgtttcgacgacgggactaccggttaccgttacgttaaccgttccggttacgggaccgggaacggtacccggtaaacggccttaaccgggtacccgttacgttaccgggtacgtaccggtaccccggtaacggtcccggtacccgtccccggttacccgg

SEQ ID NO: 119411 - DNA, 776 bp, Homo sapiens
  misc_feature: GYAE6OF02HMVEI.5.86.H09.1.454.CMB.1.raw
  modified_base (257)..(257): a, c, t, g, unknown or other
  misc_feature (257)..(257): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (775)..(775): a, c, t, g, unknown or other
  misc_feature (775)..(775): n is a, c, g, or t
tcagatcagacacgcacgaccggtgctcgatttagtgctatagacttgagtctgggggaggcttggtacagcctggggggtccctgagactctcctgtgcagcctcgtggattctaccttttactgtattttggcatgacgtgggtccgccaggctccgaggggaagggctggactggctctacaaattattaaataggaaaaaggtcaaatataacaagactaacacagactcgtagaagggccggttacaccacncgagagacactccgaggacncgtctacacanagtagacncgcngagacgacggacgacgaccggtacgtaattagttacgtggtaggtacggggaaggggtaacgggtggggtacttaagtaccggtaccggcggtacggggaccgtaacgggtacccgttcgggtaccgtaccgttcctacccgtacgacccgtacccctacccgaaccggtaacccggtacccgtacccgtttccccgggttcccctttccccccgggtcgggtcccccgtcccggtcgtacccgtaccgggacggtaccgaacccccgtaccgtaccggaggaacccgtaccgaacccgtaccggggtcccgggtcccgggtacggtacccgttcgggttacccggtacgggtaacgttaaacccgggtttaccctttcccgggttacccgttggttaccacggttaccgtacgtcgggggacggtcgggtaacccggtggacccgggaacggtcaacggttacgtggctagagng

SEQ ID NO: 119412 - DNA, 646 bp, Homo sapiens
  misc_feature: GYAE6OF02JA03Q.5.86.H09.1.454.CMB.1.raw
  modified_base (464)..(464): a, c, t, g, unknown or other
  misc_feature (464)..(464): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacaggtcctgggcccagtctgccctgactcagcctccctccgcgtccggtctcctgacagtcagtcacctatctcctgcacgtcgggaccagcagtgaactgttggtcgttatacgtatcgtctcgtgtaaccaacacactcgagacaacgcccaatctgtacttctagtacgtacaggtaacgccgtcctacggacgggtcctagtatccgtcttctctcggtctacgtaagtcgtcgactaccgacggtcctaccgtcgtaccgtcgtcggtcgtaccgtaccgacgtacgtgtaggactggacgtctacgtacttacgttacncgtcacgtacgttacgtacgtttacgacgttacggaccgtacgtaccgtacgttacgtaccgggtttacgggaccgggtaaccggtaaccgaacgtcggttaacccggtccggttaacccggttacggacccgtaaccgggtacccgaacgggtttacccgaccccggttaccccgttacgg

SEQ ID NO: 119413 - DNA, 566 bp, Homo sapiens
  misc_feature: GYAE6OF02IWSGR.5.86.H09.1.454.CMB.1.raw
  modified_base (305)..(305): a, c, t, g, unknown or other
  misc_feature (305)..(305): n is a, c, g, or t
  modified_base (436)..(436): a, c, t, g, unknown or other
  misc_feature (436)..(436): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcactgggaccagcagtgacattggtcgttataactatgtctcctgtaccaacacatccaggcaaacgccccaaactcgtgatttcngaggtcagtaagccggtccctcgacggggtccctgactcgcttctctcggctccaagtctgcaacgaccgcctccctgaccgtctcgtcggctccgagacctggagatggacgtctagtacttagttacgngaccagtctactagtttcgacgtacggctacgtaccgttataccgttccgttacgggacggacggtaccgaagtccgtacggtacccgtcgtacggcgacggtacccgaacggcctcccgccccgtccgg

SEQ ID NO: 119414 - DNA, 734 bp, Homo sapiens
  misc_feature: GYAE6OF02GRHAS.5.86.H09.1.454.CMB.1.raw
  modified_base (479)..(479): a, c, t, g, unknown or other
  misc_feature (479)..(479): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgtattttggcatgacgtgggtccgccaggctccgaggggaagggctggacgtggctctacaaattattaagtagggtaaaggctaatataacgaagactacacagactccgtagaacgggtccgtcaccacctacgagacgaacacgtaccgaggaccacggtctaccacacatacgaacacgcctgaacgacgaccggaggaccgacggtaccgtaatacgttagttggtaggtagggaaggggaaacgtggggactaagttcggaccgtcggtcggggaccgacggggtaccctgggaccgtaccgtcctccgtaccnccgtaccctacccgaaccgaaccgggccccgtaccgttcccgggttacccctttccccgtcggtaccccgtcccgtaccgtcccgtacccggaccgggtaccgcccgtacccgtaccggaacggtaccgaacccgacgcccgggtacccgaccgggttccggacggttccgtcccgggttacggtaccggaaccggttaccgtttacccggttacccggttaggttccctaggtacgttccggtaggtacccggg

SEQ ID NO: 119415 - DNA, 608 bp, Homo sapiens
  misc_feature: GYAE6OF02JASFF.5.86.H09.1.454.CMB.1.raw
  modified_base (203)..(203): a, c, t, g, unknown or other
  misc_feature (203)..(203): n is a, c, g, or t
  modified_base (353)..(353): a, c, t, g, unknown or other
  misc_feature (353)..(353): n is a, c, g, or t
  modified_base (452)..(452): a, c, t, g, unknown or other
  misc_feature (452)..(452): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctctgcactcgggaccagcaggtgactatttggtacgttataactatcgtctcctggtaccaacaacatccaggacaaacgcccccaaactcgtagtactttcgtagtaggtcagtaagcggccctcgacggggtccngactcgtcttctcgtgctacgaagtctcgacaacaccgcctccgcgtaccgtctcgtcggctaccgagactggagtatggacgctagtacttattacgngcagtctactacgtttcgacgacggacaacggtccgttaactaccgttcgtaccgggacgggtaacgggaccgtaagtaccggtacggtacccggttaccgtaacggttaccgaccggtaccccgtaacggtcccttcccggacccccgttcccgg

SEQ ID NO: 119416 - DNA, 737 bp, Homo sapiens
  misc_feature: GYAE6OF02IF23Q.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgtattttggcatgacgtgggtccgcaggctccgagggaaggggctggactggctcgtacaaattattaatgggtaaaggctaatatacaagactacacagactccgtagagggtccgttcaccactcgagagacaactcgagggacacggtactacctacacatagaacagcctgagacggccggagtaccgaccggtaccgtatattacttggtggtaggaaggggaacgtagggggtactaaacggtttcggaaccgtcggtacgggggacccgaacgggggtaaccccgttggggtacccgtacccggttccttacccgtacgtaccgtcccttaacccgaacccggaaccggggtcccctaacggttcccggttccccgttaccccccggtcgggccccgtccccgttcggacccttaccggacggtacggaccctacccggtacggacggacgtaccgtaccgaccgggtcccgggtcccggtacgggtccgtaccggtccggtacggtacggaaccgggtaccttaccggttccccgttcggttccttaggtacttccggtaggtaccgggg

SEQ ID NO: 119417 - DNA, 787 bp, Homo sapiens
  misc_feature: GYAE6OF02FN19N.5.86.H09.1.454.CMB.1.raw
  modified_base (184)..(184): a, c, t, g, unknown or other
  misc_feature (184)..(184): n is a, c, g, or t
  modified_base (765)..(765): a, c, t, g, unknown or other
  misc_feature (765)..(765): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcgaccttttactgattttggcatgacgtgggtccncaggctccgagggagggctggactggctcgtacaattattaagtaggtaagacaatatacaagactacacagacctcgtgaaggccgttacaccgtactcgaagacgaacacctcgacgggactacggtacgtaccaacgtacacgttacaacgacgtaccgtagtacggacggaccgacgggaccgacggtcccgtaattacgtttagtttcggtcggttaaggaacgggggtaaacggttgggggaacttaaggtttcggacccggtcggtacgggggaccgtaaccgggtaacccggttcgggtaccgtaacccggtttcccgtaccgtacgtaacccggtcccttaaccccgaacccgtaaccggggcccctacggtttacccggttccccgttacccccgtcgggtacccgtcccgttaccgccgttaacccgaggtacccgtaccgacccgtacgggtaacgacccgtacgaaccggaccggtacccgggtaccccggttgggtacccgtcgggttaaccggttaacggaccgtaacggtaaccctttaccggttcccggttacgttccggttanccgtttaccgtacgggaccggg

SEQ ID NO: 119418 - DNA, 744 bp, Homo sapiens
  misc_feature: GYAE6OF02GIX2P.5.86.H09.1.454.CMB.1.raw
  modified_base (220)..(220): a, c, t, g, unknown or other
  misc_feature (220)..(220): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacgaggtcctgggcccagtctcgccctgactcacgccctccctccgcgtccggtctcgcggacagtcagtcaccatcctctncacgtcgggaccagcagtgactagttcggtcgttaatactattcgtctacctcggtaaccaaccaactactccgacggaaccaaaacccgaccccctaaacgtcgttcgtacttttaccaggtacggttacgaacggttaacggccggtccccgtacggtaaccggggttcctaggtacgtcctcgttcctcgtcggaccttacgtaacgtcgtacggacaacccgtaccggtccccttaccccgtacggtaccccgtacgttaccgtccggggtaccttacccggaacggtacgttagggtaaccgtaggtacggacggtacgttccgtaaaccgtttaccgttaccggtacgaaccgtgtaccgttcgttaacgttcggacgacgtaccgtacggacccttagttaccgttcgggtaccggagggtaaccggtaacggaccgttaacggtcccgtaccgttccgttaccgggtacgtacccggaccggtaaggtccccttacccgggtcccccgttaccggg

SEQ ID NO: 119419 - DNA, 721 bp, Homo sapiens
  misc_feature: GYAE6OF02IT8FB.5.86.H09.1.454.CMB.1.raw
tcagatcagacacgcacgaccggtgctcgatttagtgctatagacttgggtttgggggtgctcgatttagtgctatagacttgggtttgggatctaacgttgcaggtgtaggtctgggtccctgagactctcctgtgcagcctctggattcacctttactgattttggctatgacgtgggtccgccaggtctaccgaggggaagggctggactgctctacaaattattaagtaggtaaaggctaaatataacaaacgactaacacagactccgtaggaaggtccgtacaccgacctacgagagacaactacgaagggacacggtagtaacccgtaacaacgacgtagaacgacgaccgtaggacgacgaaccgaggacgaccggtaacgtaatacgttagttcgagtaggacgggtaaacgtcggggactaacgttacggaccgccggtacgggaccggaaccgggtaacccgtacggtacacccgtacctccgtacacgtacctaccgaccgaacgtcccgtaccgtccggttacccgttcccgaccggacccgtacccgtctacccgtccgaggacctaccgtaccctaccgaccgtaacgcgtaaacgaccggccgtcccggtcggtacttaccggccggttaccgggtaacgtaaacggttacccgtacccggttacccggttcttaccggtacgtacggttaccgacggtaacggg

SEQ ID NO: 119420 - DNA, 755 bp, Homo sapiens
  misc_feature: GYAE6OF02HQN8O.5.86.H09.1.454.CMB.1.raw
tcagatcagacacgcacgaccggtgctcgatttagtgctatagacttgagtctgggggaggcttggtacagcctggggggtccctgagactctcctgtgcagcctctggattccacctttactgattttggcatgacgtgggtccgccaggctccgaggggaacggggctggacgtggctacctacaaattattaagtaggaaaagcaatatacaagactacacagactccgtaggaacgggtccgttacaccactcggaagagaacctaactccgaggggaccacggtacgtacctacgacatcggaacagtcctagacgacgaccggaggaccacggtccgtaagttatttaatggttagaggtaacggggaacgttgggggactaagtttccggaaccggtcgtacgggggacctaacggggtaacccgtgggtaccacccgttacgtcccgtacgaccgacccttaccaaccgggtaacccggtcccgtaacgtttccgggttacccctttaccccccggtaggtcccccgtaccccgttcgccgttacccggaagggccgtacccacccggttaccggaacggaccgccaaccggacggtcccggcccggttcggggcccttacggcccggttacggtaaccgtaaccgggtacctttaccccggtaccgtacgttaccgtacgtacgtacgtcggtaaccgggcgggtcgtacgggacgtacgggcccgtagtaacgtgtacgctgacg

SEQ ID NO: 119421 - DNA, 790 bp, Homo sapiens
  misc_feature: GYAE6OF02FGF1H.5.86.H09.1.454.CMB.1.raw
  modified_base (119)..(119): a, c, t, g, unknown or other
  misc_feature (119)..(119): n is a, c, g, or t
  modified_base (240)..(240): a, c, t, g, unknown or other
  misc_feature (240)..(240): n is a, c, g, or t
tcagatcagacacgcacgaccggtgctcgatttagtgctatagacgttgggtttgggggctggggtctcaggaggcagcgctctcaggacgtcaccaccatggcctgggctctgctccncctcaccctcctcactcaggcacagggtcctgggcccagtctgccctgactcacgccttccctccgccgtccgggtctccgtaggacagtcagtccacctatcctcctgcacgtgggaccngcagtcgactagttcggtacttaataactatcggtaccttccgtaggttaaccaacgactactccgaggaccaaaccgcccctaaaagttcgtagtacttttcggacgtacggttaccgacgtaaacggtccggtaccccttacgggtaccgggggttaccccagggttaaccctccggttaccgttcctcggttacgggtccctaaccggtaacggttccgtacgggtaaccaaaccggtccggtcccctacccgttacgacccgttacctcgggtacggtcctacccgtagtaccgttacggaacggtacgtacggaacggttcttaacggtacctttaacgttaccgtcgtaacgtctaccgttacgtacgttttcgaaccggtacgacgtaaccgtaccgttaacgttccgtttaccgggttaccggacgggtaaaccggaccgtaaccgggtaccgtacccgggtaaccccgttccgtaaccgggtaaccctaccgggtaaccccggtaccggacccggtttaccccgtcccccggttaaccggg

SEQ ID NO: 119422 - DNA, 647 bp, Homo sapiens
  misc_feature: GYAE6OF02IINK1.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccatctcctgcacgtgggaccagcagtgactgttggtcgttaataactatgtctcctaggtaccaacaacactaccaggaccaaacgaccccctaaaactcgtacgtatttctggtaggtcaagtaacgcgcctcgtacgggtcctgactcgtcttctcgtcgtctacgtaagtcgtggacaacgacggtccctacccgtcgtaccgttcgtccgtcgggtcctaccgacgacgtggaacggtatacgggacgtcgttacgtaacttataaccgttcgacgacgttctactagttttacgcgtacgggtactacgtaccgttaacgttaccgttcggtaccgggtcgggtaacggaccggtaacggtaccgtaccgtaacccggttaccgtacggtaccacggtaacccggacggtccgtccccggtccccgtaccgg

SEQ ID NO: 119423 - DNA, 667 bp, Homo sapiens
  misc_feature: GYAE6OF02FSBII.5.86.H09.1.454.CMB.1.raw
  modified_base (524)..(524): a, c, t, g, unknown or other
  misc_feature (524)..(524): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (560)..(560): a, c, t, g, unknown or other
  misc_feature (560)..(560): n is a, c, g, or t
  modified_base (572)..(572): a, c, t, g, unknown or other
  misc_feature (572)..(572): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggaccagcacgtgaactagttggtacgtttaataactagttagtccttccgtacggtaacccaaacaaccgtactacccgaacggaccaaaaccgaacccccctaaacgtcggtagtacttttcgtggacggttacgaacggttaacggccggtaccccgtacggaccgggggtccccttaggacttccgtacttccgtcgttacggtcctaccgtaacgttcgtacggtaccaaccggtaccggtccctcccgtacgacccgttcgttccgtcgggaccttcccaggtctgacggtanacggtggtcttacgtacgtacttacgcncngtcctntagttgcaggcncgtcctatccgttcgtcgggtacgacggtacaaccggtcgtaccgtaccggtcgtaacgccgaccgtacccgacgtccgtcccgcccgttaccgg

SEQ ID NO: 119424 - DNA, 689 bp, Homo sapiens
  misc_feature: GYAE6OF02GF1QX.5.86.H09.1.454.CMB.1.raw
  modified_base (666)..(666): a, c, t, g, unknown or other
  misc_feature (666)..(666): n is a, c, g, or t
tcagatcagacacgcacgaccggtgctcgatttagtgctatagacttgggtttgggggctggggtctcaggaggcagcgctctcaggacgtcaccaccatcggcctgggctctgctcctcctcaccctctcactcaggcacacgggtcctgggcccagtctcggccctagacctcacgccctcccgtccgtccggtcccgggtctccgtaggacctagtcacgtccaccatcctctcgacacgtacgggaccagcagtcgactagttcggtacgttaactaactatcgtctacgtacggtaaccaacaactacaccgtaacgaccaaacgacccctaaacgtcgtacgtactttcacggtacgtacaacggtaacgccggtccctacggacggggtcctaggtactccgtacgtctcgtacgactaccgtaacgtctacggaccaacggtaccgtccttccctacggaccgttcgtaccggtcggtaccgtaccgacgtacgacggtagacgtagacggtccgtagacttaacgttcacgactacgtcgttactgtttaccgacgtaccggtacgacgtaccgttacttacgtcgggtttacggacgggtaacggaccgtaacgcggtccggtaacccgtacggtacgtacgaccgaccggtaacnccggttacccgtacccgtaccgg

SEQ ID NO: 119425 - DNA, 702 bp, Homo sapiens
  misc_feature: GYAE6OF02GDCPH.5.86.H09.1.454.CMB.1.raw
tcagatcagacacgcacgaccggtgctcgatttagtgctatagacttgggtttgggggctgggggtctcaggaggcagcgctctcaggacgtcaccaccatggcctggggctctgctcctcctcaccctcctcactcagggcacagggtcctgggcccagtctgccctgactcagcctccctccgcgtccgggtctcctggacagtcagtcacatctcctgcactgggaccagcagtgactagttcggtacgtttaataacgttatcgttctcctaggtaacctaaaacaactatccgaggaccaaacgaccccctaaaactcgtagtactttctaggaaggttcaaggtaacgcggacccctcgacgggggtccctgaactcggtaccttcgtctcggtactaccgaacgtcgtcggacctaaaccgaccggtccctacccgtagtacccgtctccgtacgggctaccgacgacgtgacggtacgtagacggtacttagtaacttacttacgtcgacgtacgccttactaacgttttcgaccacgggtactaaccgggttaccgtaacgttaaccgttcggttaccggggtacgggtaacggggaaccgtaaccggacccggttaccgtaacccggttacccgtaaggtaccccgtacgggaacccctaacgggtcccgttaccggacccccgttacccgg

SEQ ID NO: 119426 - DNA, 657 bp, Homo sapiens
  misc_feature: GYAE6OF02G5MIB.5.86.H09.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
tcagatcagacacgcacgaccggtgctcgatttagtgctatagacttgggtttggggctggggtctcaggaggcagcgctctcgaggacgtcaccaccatggcctggctctgctcctcctcaccctctcacgtcagggcacgaggtcctgggcccagtctgccctgactcagcctccctccgcgtccggtctccgtggacngtcagtcacntctcctgctacgtcgggacctagcaggtgactgtttggtacgttattaacgtatcgtcctccgtacgtaaccaactacgtacgtaccgacggaccgaaccgacccctaacgtcgtacgtacttcgtaggtacgtacgtaacgtacgccgtccgtcgtacgggtcctgtacgtcgtctcgtcgtcgtacctaccgtacgtcgtacgaccgaaccgtaccgtcccgtcccgtcgtaccgtcgtccgtcggtacctaccgacgtacgtagtacgtacgtacggtacgtacgtacgtaacttacgtacgtcgtactagtctacgtacgttcgacgtacgacgtacgtaccgtacgtccgtacgtacggtacgtacgtaaccgtacgtcgttaccggtaccgtaccgttacgaccgtaccgtaccgtaccggtccgtacccgtccgtaccg

SEQ ID NO: 119427 - DNA, 902 bp, Homo sapiens
  misc_feature: GYAE6OF02HOLIP.5.86.H09.1.454.CMB.1.raw
  modified_base (174)..(174): a, c, t, g, unknown or other
  misc_feature (174)..(174): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggccacagggtcctgggcccagtctcgccctgactcncgcctccctcgccgtcggtctcctggacagtcagtcacctatctcctgcacgtaggaccagccagtacgactagtttcggttacgtttaagtaaacttattcgttaccttccgttacggtaacccaaactaaacactaccgaacggacccaaaaccggaaccccccctaaaacgttcggtacgttaacgttttaccgtaggtacgggttacctaagggttaaaccggcccggtaccccgtacgggtaacccgggggttaccccgtaggtaacgtttaccggtccgtttaccgttccggttacggtacccttacccgtaaacggttccggttacggtaaccgaaacccgacccggttccccttacccgttacggtacccgttccggtaccggtccgggtaaccctacccggtaacggtacctagggtaacggtacgtacgggacggttaccgttaacggtaaccgtttaaacgtttaccgtacgtaccgtaaccggttaccttaccgtttacgttcgaacccggtacgggtacccttaacccggtacccggtttaaaccttaacccgggtttacccgggtttccggggtaaccggggaacccggggttaacccggtaaaccgttcccgggttaacccgggtaacccggttacccggttaaccggttaccggaacccggtaccccggtaaacccggtccccggttaccccggttacccccgttccccggg

SEQ ID NO: 119428 - DNA, 710 bp, Homo sapiens
  misc_feature: GYAE6OF02JWAVB.5.86.H09.1.454.CMB.1.raw
  modified_base (219)..(219): a, c, t, g, unknown or other
  misc_feature (219)..(219): n is a, c, g, or t
  modified_base (320)..(320): a, c, t, g, unknown or other
  misc_feature (320)..(320): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcacgggcacaggtcctgggcccagtctcgccctgactcacgccctcctccggcgtccgggtctccgtgacagtcagtcaccatcncctgcacgtgggaccagcaggtcactattggtaccttataacttatcgtacttccgtacggtaacctaacaacctactccgacgaccaaccgaccccaacncgtgattacagtacgtacagtacgcgtcctcgtacgggtcctgtactcgtcttcgtcgttccggtcctacctaacgttccgacggtaccgaaaccgtaccggtcccttcccgtacggtacccgttctcggtccggtcctaccgtacgtacgtaacggacggtagtacggacggtcgttacgtacgttacgttaccttacggctacgtacgttccgttaacgtttcggaccgtaaggcccgtaacgtccgtttaaaccggtccgtttaccgttaccgggggtaccgtaaccgggtacccgtaaacggttccggtaacgtaccccggttacggtaccgtaccgaaccgggtacccgttaacccggtccggttaccccgtcccccggtaacgg

SEQ ID NO: 119429 - DNA, 841 bp, Homo sapiens
  misc_feature: GYAE6OF02GUJRL.5.86.H09.1.454.CMB.1.raw
tcagatcagacacgcacgaccggtgctcgatttagtgctatagacttgggtttgggggctgggggtctcaggaggcagcgctctcaggacgtcaccaccatggcctgggctctgctcctcctcaccctcctcactcagggcacagggtcctgggcccagtctgccctgactcacgcctccctccgcgtccggtctcctggacagtcagtcacctatcctcctgccacgtcgggaccacgcagtttttacgactagttcggtacgttaataactatcgttctccgtacggtaaccaacaactactaccgacggaaccaaaccgtacccccaaaacgttccgtacgtactttcgtacggtacggtacgtaacggtaaacgtcccgggtaccccgttaccgggtaccggggttaccccgttacgggtaaccgttcccgttcgtttaccgtccgttaccggaccctttacccgtaacggttacggtaccggtaacccgtaaaccggtaacccgggtccccgtttacccgtaccgggtaccccgtttccgtacccggttaccggggtcccttaaccccgtaacgggtaccgttaacgggaagggtacgtacggggtaccgttacgttccgggttaaaccttaacgtttccggacgtacctacggttaccttaccgttagttccggacgtaccgggtctaacggttaccttacgttaccgttccggtcggggtaaccgggtaccggtacgtaacccgggtccgtttaacccgggaccgtttaccggtaccgtaccggtaaccgtacccggtaacggttccccctcccgggtaccccgtttacccggg

SEQ ID NO: 119430 - DNA, 761 bp, Homo sapiens
  misc_feature: GYAE6OF02GJ63J.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagccctcctccgcgtccgggtctccgtggacagtcagtccaccatcctcctgcacgtgggaccagctagtgaccagttcggttacgttaataactacttacgtcttccgtcggtaaccaacaacactaccagaacctaaacgacccccctaaacgtcgtacgtatttccgtacggaacgtcaacggttaacgcccgggcccttacgggtacgggttccccgtaggtacgttccgtaccttccttcgtcggtaccttaccgaaacgttcggttacggactaaaccgcccggttccctcccgttacggtacccgttcgttacccggtcgggtaccctccgaacgtcccggttaggacggttaacggtacggtacgggtaccttaacggtaccttttaacgttaccgtggtaccctacggttccttacggtacgtttacgaccgtacggtaccgttacgtaaccggttacttccgtccgttaccggggtacggtaaccgggaacgtaacggtccgttaccggtaacccgtaccggtacgtacccgtacgggaacccggttacggtcccgttaccccggaccccggttacccgg

SEQ ID NO: 119431 - DNA, 681 bp, Homo sapiens
  misc_feature: GYAE6OF02GT2ND.5.86.H09.1.454.CMB.1.raw
  modified_base (143)..(143): a, c, t, g, unknown or other
  misc_feature (143)..(143): n is a, c, g, or t
  modified_base (479)..(479): a, c, t, g, unknown or other
  misc_feature (479)..(479): n is a, c, g, or t
  modified_base (535)..(535): a, c, t, g, unknown or other
  misc_feature (535)..(535): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctntcccccccggattcaccttttactgtattttggcatgacgtgggtccgccaggctccagggaaggggctggacgtggctctcaaatattaataggtaaaggcaatataacaagactacacgagactccgtagaaggggccggttcaccacctcgagagaacaactccgagggaccacggtagtacctacacatgtaacagcctaggagagccgaggacgacggccgtatattacttgtgtaggaacggggaaacggtgggggactaagtttacggacccgtcggtcgggggacccgaacggggaacccttggggaccctacccggtcctccgtacncgccctaccaccggacgggccctagtccggttccttcccccgtaggcccgtacccncgtacctccgaggccacgacccgtcggacacgccaacgaccggccgggtacccgtgggcctaccggtcccggtagggtacccgtaaaggttcccgtttaccggttcccggttacgtacgttccggtaacgttcgacggtaccgggg

SEQ ID NO: 119432 - DNA, 811 bp, Homo sapiens
  misc_feature: GYAE6OF02GV3U7.5.86.H09.1.454.CMB.1.raw
tcagatcagacacgcacgaccggtgctcgatttagtgctatagactttggggtttgggggctggggtctcaggaggcagcgctctcaggacgtccaccaccatggcctgggctctgctcctcctcaccctcctcactcagggcacagggtccgtcgggcccagtctcgccctgactcacgccctccctccgccggtccggtctccgtggacagtcacgtcaccactcctccgtgccgacgtcgggaccagcagtcgactagtttcggttacgttaacttaactatcgttacctccgtacggttaacccaaacctaacgtactacccgaacggtaccaaaacccgtacccccctaaacgttccgttagtaacttttcgtacgggtacggtacgaacgggtaccggcccggtaccccgttaccggtacggggttcccctaggtaccgttccgtcgttccgtacgtcggtacctaccgtaagttccgtacgacctaccgacccgtcccgtacccgtcgaaccgttcgtacgtcgggcctacgtacgtacgtagtaacggacgttacgggtacgtacgttacgtaactttaacgttacgacgtaccgacgttccgttaactttacggtaccgtaccgtacggtaccgttaaccggtaaccgtttaacgttaccgtttccgggtaacggggaccgggtaaccgggtaaccgtaccggtaccggttacccggttacccggtttaccgttaacggtacccggttaacggaacccccggttaacggttccccggtacccccgtaccccggtttacccgg

SEQ ID NO: 119433 - DNA, 755 bp, Homo sapiens
  misc_feature: GYAE6OF02IS7SO.5.86.H09.1.454.CMB.1.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctctcactcagggcacagggtcctgggcccagtctgaccctgactcacgcctccctccgcggtccgggtctccgtggacagtcacgtcacgtactcctcngcacgtggaccagctagngaactgttcggtcttactaactatcgtctccgtagtaaccaactaacactaccgaggaccaaaccgacccccaaagttccgtacgttaaccgtttctacggtacggttacagggtaaaccgtccggaccccgttacggaccggggttaccctcggtaaccttccggtccgtttcgtaccgtttcggcccgtaaccgtaacggtccgttacggacccaaccggtaccgtccccgttccgtcggtacccgtcttccggtcggaccgtaccgacgtacgtggaacgtcaggtcgtactacggtacttacttacgtgaccgatccgttacgtactttacgacggtacgaccgttacggtaccttaaaccgttacggtttacccgggtcggggtaccgggtaaccgggtaaccggtcgttaccggtacccgggttaacccttacccgggttaacggtacctacccggggaaaccgtccgggtaacccccgttcccgggtaacccccgttacccggg

SEQ ID NO: 119434 - DNA, 698 bp, Homo sapiens
  misc_feature: GYAE6OF02GH5N8.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacgaggtcctgggcccagtctcgccctgactcacgccctccctcggccgtccgggtctccgtaggaccagtcagtcacctatcctcgtgactacgtcggaccagcaagtgactagtcggtacgtaatactatgtctcgtagtaaccaacaacgactacgacgtacaaaccgtacccctaaacgtcgtacgtactttcgacggtacgtacaaggtaacgcccggtacccgtacggtacgggttcctgtaacgtccgtcttcgtacgtcgtcgttaacgtacgtacgtacggtaccgaaacgtcccgggtacctcccgtacgggtacccgtacgtccggtcggtcccgtaaccgtacggtacgtaccgggaaggtaaccgtcggagtacgtacgtaaccgttaacgttacgtacgccgtaggtacttacgtagttaccgcgacggtctacgtccttactcgtaccggtacggacgaacggaccgtaacggtcgtacccggtaccgttacgtaccgggtaacgtcccggaccgtaaccgtccggtcccttacccgggtaaccg

SEQ ID NO: 119435 - DNA, 756 bp, Homo sapiens
  misc_feature: GYAE6OF02INQG6.5.86.H09.1.454.CMB.1.raw
  modified_base (170)..(170): a, c, t, g, unknown or other
  misc_feature (170)..(170): n is a, c, g, or t
  modified_base (233)..(233): a, c, t, g, unknown or other
  misc_feature (233)..(233): n is a, c, g, or t
tcagatcagacacgcacgaccggtgctcgatttagtgctatagacgttgggtttgggggtgctcgattttagtgctatagacttgggtttgggatctacgttgcaggtgtaggtctgggtccctgagactctcctgtgcagcctctggattcactttactgtattttggnatgacgtgggtccgcaggctcgagggagggctggactggctctacaaatattaagtggtaagnaatatacgaagactacacagactcgtggaagggtccgttcaccaccttcggaagagaacaaccgtacgagggaccgacggttcgtacctaaccgacgtatacgaaccgtagaccgtagacggtacggccgggaacggaccgtaacggtaccgttaataacgtttagtttggtacggtagggaacggggggtaaacgttgggggaacttaaaggtttcggaaccggtcgtacgggggacctaacggggtaaccccgttgggtaccgtaccccggtttactccccgtacgacggtaccccttacccgaacccggtaaccgggcccgtaacgttcccggttacccgttccccccgtagggtaccccgtcccgtcggcctacccggacggacgtaccccgtaccgccggtaagaccgtaccgacgtaccgggccgtcccgggtagggtccggtcgtccggttaccggacggtaaccggaccttaccgtttcccggacgttcggtacggacgttccgagggtaccggg

SEQ ID NO: 119436 - DNA, 765 bp, Homo sapiens
  misc_feature: GYAE6OF02GM5BR.5.86.H09.1.454.CMB.1.raw
tcagatcagacacgcacgaccggtgctcgatttagtgctatagacttgagtctgggggaggcttggtacagcctgggggggtccctgagactctcctgtgcagcctctggattcacctttactgattttggcatgacgtgggtccgccaggctccagggaaggggctggactggctctcaaatattaatggaaaaggcaatatacaagactacacagactccgtgaacgggccggttcaccacctcgagagacaactccagggacacggtgtacctacacatagaacagcctgagacgccgaggaccacggccgtatattattgtggtggaaggggtaaacgtggggggactaagtttcggacccgtcggtcggggacccgaaggggtaaccccgtgggtacccacccggttcccttcccgtcgacgtccctacccgaacccgaacggggcccccaagttcccgggtttcccttcccccccgtcgggtccccgtcccccgtcggtccccttcccggaacgggaccggccccgtaacccccggttcccgggaaacggacccggtaccgaacccgtacgggccccggggtacccccggtgggggccccgtttacgggtccccggttacgggggttaacccgtaaaacggggttaccctttaaccccggttttcccccggttggttcccgtagtaccgttccggtacgggccgggtaccggggttccgtacgggaccgtaacgggcccggacgtaacgtagctgactg

SEQ ID NO: 119437 - DNA, 696 bp, Homo sapiens
  misc_feature: GYAE6OF02FJI5T.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcgagggcacgacgggttcctgggcccctagtcctcgccctgacctcacgccctccctccgcgtccgggtctccgtggacagtcacgtcaccgactcctcctgactacgtcgggaccagcgtagtcgactgttcggtacgttaataactatcgtcctcgtacgtaaccaacaactactccacggacaaccgacccctaagttcgtagtactttcgaggacgtacgtaagtacggccgtacctcggtaccgggttcctagcgttcgtcttcgtcgtcgtacctacgtagtcggtacgaacccgtaacgacccggtccccttccgaccggttacccgtacgtttccggtaccgggtcctaccggaacgtaccgtaggaacggtgtacgcgttaacgtcgtaaccttaagtcgttacgcgtacctctactacgttcgacgacgtacgtacggaccttagtccgttaccggtcgggtacggaccggtaacgaacggtctaaccggttccgttaccgtaccggtacgacccggtaacccgcggtcccgtacccgtaccccggttaccg

SEQ ID NO: 119438 - DNA, 636 bp, Homo sapiens
  misc_feature: GYAE6OF02IOCIL.5.86.H09.1.454.CMB.1.raw
  modified_base (632)..(632): a, c, t, g, unknown or other
  misc_feature (632)..(632): n is a, c, g, or t
  modified_base (634)..(636): a, c, t, g, unknown or other
  misc_feature (634)..(636): n is a, c, g, or t
tcagatcagacacgcacgaccggtgctcgatttagtgctatagacttgagtctgggggaggcttggtacagcctggggggtccctgagactctcctgtgcagcctctggattcaccttttactgtattttggcatgacgtgggtccgccaggctccgagggaaggggctggactggctctcaaattattaagtaggaaaaggcaatatacaagactacacagactcgtgagggccgttcaccactcgagacgacaactccgaggacacggtgtacctacacatagaacacgcctgagagccgaggacacggcgtatattattggtgtggaggggtaacgtgggggactaagtttcgaccggtcggtacgggggccgtaacggggaaccccgttcgggtacctacccggtccttcccgtacgaccgtccctacccgaaccggaaccgggccccacgttccggttcccgttccccccgtcgggccccgtccccgtcgtcccgtccgacgggaccgaccacccgtcgacgacgacaccgcggccggccgtcgggctcgaccgtggtacaacggtaccttcgtcccgtcgtctagactcgtggacggcgggtcgtggacgaacggcgacagtacgngnnn

SEQ ID NO: 119439 - DNA, 641 bp, Homo sapiens
  misc_feature: GYAE6OF02G0ZWP.5.86.H09.1.454.CMB.1.raw
  modified_base (238)..(238): a, c, t, g, unknown or other
  misc_feature (238)..(238): n is a, c, g, or t
  modified_base (474)..(474): a, c, t, g, unknown or other
  misc_feature (474)..(474): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccaccatctcctgcactcgggaccagcagngacagttggtcgttataactatgtctccgtgtaccaacaacatccaggacaaacgccccaaactcgtgactttctggacgtcgaggtaacgccggcctcgacggggtccctgactcgcttctcgtcggactcgacgtcgtcgaccaacgccgccctacccgcgtacccgtctaccgtcgggtcctaccaagggtcctaggacggtacgtggacgtcttacgactttaacttaccgngaccgacgtctacgtacgttggacgaacggtcacgttaccgtaacgttaccgttcgttacccggggacgggtaccggtaaccgtaacgggtccgtaccggttaacccgtacccggttagttacccgacggtaacccgaaccgggtccgtccccgtcccggttaccgg

SEQ ID NO: 119440 - DNA, 844 bp, Homo sapiens
  misc_feature: GYAE6OF02GHCZT.5.86.H09.1.454.CMB.1.raw
  modified_base (256)..(256): a, c, t, g, unknown or other
  misc_feature (256)..(256): n is a, c, g, or t
  modified_base (841)..(841): a, c, t, g, unknown or other
  misc_feature (841)..(841): n is a, c, g, or t
tcagatcagacacgcacgaccggtgctcgatttagtgctatagacttgagtctgggggaggcttggtacagcctgggggtccctgagactctcctgtgcagcctctggattcacctttactgattttggcatgacgtgggtccgccaggctccgagggaaggggctggactggctctacaaatattaataggaaaaggcaatatacaagactacacagactccgtgacggtccggtacaccacctgagagacaacncgaggacacggtcgtacctacacaatagaacacgccgtagaagacgaccgaggaccgacggtaccgtaagttacttattggtaggttacggaagggggtaaacgtgggggtactaagtttcgaccgcggtcggggacccgaacggggtacccgtgggtacccgtaccggttcgttacccgtacgaccgtccccgtacccgaacccgggtaaaccggggtaccccctaaccgggtttccccggtttccccgtttcccccccggtccgggtacccccgtacccccgttcccggtaccccggttacccggaaccggggaacccggtccccgtaaccccccggttacccggaaacggaccccgaaccccggaaccgggaaccgggtaaccccgggtcccgggttcccggggtacccggtccgggacccgggtttacgggtaaaccgtaaccgggttaaccccgtttacccggtttccccggttaacgtttcccggttagttacccgccggttaacggtaaccgggtaccggggtaccggttaccgggacccggttaaacgggcccgtacggtaccgtaaggtcgacggngag

SEQ ID NO: 119441 - DNA, 639 bp, Homo sapiens
  misc_feature: GYAE6OF02GESJA.5.86.H09.1.454.CMB.1.raw
  modified_base (482)..(482): a, c, t, g, unknown or other
  misc_feature (482)..(482): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctctgcactgggaccagcagtgacattggtcgttataactatgactcctggtaccaacaaccatacccaagggcaaaacggtaccccccaaaagtccgtgtaatttctggacggtcctaagtaacgccggccctcgacgggggtaccctgagttccgcttctcgtcggtctacccgaagtcctggacctaaacgaccggtacctcccgtcgtaccgtctcgtggcctcgacgtactgagatgtacgctgtaacttattacgtgtaccgngtctacctatttacggaccgtaggactaacggttaccgttaagttacgtttcgtaccgggtccggggaacggtaaccgtaaggtccgtacgtaaccccggttaccgtacggtccgaccggtaacccgaccggtcccgtaccgtcccccgtacccggg

SEQ ID NO: 119442 - DNA, 638 bp, Homo sapiens
  misc_feature: GYAE6OF02H6QPA.5.86.H09.1.454.CMB.1.raw
  modified_base (208)..(208): a, c, t, g, unknown or other
  misc_feature (208)..(208): n is a, c, g, or t
  modified_base (397)..(397): a, c, t, g, unknown or other
  misc_feature (397)..(397): n is a, c, g, or t
  modified_base (542)..(542): a, c, t, g, unknown or other
  misc_feature (542)..(542): n is a, c, g, or t
tcagatcagacacgcacgaccggtgctcgatttagtgctatagacttggggtttggggctggggtctcaggaggcagcgctctcaggacgtcaccaccatcggcctgggctctgctcctcctcaccctctcactcgagggcacgagggtcctgggcccagtctcgccctgactcacgcctcccgtccgcggtccggtctccgtggacngtcacgtcaccatcctccgtgcacgtcgggacagcgagtcactagttggtaccgttaatacgttactgttctaccgtacggtacccaaacgtaactaccgtaccgaacggtaaccaaaaccggaccccctaaaagtcgttacggtactttcgagtacggtcaagtacggccgccgttacggcggttccngtacgtctcgttactcgtcgtctacgtagtcgtgaactacgtacgccttacgcgtacgtctcgccggtcacacgctagagtcgtggagtcgtgtacttagtagtcgactcgtacgttagtcgttacgcgtacgcgtacgtcgtanaccgtttcggacgacgggtacggacgtacggtccgtacgtaacccgtcgttaaccggcgaaccggtccgaacgtccctaccggtacccgttcccgg

SEQ ID NO: 119443 - DNA, 1185 bp, Homo sapiens
  misc_feature: GYAE6OF02FJS5D.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcacctttactgattttggcatgacgtggtccgcaggctcgagggaagggctggactggcttctacaaatagttaacgtgggtaaaacggctaaattataaaccaaagtaccttaacgaacctaacggaccgttacccggtaggtaaacgggggaccccgggttttaccgaaccccgtaaccccttaccgggaacggtacggtaacccgaaaacccgttaccccgaacggggaacccggtaacccgggttacgggttaacccccttaaaccggaaaccctaacgtttacggtaaaacccgtaacggtaccccggttacgggaacgggtaacggaccccgggttaaacggggaaaccgtaaccccgggggtaccccggttttaaacgtaaacgttttaacgttttacggtacggttacggggtaaacggggggtaaaaccgtttacggggggggtacttaaacgttttacggtaacccggtaccggttaccggggggtacccgtaaccggggggtaaacccccgtacggggtttaaccccggtaaacccggtttacccgttaccccggttccccgtaaaaccgggtcccccgtttaacccccggaaaccccgggttaaaacccggggggtaaaccccccctaaacgggttttaacccccggggtttacccccgtttttaacccccccccggttaaccgggggtaccccccggttcccccggtttaccggtaacccccgggttttaacccccggaaacgggggtaaaacccggtcccccgtaaaccccccgttaaccccggggttaaaccgggttaaacccggaaacccggttaaacccggaaccccgggttaccccggggttacccccggttacggggggtaaccccgtttaccgggttacccccgggtaacggggtttaacccccggaaaaacccggggtttaacccggttaaaaccccccgggtttttcccccggttacggttaccccgtttaaccgggtaacccgtttaccggttaccggggttaaacccggggg

SEQ ID NO: 119444 - DNA, 677 bp, Homo sapiens
  misc_feature: GYAE6OF02F8ZIE.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctgggcccagtctcgccctgactcacgcctccctccggcgtccgggtctccgtggacagtcagtcaccatcctctgccacgtggaccagcagtgactagttcggtacttaataactatgtaccttccgtacggtaaccaacaacatccaggacaaacgacccccaaacgtccgtagtaactttcgagtaggtacaagtaacgcgtacccgttcgacggggtcctcgagtaccgtcttactccgtggtctacctaagtcgtacggacaacgccggtccctcccgtacgccgttcgtccgtcggctaccgacgtacggtacgaaggtacgtacggacggtcgttaacgtacttacgttacgtcgacgtacgtcgttacgttacgtttcgaccgtaggtactaggtaacccttaacttccgttaccggttaccgggacgggaaccggtaaccgtaaggtcccgttacggtaacccgttccgtacggtaccgaccggtacccgaacggtccgtcccgtaccccggttaccgg

SEQ ID NO: 119445 - DNA, 668 bp, Homo sapiens
  misc_feature: GYAE6OF02GY6EP.5.86.H09.1.454.CMB.1.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcacgtggaccngcagtnactatttggtacttaataactatcgtcttccgtaggtaccaacaacatccgaagaccaaacgcccccaaactcgtatatttcgaggaggtcaagtacgccggtcctcggacggggttccctgtactcgtcttcgtcgtcgtcctacgtaacggttctacggaccaaaccggcccggtacccttcccggttacgtaccccgttccgttacccggtcgggtccctaccgacggtacgtaggtaggacgtcggtacggtcgttaacgtacttaacgttacgtcgacgtcgtccttacgtagtttcgcgtaggcgacggttcctacttaccgttccggcgggtacgggacggtaaccgaacggtcgtaccggtacccggtccgttacggtaccgcggtacccgtacggtcccgtcccggtcccgttacccgg

SEQ ID NO: 119446 - DNA, 636 bp, Homo sapiens
  misc_feature: GYAE6OF02IKQCB.5.86.H09.1.454.CMB.1.raw
  modified_base (237)..(237): a, c, t, g, unknown or other
  misc_feature (237)..(237): n is a, c, g, or t
  modified_base (299)..(299): a, c, t, g, unknown or other
  misc_feature (299)..(299): n is a, c, g, or t
  modified_base (477)..(477): a, c, t, g, unknown or other
  misc_feature (477)..(477): n is a, c, g, or t
tcagatcagacacgcacgaccggtgctcgatttagtgctatagacttgggtttggggctggggtctcaggaggcagcgctctcaggacgtcaccaccatggcctgggctctgctcctcctcaccctctcactcgaggcacagggtcctgggcccagtctgccctgacctcagcctccctccgcgttccgggtctccgtggacagtcagtcaccatctcctgcacgtcggaccagcgngtagactgtttggtacgttaagttaaccttagtcgttccgtccgttggtaacccaaacaacnctaccgagacaaaccgaccccctaaatcgtagtattcgtagacgtactagtaacgccggtcctacgtacggggtccctagacgttccgtcttcgtcgtcgcctaacgtacgttcgtcggaactaaccgacggtccctaccgtcggtcctcgtccgtcgggtctacgcgtacgtacggngtagtcggagtcctagtacgttacgtttacacgtccgacgttcgtacttgttacgacgacgggtactcggtaccgttacgtacgttcggtacggcggaccggtacgacgtcgtacgtacccgttcgacgtcaccggccaacggtcgcccgtcccgtacg

SEQ ID NO: 119447 - DNA, 686 bp, Homo sapiens
  misc_feature: GYAE6OF02I1DCU.5.86.H09.1.454.CMB.1.raw
  modified_base (531)..(531): a, c, t, g, unknown or other
  misc_feature (531)..(531): n is a, c, g, or t
  modified_base (536)..(536): a, c, t, g, unknown or other
  misc_feature (536)..(536): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcaggcacgagggtcctgggcccagtctcgccctgactcacgccctccctccgcggtccgggtctccgtggacacgtcacgtccacctatcctcctagccacgtcgggaccagctagtcgaactgttggtacgtttaataactactgttcctccgttacggtaaccaacaacactaccgagaacccaaaccgaccccctaaagtcgtaacgtatttcgtaggaacggtcaaggtaacggcccggtacctcggtaccggggttcctaggtactccgtcgttctcgtcgcctacgtagtcgtaggaaccaccgtaccggcccttaccgtcgtaccgtcctcggtcgtacctcgtacgtcgtacgaaggtagtcggacggcttacgtacgttacgttaccgngtacncggttctagtacgttcgacgtacggtcgtaccgtacgttacgttaccgtcggtacccgggacggaacgaccggtacgaccggtttcggaacccgttaccgtaggtcctaacccggacccgtaccgggtacccgttcccggacccttccgg

SEQ ID NO: 119448 - DNA, 663 bp, Homo sapiens
  misc_feature: GYAE6OF02HJLMF.5.86.H09.1.454.CMB.1.raw
  modified_base (341)..(341): a, c, t, g, unknown or other
  misc_feature (341)..(341): n is a, c, g, or t
  modified_base (523)..(523): a, c, t, g, unknown or other
  misc_feature (523)..(523): n is a, c, g, or t
tcagatcagacacgcacgaccggtgctcgatttagtgctatagacttgggtttggggggctgggggtctcaggaggcagcgctctcaggacgtcaccaccatggcctgggctctgctcctcctcaccctctcactcagggcacgagggtccgtgggcccagtctcgccctgacctcgacgcctccctccgcggtccgggtctccgtggacagtcagtcacctatcctcctacgccacgtcgggaccagcagtgactagtttggttacttaataactatcgtcctccgtacgtaaccaacaacatccgaaggtaccaaaccgaccccaatcgtatacttcgngacgtcaaggtacgccggtacctacggaccggggttccaggtacgtcgtccttcctcgtacggtacctaccgtaagttccggtacggaacctaacggtcccgtccctcgtccggtacctcgtcggtcggcctacgacgtacgtaggacgtagtcgtacggacttacgtaccttatcgactcngttactactaggtcacggtcgtacgacgttctacgtcgtacgggttcggagggtaccgtaacgacggttccggtacgtaacccggttacggtcgtaaccggccggttaaccgaccgggtcttaccccggtcccggttacg

SEQ ID NO: 119449 - DNA, 804 bp, Homo sapiens
  misc_feature: GYAE6OF02GJQ97.5.86.H09.1.454.CMB.1.raw
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcgagggcacgacgggtcctcgggccctagtctcgccctgactcacgccctccctccggtcgtccgggtctccgtaggacagtcagtccactactctcctnaccacgtcggaaccngcagtgactatggtactaatactntcgtctcgtacgtaaccaactacnctaccgaggaaccaaaccctaaccccgtaaagttcgtacgttaactttcgacgtacggttaacgtacggtacggtccgtaccgtacgggtaccggggttccctaggccggtttctccgtttacgtcgtaccgtcctaccgtaaacggtttcgaacggacccaaacggtcccggtccctaccgtacggtacccggtcgtccgggtcggtaccctaccggtaggtaccgtacggggtaagccggttaagggaccgttagttaaccggttaacctttacgtttaacggcgtaacgttaccggttcttaacgtttacgttaaccggcgtaaccggtcgttaacccggtttaccgtaaccgttaccgggttaccgggttaccggggtacgggaaccgggttaaacccgtagggtttccccggtaacggttaacccggtttacgtaaccgggtcccgaaaccgggttaacccgtcccggttaaccccggttaccccgtacccggtttcccggg

SEQ ID NO: 119450 - DNA, 745 bp, Homo sapiens
  misc_feature: GYAE6OF02GXEUC.5.86.H09.1.454.CMB.1.raw
tcagatcagacacgcacgaccggtgctcgatttagtgctatagacgttgggtttgggggctggggtctcaggaggcagcgctctcaggacgtcaccacatggcctgggctctgctctcctcaccctctcactcagggcacgagggtcctgggcccagtctgccctgactcagcctccctcgcgtccggtctcctggacagtcagtccacctatctcctgccaacgtcggaccagcaggtcactagtttcggtacgttaataactattgtcctaccgtacgtaaccaacaactactaccgaggaccaaaaccgcccctaaacgtcgtagtactttcgtaggtacggtacgaacggtaacggccggtaccgttacggtaccggggttccctaggtacttaccgtcgttaccgtccgtcggtacctacgtaagtccgtacgacctaacgaccggtccctaccgtacgtccgtctcggtcggtcctacgacgtacggtaggaacggtcgtacggacggtacgttacgtaacttacgttaccgtacgacgttacgtccttaagtacgtttacggacgttacggaacgttaccgttaaccgttaacgtcccggtttacggtaccggggtacggtaaccgggttaccgaacggttacccgttaaccggtaacccgggttaccgttaacgggtacccggtaaccggttaaccccggaaacggttccccgtaccccggttacccgttacccggg

SEQ ID NO: 119451 - DNA, 862 bp, Homo sapiens
  misc_feature: GYAE6OF02HCWW5.5.86.H09.1.454.CMB.1.raw
  modified_base (206)..(206): a, c, t, g, unknown or other
  misc_feature (206)..(206): n is a, c, g, or t
tcagatcagacacgcacgaccggtgctcgatttagtgctatagacttgggtttggggggctggggtctcaggaggcagcgctctcaggacgtcaccaccatggcctgggctctgctcctcctcaccctctcactcagggcacgagggtcctgggcccagtctgccctagactcacgcctccctccgcgtccgggtctccgtggacngtcagtccaccatctcctgcacgtggaccagctagcgactagtttcggtacgttaattaactattcgtaccttccgtaggtaacccaaactaaacactaccgaaggaccaaaaccgacccccaaaacgtcgttaacgtactttacgtaggtaacggtacgtaaggtaaacggccggtaccccgttacggtaccggggggttacccctaggtaaccgttcccggttacctttaccgttacggttaccgggtacctttaaccccgtaaaacgggtttccgttacgggtaaacccctaaaccggacccgggttaccccttaccccgtacggtacccggttccgttaccgtcgggtaccctaccggtaacggtaaccggtaggtaaaccgggtacgttacgggaaccgggtcttaacggtaactttaaacgttaccgtacgacgttaaccgtacgttaccgttaagttttacggaccgggtaacggtaccggtaaccgttaccgttaaacgttaccggtttacccggttaccggggaccggggttaaccggggtaaccgaacggttacccgtaaccggtaaccccggttacgttacgggtaaccctaaccgggtaccccgtaaaccgggtcccggttacccggtacccccgttacccggg

SEQ ID NO: 119452 - DNA, 805 bp, Homo sapiens
  misc_feature: GYAE6OF02F7Z79.5.86.H09.1.454.CMB.1.raw
  modified_base (797)..(797): a, c, t, g, unknown or other
  misc_feature (797)..(797): n is a, c, g, or t
tcagatcagacacgcacgaccggtgctcgatttagtgctatagacttgagtctggggggaggcttggtacagcctggggggtccctgagactctcctgtgcagcctctggattccacctttactgtatttttggcattggacggttcggggtcccgccgaggctaccgaggggaggggtctgggactggcctcgtacaaattattaagtagggaaaaggtcaaatactaaacgaagtaacctaaccacgtaacgaccgttaccggtaggaacggggtccccggttacaccccaccttacggaaggtaccgaaccaaacctccggaacggggtaaccgacgggttcgtaacccgtacctaactacttacgaaacacggaccgtagaacggacgacccggaaggaaccggaccgggtcccggtaattacgttaggtttacggtgtagggtaaggggtaaaccggtgggggtactaaggtttcgaacgcggtacggggccgtacggggaacccgtcgtaccgtacccgtcgtcccgtagaccgtcccgtacccgaccgaaccgggtcccgtacgttacccggttcccctccccggtccggtacccggtccccgtaccgtcccgtccgacgggaccgaccgaccccgttaccggacgacgaccgtaccgacggtcccggtccggcggcgtccggtccggtaccggacggtaaccggtaccttaccggtccggttcgtccgttacgtactcggttcggtaacggcggtaccggtggtaccgacgggtccgacggttagccgngtccagtc

SEQ ID NO: 119453 - DNA, 666 bp, Homo sapiens
  misc_feature: GYAE6OF02JV5LL.5.86.H09.1.454.CMB.1.raw
  modified_base (231)..(231): a, c, t, g, unknown or other
  misc_feature (231)..(231): n is a, c, g, or t
tcagatcagacacgcacgaccggtgctcgatttagtgctatagacttgggtttgggggctggggtctcaggaggcagcgctctcaggacgtcacaccatggcctgggctctgctcctcctcaccctctcactcagggcacagggtcctgggcccagtctcgccctgactcagcctccctccgcgtcggtctcctggaccagtcagtccacctatcctctgcagtcggaccngcagtcactattcggtacttataactatgtctcctggtaaccacacatccaggaccaaacgcccccaaactcgtagtacttcgtagagtacgaaggtaacggcccggtcccgtaccgtaacgggggtccctagtacgtcgtacttcgtcgtggtccctacgtaacgcgttcggacaacggtccgccctccgtacgtaccgtcctcgacgggttccaccgtacgacgtacggtacggtacgtacggtacggtccgttaacgtaccgttaacgttacgtcgtacgtaaccgtccgttacgttaacgttccggtacgtaccgggacttaccggtaccgttacgttaccgttccgtacggaccgggtaacgaccggtaacgtctaccggtaccgtacggtacgtacgtcgaccgtacggtccgtacccgtccgtaaccg

SEQ ID NO: 119454 - DNA, 742 bp, Homo sapiens
  misc_feature: GYAE6OF02HAL1D.5.86.H09.1.454.CMB.1.raw
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccaggggaagggctggactggctctacaaattattaagtggaaaagcaatataacaagactacacagactcgtagaacgggtccgttacaccacctcgagacgacaactccgaggacacggtcgtacctacacatacgaacacgcctagagacgaccggagacgacggccgtatattagttgtgtaggaaggggaacgtgggggactaagtttcggaccggtcggtcggggaccgtaacggggtaacccgtggttacccgtacccggttcctacccgtaccgtacgtccccgtacccgaacccggtaaccgggtcccctacgttaccccggggttccctttaccccccggtcgggaccccgtccccgtcggtcccttacccggacgggaccgacccgtacccgttaccggaacgtaccgaccaaccgtccggacccgggtccccggtagggtcctccggtcccgttcgggtaacccgaacgggttacccttacccggttcccgtacgttcgtacgttacttccggtcggtaccggcccgggttacgtaccggaccggtaacggtcccgtacggtaagtcggatccgagcg

SEQ ID NO: 119455 - DNA, 629 bp, Homo sapiens
  misc_feature: GYAE6OF02GKFDQ.5.86.H09.1.454.CMB.1.raw
  modified_base (263)..(263): a, c, t, g, unknown or other
  misc_feature (263)..(263): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (426)..(426): a, c, t, g, unknown or other
  misc_feature (426)..(426): n is a, c, g, or t
  modified_base (626)..(626): a, c, t, g, unknown or other
  misc_feature (626)..(626): n is a, c, g, or t
tcagatcagacacgcacgaccggtgctcgatttagtgctatagacttgagtctgggggaggcttggtacagcctggggggtccctgagactctcctgtgcagcctctggattcacctttactgattttggcatgacgtgggtccgccaggctccgagggaagggctggactggctctcaaatataatggaaaagcaatatacaagactacacagactccgtgaagggccgttcaccacctgagagacaactcagggacacggngtacctacacatgaacagcctgagacgccgaggacacggccgtatattattgtgtgaaggggaacgtgggggactaagtttgaccgcgtcggggccagggacctggtcaccgtcctccncacgcccnccaccgaacgggcccaacgttccggtccttccccgnggtcccgccctcgcctacccgacgggtacgccacccgtccggacgacgaccgaccgacgcccgggcccgtacggggccgtaccggtccgtcgggtaccgtaacgtaaccgttacccgttacccggttgtccgttcgtacttcgtacgggtacggccgggtacggtccggaaccgaagggacgtccggaagtaacgtgacnacg

SEQ ID NO: 119456 - DNA, 802 bp, Homo sapiens
  misc_feature: GYAE6OF02JL073.5.86.H09.1.454.CMB.1.raw
  modified_base (227)..(227): a, c, t, g, unknown or other
  misc_feature (227)..(227): n is a, c, g, or t
tcagatcagacacgcacgaccggtgctcgatttagtgctatagacttgggtttgggggctggggtctcgaggaggcagcgctctcaggacgtcaccaccatggcctgggctctgctcctcctcaccctctccactcagggcacagggtcctgggcccgagtcctgcccctgacctcacgtccctcccgtccgccggttcccgggtccttccgtgggacctaggtacncggtcaccatccgtcctgcctacgtccgggaccagcgtaacgtcgaactacgtttcggttacgttacttaaactactttcgtactacccgttacggtaaaccctaaaacctaaaccgtaacttaccggacggtaaccgaaaacccgtacccccgtaaacgtacggtacgtaactttccgtacggtaacgtaaccgaacgtaacggtccggtaccccgttacggaaccgggggttaccctggtacgtaccgtccgttaccgttcggtcgtaccgtacgtacggtccgtacggtaccgtaacccgtacccggtcccgtaccgtacccggtaaccggtccgttccggtccgggtacctccggtaaccggtcgttaacgggacggtaagtacggtccgacgttaacgtacgttaaagttccgacgtacgccgttacgtccgttacttacggtcgtaacggccggtaacgtccggttaacttccgttaccggaccgggtcgaaccgggtaccgtacgtccggtacgtacccggtcggtacgtaccgaccggtaacggaccggtccgccgtccccggtacg

SEQ ID NO: 119457 - DNA, 851 bp, Homo sapiens
  misc_feature: GYAE6OF02FK4GX.5.86.H09.1.454.CMB.1.raw
  modified_base (212)..(212): a, c, t, g, unknown or other
  misc_feature (212)..(212): n is a, c, g, or t
  modified_base (572)..(572): a, c, t, g, unknown or other
  misc_feature (572)..(572): n is a, c, g, or t
tcagatcagacacgcacgaccggtgctcgatttagtgctatagacttgggtttgggggctggggtctcaggaggcagcgctctcaggaccgtcaccaccatggcctgggctctgctcctcctcaccctcctcactcgagggcacgacgggtccgtcggcccagtctgccctgactcacgcctcctccgcgtccgggtctccgtgactagtcngtcaccactcctcctcgcacgtcgggaccaggcagtcgtactagtttacggtcttaactaactactgtaccttcgtacggtaaccaacaacctacgtacccgacggaaccaaaacccggtaccccctaaacgttaccgtagttacttttacgtacggtaacggttaacgtaaacggtaacggtcccggacccgttacggaacccgggggttaccctaggtaccgttccgttacccgttccctacgtccggttccgtaacccggtaacgtccgggcgtaacccgaaacccgtcccggtaccccgttacccgtccgtacccgtttcctaccgggttccgggaccgtaaccgacgggttaacnggaacgggtacggttagaacgggttccgttaaagtaccgtttacggttaaccgtcggtacctacggttaccttccttaacggttccgggtaacggacggacccgggttaacgtacccgggtttaacgttaccggttaccgggttcgggggtaaccgggaacggtacccggaaacggtttcccggtaacccggtttaccccgttacgggtaaccgggttacccgtaaccgggtaaccccggggaacggttccccctaccccgggttccctaacccccggg

SEQ ID NO: 119458 - DNA, 690 bp, Homo sapiens
  misc_feature: GYAE6OF02GDB5G.5.86.H09.1.454.CMB.1.raw
  modified_base (540)..(540): a, c, t, g, unknown or other
  misc_feature (540)..(540): n is a, c, g, or t
tcagatcagacacgcacgaccggtgctcgatttagtgctatagacgttggggtttgggggctgggggtctcaggaggcagcgctctcaggacgtcaccaccatggcctgggctctgctcctcctcaccctctcactcaggcacagggtcctgggcccagtctgccctgacctcacgcctccctcgcgtcccgggtctcctggacagtcagtcaccatcctccgtgacacgtgggaccagctacgtgaacctagtttcgggtacgttaataactatcgtacctccgtaggtaaccaaacaacgtacttccgaaggactaaaaccggacccccctaaaacgtccggtagtaactttcgtacggacggttaccaaggtaaacggccggtaccctacggtacggggtccctaggaactcggtcttcctcgtcggactaccgtaacgttcgacggtaccaacggtaccgtcccgtacccgtgaccgttcgtcgtcggcctaccagaccgtaggagacgtcggagtcctagacgttactacgtganaccggtctactagtttaccgagtacgcgtaacgtaccgtaagttaccgttcgtaccgggtacggtaacggtaaccgaggtaccttaccgggacccgttacgtaaccggacttaccggacccgttaagcccgttacccgaccccgttacgg

SEQ ID NO: 119459 - DNA, 656 bp, Homo sapiens
  misc_feature: GYAE6OF02GXHE8.5.86.H09.1.454.CMB.1.raw
tcagatcagacacgcacgaccggtgctcgatttagtgctatagacttgggtttgggggctggggtctcaggaggcagcgctctcgaggacgtcaccaccatcggcctgggctctgcctcctcctcaccctctcactcgagggcacgaggtcctgggacccagtctcgccctgactcacgtccctccctccgcgtccggtctcctggactgtcagtcaccatcgtcctgcacgtggaccagcagcactagttcgtacgttatactatcgtctctcgtacaacaactactacacggtacaaaccgtacccctaacgtacgtctacgttcgagtacgtactaacgaacgccgtcctacggtacgggtacctgtactccgttacgtcctcgtacgaccgttcgtaacgtaccgtaggtaccgaacctaccggtccctccgtaccggtaccgtccgtacggccggtactaccgacggtacgtaggagtacgtcggacgtgttacgtacgttgtaactcgaactcgtactacgtacgttcgacgacgtccgtaacgtcgtaacgttacgtcggtacggacgtacggcctaagggtcctaccggtaccgttaccgtacgtaccgaccgtcggtaacccggtcgtacccgtaccccgttaccgg

SEQ ID NO: 119460 - DNA, 756 bp, Homo sapiens
  misc_feature: GYAE6OF02HX0NJ.5.86.H09.1.454.CMB.1.raw
tcagatcagacacgcacgaccggtgctcgatttagtgctatagacttgggtttgggggctggggtctcaggaggcagcgctctcaggacgtcaccacatggcctgggctctgctcctcctcaccctctcactcgagggacacgacgggtcctcgggacccagtctcgaccctgactcacgccctcccctccggccgtccgggtactcgtaggacagtcacgtccactactcctactcgcgtacgtaggaccagcctagtacgactacggtttcggttacgttaacttaaacttcgtacgtttcctaccgttaccggtaaaaccaactaaaccgtacgtacccgaagggtaacccaaaacccgtacccctaaagttccgttagtacttttcgaagtacggtaccgtaacggttaccggccccggttaccctacgggtaccggggttccctgtaccgttaccgttcttaccgcggttacgtccgtaaaccggttaagtccgaacgggtaccctaaaccggcccggttacctcccgtacggtaccgtcgtaccggtacggtacccttaccggacgtacggtacggagacgtacggaggtaccttaggtactttacgttaccgtgacgtactacgttactacgttgtaccgagaccgtcgtacgtaccttcgtaccggttgacgggtaccggactacgtccgtcggtaccgtacgtcggaacgaccggtaccgaaccggtcgtacccgttacccggtccg

SEQ ID NO: 119461 - DNA, 801 bp, Homo sapiens
  misc_feature: GYAE6OF02H413J.5.86.H09.1.454.CMB.1.raw
  modified_base (166)..(166): a, c, t, g, unknown or other
  misc_feature (166)..(166): n is a, c, g, or t
  modified_base (585)..(585): a, c, t, g, unknown or other
  misc_feature (585)..(585): n is a, c, g, or t
tcagatcagacacgcacgaccggtgctcgatttagtgctatagacttgggtttggggggctggggtctcaggaggcagcgctctcaggactcaccaccatggcctgggctctgctcctcctcacccttcctcactcgaggtcacgtagggtcctgggccctagtcncggccctgactcgacgtcccttcccgtcgtcggttccgggttactcctagggaccagtcacgtccaacctactccgtacctcgcctaacgtcgggaaccagccgagttacgacgttagtttcggtaccgtttaacttaaccgtacttacgttccgttacccgttaacggtaaccctaaacctaacgtaacctaccgaacgggtaacccaaacccggtaaccccccgtaaacgttcccggtttagttaacttttccggaggtaacgtaccgttaaggtaaccggtcccggtcccttacggaccgggggtttccctaggtaccgtccggttctttacgtacgttcggtacgtaccgtaaggtccgtacgaccgaaccgtacgcccgttaccgtcgtacccgtcttccggacgtaccaccgngaccgtagaggtacgtggaacggcttacgtacgttacgttacttcgacctagttccgttaagttgttacgacggtacgtaccgtacgtaactttacgttaccggtcgggttacccggaccggggttaagaaccggtacgcgttacccggtaccgttacggttaccgtaccggtacggaacccgtacggttcccgaccccggttaccccggtaaccg

SEQ ID NO: 119462 - DNA, 687 bp, Homo sapiens
  misc_feature: GYAE6OF02GSHQ4.5.86.H09.1.454.CMB.1.raw
  modified_base (204)..(204): a, c, t, g, unknown or other
  misc_feature (204)..(204): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacgagggtcctgggcccagtctgccctgactcagccctccctccgcgtccgggtctccgtggacngtcagtcaccatctcctgcacgtgggaccagctagtgactgtttggtacgttaataactatcgttcctccgtaggtaaccaactaacactaccgaaggaaccaaacccgacccccctaaaagtcgtagtactttcgtaggacggtacgtaaggtaacggccggtccgtacggacgggttccctagaccttcgtccttcgtcgtcggtacctacgaacgttcgtacggacctaaccgccggtcccttcccgtacgtacccgtcgtcgtcggcctaccgagtaccgtggaggtgtacgggacggtacgttagtaaacgttacgttacgtcgactacgtcttacgtagttcgacgtacggtcgtaacgttaccgttacgttaccgtaccgggtcgggaacggtacgaaccggtcgtaccggtaccgttaccggtacggtacgtaccgtaccgacccggtacgtcccgtaccccggtccccgtacgg

SEQ ID NO: 119463 - DNA, 791 bp, Homo sapiens
  misc_feature: GYAE6OF02G01AS.5.86.H09.1.454.CMB.1.raw
  modified_base (178)..(178): a, c, t, g, unknown or other
  misc_feature (178)..(178): n is a, c, g, or t
  modified_base (281)..(281): a, c, t, g, unknown or other
  misc_feature (281)..(281): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcacccgtctacactcgagggcacgagggtcctcgggcccagttctcgccctgactcncgtccctccctccgcggtccgggtactccgaggacacggtcacggtccacatcctctagcagtcgggaaccagctaggtacactattggttaccttataactntcgtcctactacggttaaccaaacaacgtactaccgaacgggactaaaacccgtacccccgtaaagttcggttactaacgttttccgtaggtacgtaaccggtaacgtaacccgggtcccggtacccgttacggtaaccgggggtccccttaggaacttcccggttcttcgttaacgtccggtacctacgtaacgtccgttaggaaccctaaaccggtccgttacccgtaccccgtaaggtacccgtccgttccggtaccggtaccggtaccttaaaccggacgttaggggaacggttaacggcgggtacgtacgttaacggtaacttaacgttaccgggttataaccgtcgtaccttacgtaggttaccgactaaccgggacgttaccgggactttactaacccggttccggtacgggccgggtaacgaaccgtaggtactacccgtaccggttcaacggttcccgaacggttaacccgaacggtccccgttcccgtaacccggtccgg

SEQ ID NO: 119464 - DNA, 777 bp, Homo sapiens
  misc_feature: GYAE6OF02H84M5.5.86.H09.1.454.CMB.1.raw
tcagatcagacacgcacgaccggtgctcgatttagtgctatagactttggggtttgggggctggggtctcagggaggcagcgctctcaggacgtcaccaccatggcctgggctctgctcctcctcaccctctcactcagggcacagggtcctgggcccagtctgccctgactcacgcctcccgccgcgtccggtctcctggacagtcagtcaccatctctgcacgtcggaacagcagtcgactacgttggttaccgtttaataaacgtatcgtcctacgtaggtaacccaaacaactactaccgaacggtaacccaaaaccgaccccctaaaacgttccgttacgttaacgttttccgtacggtaacggttacgtaacggttaaaccgggtccggaccccgttaacggggtaccggggttcccctaggtaccgttaccgtccgttttcgtaccggttcggtaacccttaacccgtaaacggtccgtacggtaacctaaaacccggtacccgggttcccctttaccccgggtacggtaccccgttcgttacccgggttaccgggtaccctaccgtaacgtaacgtaagggaacggtacgtacgggtacgtaccgttaacgtacttaacgttacgtacgctaacgtcttacgtacgttcgacgtacggactacgtacgtactcgttacggtacggacgggaacggaactcggacgttaccggacccgttacggtaacgtacgaccggtaccgtaacggtccgtaccccgtccgtaaccg

SEQ ID NO: 119465 - DNA, 698 bp, Homo sapiens
  misc_feature: GYAE6OF02IUL6D.5.86.H09.1.454.CMB.1.raw
  modified_base (563)..(563): a, c, t, g, unknown or other
  misc_feature (563)..(563): n is a, c, g, or t
  modified_base (609)..(609): a, c, t, g, unknown or other
  misc_feature (609)..(609): n is a, c, g, or t
  modified_base (616)..(616): a, c, t, g, unknown or other
  misc_feature (616)..(616): n is a, c, g, or t
tcagatcagacacgcacgaccggtgctcgatttagtgctatagacgttgggtttgggggctggggtctcaggaggcagcgctctcaggacgtcaccaccatggcctgggctctgctcctcctcaccctcctcactcgagggccacgacgggtcctcgggcccaggtctcggccctgactcacgtccctccgtcgcgtccgggtctccgaggactcgacgtacgaccacctactcgtcccgtagccgaacgtcggggaaacccttcggagtacgtaccggtaacttggtttacggttcgtttaaacgtaaccttagtaccgttcctaccggttacggtaaacccaacgtactaacggtaccaggacctaaacccgacccctaacgtcgtacggttacttcgaggacgttacggacgttaacgcccgtcccgtacggtacggggtccctaggacgttccttcgtaccttcggccggtaccgtacctaacggtcggtacgtaccgaaacccggtcctcccgaccgtccgaaccgttcgtccggacgtacgtcgacgtcgtgtacgngtaggcgtgtacgtactttagaccgtctactacgacgtatcggtancggtacncgttacgcgtacgtctaacgttggacgacgtacgcggtcacgtcgtacgtacgaccggcacgttccgccgtcccgtccgtcg

SEQ ID NO: 119466 - DNA, 811 bp, Homo sapiens
  misc_feature: GYAE6OF02JRH90.5.86.H09.1.454.CMB.1.raw
  modified_base (125)..(125): a, c, t, g, unknown or other
  misc_feature (125)..(125): n is a, c, g, or t
  modified_base (183)..(183): a, c, t, g, unknown or other
  misc_feature (183)..(183): n is a, c, g, or t
  modified_base (207)..(207): a, c, t, g, unknown or other
  misc_feature (207)..(207): n is a, c, g, or t
  modified_base (355)..(355): a, c, t, g, unknown or other
  misc_feature (355)..(355): n is a, c, g, or t
tcagatcagacacgcacgaccggtgctcgatttagtgctatagacttgggtttgggggtgctcgatttagtgctactagacttgggtttgggatctacgttgcaggtgtaggtctgggtccctgngactctcctgtgcagcctctggattccacctttactgattttggcatgacgtggtccncaggctccgagggagggctggacnggtctcgacaaatagttaagtaggtaaaggctaagtactaacgaacgtaacctacgacacgtaactccggtggaacggggtccgttacacccgtacgtacgagacgacaccgtccgggacacggtcgtacctactacacgtacgaacncgaccgtagtacggacggaccggtacggaccgtaccggtccgtaacgttaacgttacgttaggtacggtaggtaacgggggtaaacggtcgggggtaactaaaggtttcgggaacccgttcggtacggggacccgtaacggggtacccggttaggtacccggtaccggttaccccgttccgtaccgtacccggccccgttaaccaacccggaaccgggtccctaaccggttcccggttaccctttccccgggtccggtcccgtacccgggtccgtccgtaccggtacggaccgtccgaacccttcggaaccggtcgtaccgaccggaccggtacccgccggtttaccgggaccgtcccggtaccgtaacgggttccgtaaacggggttcccttaacccgggtttcccgtacgttccggtacccgttaggtttccgtaccgggtccggtaaccgggg

SEQ ID NO: 119467 - DNA, 704 bp, Homo sapiens
  misc_feature: GYAE6OF02JXAPG.5.86.H09.1.454.CMB.1.raw
  modified_base (149)..(149): a, c, t, g, unknown or other
  misc_feature (149)..(149): n is a, c, g, or t
  modified_base (164)..(164): a, c, t, g, unknown or other
  misc_feature (164)..(164): n is a, c, g, or t
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (421)..(421): a, c, t, g, unknown or other
  misc_feature (421)..(421): n is a, c, g, or t
tcagatcagacacgcacgaccggtgctcgatttagtgctatagacgttggggtttgggggctggggtctcaggaggcagcgctctcaggacgtcaccaccatggccgtgggctcgtgctcctcctcacccctctcactcgagggcacgngggtccgtgggcccngtctcgccgtgactcacgcctcccgtcgcggtccgggtctccgtggacngtcagtccacntctctcgacgaccgtacggtaaccagtcgaaggttcgacctaagtttcggtaacgtttaacgttaactagtcgttccgtacgttacggtaacctaaacaactcgtaccacgggtaaacctaaaccgaccccctaaacgtcggtacgtactttaccggagtacggtacgacgtaacgccggacctcggacggtaccgngtacgtcgtacgttctcgccggtactaccggttactccggtacggtaaccaaccgccggtacccgtccgtcgtacccgtgtccgcgtacctccgtacgacgtggtaggtactcggaagtcgtaagtccttaagtacgactgagtcccttaggtctaccgtagcgtagtaccggtccgttaactaccggttacgttaccgggacgggtaccgacggtacctaaggtccggttaaccgccgttaccgcgtaaccgcgtaacccggaccttcccgtaccggtcccg

SEQ ID NO: 119468 - DNA, 841 bp, Homo sapiens
  misc_feature: GYAE6OF02HYNAI.5.86.H09.1.454.CMB.1.raw
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgagggtcctcgggcccagtcctgccctgactcacgccctccctccggacgtccgggtcctcgtacggactacgtcagtcaccatcctcctgccacgtcgggacctagacgagtcgaactagttcggttacgttaataactatcgtctaccgtacggtaacaacaacactacgaacgacaaaccgacccctaaacgtcgtagttacttacgtaggtacggtacgtaacgttaacggccgtaccgtacgaccggggtcctaaggcgtacgtccttcttcgtaccgtacctaaccgtagtcgtagaacctaaccgcccggtacccgtacccgtacggtacccgttcgtacggtcggtaccctaccgtacgtaacgtacggtacggacgtacgacggtactacgtaacttacgttaccgtagtaccaaacgttccgttacgtaacgtttccgggaaccgaccgggtacgttaaccggttaaacccgtttacgttaaacccgggtttttccgggaaccggggggttacccgggtaaaacccgggggttaaaccggtaaaccgggttaaaccggttttccccggggttaaccccgggtttaaaccggttaaccgggtttaaccccgggtaacccgggaaaccccgggtttaaacccgggtaccccgggtttacccccccgggttaaccccggtttaacccccggg

SEQ ID NO: 119469 - DNA, 857 bp, Homo sapiens
  misc_feature: GYAE6OF02ITAN6.5.86.H09.1.454.CMB.1.raw
  modified_base (142)..(142): a, c, t, g, unknown or other
  misc_feature (142)..(142): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcgaggcacngggtcctgggcccagtctgccctgactcacgccctccctccgcgtcctggtcctccgtggctagtcacgtcaccatcctcctagcctaacgtgggaccaggcctagtcaactgtttcggttaccggttaataacttagtcgttccgttaccgtacggttaacccaaactaaaccacgttacccgagggaacccaaaaacccggtaccccccgtaaaaacgttcggttacgtaaacgttttccgtaacgggtaccggttacggtaacgttaaaccgggtcccggtccccgttaccgggtaacggggttccccgttaggtaacccgttcggttccctttccgttcggtaccggtttaccctaccgtaaacgggttccgttaccggaaccgaacccgtaacccgggttcccctttaacccggtcccgtaacccggttaccggtttaccgttacccggggtcccgttaccgtaaaccgggtacccgttaagggaaccgggtagttacgggtaaacgggtccgttacggttaacccttagtttaacccgtcggtaccgtacgccgttaccgttagtttccgacggtaccgtacgtacccggtaacgttacgttaccgttccggttacggaccgggtacgggtaaaccgtcggtaccgtaccgtaccgttaccggaaccggttccgaaccggtcccgtaacggtcccgaacccgtccccgg

SEQ ID NO: 119470 - DNA, 720 bp, Homo sapiens
  misc_feature: GYAE6OF02HIQ7A.5.86.H09.1.454.CMB.1.raw
  modified_base (331)..(332): a, c, t, g, unknown or other
  misc_feature (331)..(332): n is a, c, g, or t
tcagatcagacacgcacgaccggtgctcgattttagtgctatagacttgggtttgggggtgctcgatttagtgctatagacttgggtttgggatctacgttgcaggtgtaggtctgggtccctgagactctcctgtgcagcctctggattcacccttttactgattttggcatgacgtgggtccgcaggctccagggaggggctggactggctctacaaatattaagtggtaaaggcaatataacaagactacacagacctccgtagaacgggccggttcaccacctcgagacgacaactccgaggacacggtgtacctacacatagaacnncctagacgagccgaggacgacggcgtatattagtgtgtgaggggaaacgtggggtactaagtttcggaccgtcggtacggggccgtaacggggtaacccgtgggtacccgtacccggtccgttcccgtaccgaccgtccccgtacccaacccgaaacccggggtcccctaaccggtcccggtttccccgttaccccccgttccgggcccgccccgttacgcccgttaccgaccgggtaccgcccgtaacccgtccgtaacgaccgtaccgaaccgaccgggtccgggaccccgtcggggtccgtccgggtccggttacgggtaccgtaaaccgggtacctttaaccgttcccggttagtccggttacgtacgttacgtggtaccgggg

SEQ ID NO: 119471 - DNA, 782 bp, Homo sapiens
  misc_feature: GYAE6OF02FYIR5.5.86.H09.1.454.CMB.1.raw
  modified_base (216)..(216): a, c, t, g, unknown or other
  misc_feature (216)..(216): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctcctcactcagggcacgacgggtcctgggcccagtctcgccctgacctcagccctcccgtccgcggtcccgggtctcctaggacagtcgngtccacattcctcctggacctacgtacgggaccagtcgacgtcgtaacgtattcggttacgtttaataacttagtcgttccttaccgtcggttaaccaaacctaacgaactaccgacggaacccaaaccgaccccaaacgtcgtaggtactttacgaggtacggtactacggtaaccgggacccgttccggtaccggaccgggggttacctggtaccgtcgtaccgttcgtcgttccggtcctttacccgaacggttcgaccgtaaccgtaccgtacccgggtcccttaccgtacgtcccgttacgtccgtcgggtacctaccggtacgtacggtggtaacggtagtacgggtacgttcctaacggttaaccttaagttccggtagtaaccgtcgttaacgttccttaaggttcgacgtacgtacgtcgtaccgttacgtaccgttcggtacccgggacgtaccgggtaacgtaccgtacggtttaaccggtcccgttaacggtacccgggaacctacccgggtacccggaaccgggttccccgtaccccgtccccgggttacccg

SEQ ID NO: 119472 - DNA, 720 bp, Homo sapiens
  misc_feature: GYAE6OF02FJLOC.5.86.H09.1.454.CMB.1.raw
  modified_base (212)..(212): a, c, t, g, unknown or other
  misc_feature (212)..(212): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcagggcacagggtcctgggcccagtctgccctgactcagcctccctccgcgtccgggtctcctggacagtcagtcaccntctcctgccacgtgggaccagcagtcgactattcggtcgttaataactatgttctccgtacgtaccaactaacactaccaggacaaaaccggacccccaaacgtcgtacgtacttttacgtacggtaggttaccgaggtaaacggccggtacccccgtacgtacgggggttcccctggtacttccggacttccgtacgttcggtcctaccgaacgttactacgggacctaaacgacccggtcccttcccgtagtacccgttcgttccggtacggggtccttaccggacgtaacgttacggtaaccgggtagttaacggagggtcgttacgtaacgttacttaacgtcgacctacggtcttactagttcgagacgtaccgtacgttccgtattccgtacgttaccggggtaccgggaacggtaccggtaaacgtcggttaaccggtaccgttacggtacggtaccgacccggttcccgaacggttcccgtaccccgaccccggttcccg

SEQ ID NO: 119473 - DNA, 767 bp, Homo sapiens
  misc_feature: GYAE6OF02G7JS1.5.86.H09.1.454.CMB.1.raw
  modified_base (280)..(280): a, c, t, g, unknown or other
  misc_feature (280)..(280): n is a, c, g, or t
tcagatcagacacgcacgaccggtgctcgatttagtgctatagacttgggtttgggggctgggggtctcaggaggcagcgctctcaggacgtcaccaccatggcctgggctctgctcctcctcaccctcctcactcagggcacgagggtcctgggcccagtctcgccctgactcacgccctcccgtccgcgtccgggtctccgtgactagtcagtccacctatcctcctgcctaccgtcgggaccacgcgtagtcgactaggttcggtacttaataactnttcgtccttccgtacgtaacctaacgaactacgtaccgaaggaccaaaacccgaccccctaaagttcggtaacgttactttcgtacggtacggttaccaaggtaaccggcccgtacccgttacgggtaccggggtccctagacgttcccggtacttcgtcgttaccggtccttaccggtaacgttccggtacgaacccgtaaccggtacccggtccccttacccgtccggtacccgttcggtcccggtccggtccttaccggaacggttcggtacgggaacggttaggacgggtaccggtaccgttaacttaacgtttacgtaccggttacggaccgttacgttacttacgttcggtttcgaaccggtacgtacgtaccggtttctaaccggttcgtaccggttcgggacgtaccggtacgtacgtaccgtaccgtaccttcggtataccggatacccggacgttacggtcccgtccgttaccccgg

SEQ ID NO: 119474 - DNA, 698 bp, Homo sapiens
  misc_feature: GYAE6OF02I8L6U.5.86.H09.1.454.CMB.1.raw
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcaccttttactgattttggcatgacgtgggtcccgccaggctccgaggggaaggggctggactggctctacaaatattaagtaggtaaaggcaatataacaagactaacacagacctcgtagaacgggtccggttacaccacctcgagagaaccaacgtccgagggacaccggtactaccctacacatacgaacagcctgagacgccgaggacacggcgtaatatattgtagtggaacggggtaacgtggggactaagtttacgaccggtcgtacggggaccgacgggtaacccgtggtccgaccgtctccaccgcgtccctacccaccggtaacggcccctacgttcccggttacccttcccccggtcgggtcccgtccccgtcgcccgtacccggaacggaccgtacccgacccgtacccggacgaccggtcgaacccggtacgggcccggtacccgcggggtcctcccggccggtacgggtaccgaacggttcccgttacccgtttcccggtacgttccgttacggcttccggtaggtacccgggg

SEQ ID NO: 119475 - DNA, 718 bp, Homo sapiens
  misc_feature: GYAE6OF02F93N7.5.86.H09.1.454.CMB.1.raw
  modified_base (124)..(124): a, c, t, g, unknown or other
  misc_feature (124)..(124): n is a, c, g, or t
  modified_base (362)..(362): a, c, t, g, unknown or other
  misc_feature (362)..(362): n is a, c, g, or t
  modified_base (709)..(709): a, c, t, g, unknown or other
  misc_feature (709)..(709): n is a, c, g, or t
  modified_base (716)..(716): a, c, t, g, unknown or other
  misc_feature (716)..(716): n is a, c, g, or t
tcagatcagacacgcacgaccggtgctcgatttagtgctatagacttgagtctgggggaggcttggtacagcctggggggtccctgagactctcctgtgcagcctctggacttcaccttttacngtattttggcatgacgtgggtccgcaggctcgagggagggctggactggctctacaaattagttaagaggaaaacgcaaattactaacgaagactaacacagacctcggtaggaacgggtccgttacaaccgacctaggagtaacaacaaccgtcgacgggactacggtcgaacctacacagtacgaacacgctagagacgaccggtagacgtacggtacgtagttacttagttaggngtaagggaaacggggtaaaccggtgggggtaacttaagttcggaaccgtcgggtacgggaccgtaacgggtacccttggaccgtaccgtctacccgtactacgccctaccgaaccggaaccggtcccagttcccggttaaccctccccgtgggcccctccgtacgtacccgtaccgaagggtaccgaccgacccgttacggaacgaacgtcaaccgacgggtccgtacccgtcgggacctcggtaccgtacggtaacgaaccggttccgttaacccgttccgagttaccgttagacgttcgacgggtacggccgggtacgtacggacgaaccggttcggactaggcncgagtcncg

SEQ ID NO: 119476 - DNA, 593 bp, Homo sapiens
  misc_feature: GYAE6OF02JAISE.5.86.H09.1.454.CMB.1.raw
  modified_base (170)..(170): a, c, t, g, unknown or other
  misc_feature (170)..(170): n is a, c, g, or t
  modified_base (199)..(199): a, c, t, g, unknown or other
  misc_feature (199)..(199): n is a, c, g, or t
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
tcagatcagacacgcacgaccggtgctcgatttagtgctatagacttggggtttgggggctggggtctcaggaggcagcgctctcaggacgtcaccacatcggcctgggctctgctcctcctcaccctctcactcaggcacgaggtcctgggcccagtctgccctgactnacgcctcctcgcgtccggtctcctggacngttcagtaccactactctcctgcctagtcgggacctagctagtgactagttcggtactataactntcgtctcgtagtaccanacntcagcaacgcccaatcgntcttgngagtacagtacgcggtccncggacggtccagtactcgtntcgtntcggctacgtaacgtcgcggtaccaaccgccggtccttacccgagtcccgtcgtcgtcggtcctaccgacgtacgtggtacgtgtacggtcgcttaacgtacttgttcctacgactcgtctcgttagttcggctcgccgtacgtacgttaactcggtcgtacgggaccggtagtaaccgagtccgtacggtccggtaacgtcgtacgaccggacctacggtcccgtaccggcccgttaccg

SEQ ID NO: 119477 - DNA, 854 bp, Homo sapiens
  misc_feature: GYAE6OF02GPSLU.5.86.H09.1.454.CMB.1.raw
  modified_base (445)..(445): a, c, t, g, unknown or other
  misc_feature (445)..(445): n is a, c, g, or t
  modified_base (843)..(843): a, c, t, g, unknown or other
  misc_feature (843)..(843): n is a, c, g, or t
tcagatcagacacgcacgaccggtgctcgatttagtgctatagacttggggtttggggggtgctcgatttagtgctatagacttgggtttgggatctagttgcaggtgtaggtctgggtccctgagactctcctgtgcagtcctcgtggtattacctaccttttactgttagttttcggctagtggtacggtcggggtccgccgtaggtccgtaccgggaagggggaaggggtccgtacgggcgtcggaccttctaacgttaaaattattaaggtaaagggtaaaggacctaaataacgtaacgtaaacgtaactaacgaacaacggtaccgttcggtaagggaaccgggttccggttaccaacccgtaccggtaggaacgaacgaactaaccgtaccggaacggggaacctacggttacgtaacctacaactaggtacgtaacnccgaccgtaggaacgcggtaaccggacggaccggtacggtacgttaattacgttggttagtacgggtaaggtaaccgggggtaacggtcggggtaactttaacggtgggaaccgggttaccggggtacggggaaaccggtaacgggggtaaccccttgggtacccgttacccggttccggttacccgaccgtaccgtaaccccggtcccgtaaaccggaacgggtccccttaccgggttcccggtttaccccgtccccgggtcgggtacccctcgtccgtaccgaccggtacggccgaccgtttacccggcgtacgacgtaccgacggtccgcggccggtacgcgccggtaccgaggtacccggtaacgtccgttacccgttcggcgtctacggttcnggttacggcgg

SEQ ID NO: 119478 - DNA, 703 bp, Homo sapiens
  misc_feature: GYAE6OF02FYKMK.5.86.H09.1.454.CMB.1.raw
tcagatcagacacgcacgaccggtgctcgatttagtgctatagacttgggtttggggggctggggtctcaggaggcagcgctctcaggacgtcaccaccatggcctgggctctgctcctcctcaccctcctcactcagggcacagggtcctgggcccagtctgccctgctcagcctccctcgcgtccgggtctcctggactagtcgagtccaccatctcctgcgactgggaccagcagtcgtacatttggtcgtttataaacgtatcggtctcctgtaaccgaacaacatccaggcaaacgaccccgaactcgtatactttcttagacggtcaagtaacgcggaccctacgacgggggtccctacggtacgaccggtcttacgtacgtcggaccgttacctaacgtccgtcggtacgaaaccgccggccctcccgtacgaccgtaccgtacgtccggggacctccgacgtaactcggaacgtacgtaggacggtcgttaacgtaccgttaacgtttacgtcgactacgtaccgtacgtagtttaccggagtacgggtaccaggtaaccgttaaccgttactaccggttaccgggtacgggtaacgggtaaccgaaaccggtccgttacgggtacccgttacccggtaacgggtcccggttaacgacccggtaccggtacccgtaccgtcccccgttaacccgg

SEQ ID NO: 119479 - DNA, 707 bp, Homo sapiens
  misc_feature: GYAE6OF02HQZAP.5.86.H09.1.454.CMB.1.raw
tcagatcagacacgcacgaccggtgctcgatttagtgctatagacttggggtttgggggctggggtctcaggaggcagcgctctcaggacgtcaccaccatggcctgggctctgctcctcctcaccctctcactcagggcacagggtcctgggcccagtctgccctgactcacgcctccctcgcgtccgggtctccgtggacagtcagtccaccatctcctgcctacgtcgggacctagcagtcactagtttggtacttaataactatgtcctccgtacggtaccaaacaactacgtccaaggaccaaaacgacccccgaaacttcgtagtactttcgtaggtacggtacaggtaacgccggtcctacgacggggtcctgtactccgtcttctcgtcggctcgaagtctacggaccaacgtaccggtccctaccgtacgtaccgttcgtaccggtcggtccttacgacgtacgtaggaacgtgtaggacgtcgttacgtacttacttacgcgtacgtacgcgttactacgtttcgacgtacggtacgtaacgtaccgttacgttaccgttacggttaccggggacgggttaaccgggtaacccgtaacggtcccgttaacgggtaccccggttaaccgttaccgggttaccgaacccggtacccggtaaacccggtcccggttaccccggtcccccggttaacccgg

SEQ ID NO: 119480 - DNA, 726 bp, Homo sapiens
  misc_feature: GYAE6OF02JHK65.5.86.H09.1.454.CMB.1.raw
  modified_base (308)..(308): a, c, t, g, unknown or other
  misc_feature (308)..(308): n is a, c, g, or t
  modified_base (583)..(583): a, c, t, g, unknown or other
  misc_feature (583)..(583): n is a, c, g, or t
tcagatcagacacgcacgaccggtgctcgatttagtgctatagacttgggtttgggggctggggtctcaggaggcagcgctctcaggacgtcaccaccatggcctgggctctgctcctcctcaccctctcactcgacgggcacgacgggtcctcgggcctacgtctcgccctcgactcgacgcctcccgtccgcggttccgggtctccgtgacacgtcacgtaccaccatcctctcgacctcggtacggaccagcgagtcacgtgttggtacttaataacgtactctcttacgacgtaaccaacaacngtaccgaagaccaaacccgcccgaaacttcggtacttacgttgtacgtacgtacgtaacggtacggccggtaccgcggtacgggtcctagtacgtacgttcttccgtcgtacggtacctaacgtacgttacgtccgaacgaacccggtccgtacccgtttacccgaccggttaccttcggttcgtcccggtactaccggacgttacggtacgtacggtcggtacggtcgtaaccgttagttaaccgtttcgtacgtctaaccgtctcgttaagtnttaccgaccgtaggacccgttaaacgttacgttcttaaccgggttacgggtaccgggtacgaacggtacgaccgttacgccgttacccggtggtaacccgtcgtacccgtacccgggtactcccgggtacccgtcccgttcgg

SEQ ID NO: 119481 - DNA, 763 bp, Homo sapiens
  misc_feature: GYAE6OF02F12FN.5.86.H09.1.454.CMB.1.raw
  modified_base (397)..(397): a, c, t, g, unknown or other
  misc_feature (397)..(397): n is a, c, g, or t
  modified_base (433)..(433): a, c, t, g, unknown or other
  misc_feature (433)..(433): n is a, c, g, or t
tcagatcagacacgcacgaccggtgctcgatttagtgctatagacttgggtttgggggtgctcgatttagtgctatagacttgggtttgggatctacgttgcaggtgtaggtctgggtccctgagactctcctgtgcagcctctggattcctaccttttactgattttggcatgacgtgggtccgccaggctccgaggggagggtcgtggactggctctacaaatataatggtaaagcaatatacaagactacacagaccgtccggtagaacggggtccggtacacccaccgtcgagaagaacctaaacctccgacggggaccacggtacgtaacctaacaccagtacgaacacgcctagacggacgccggaggaccacggccttataacttattgngtaggacggggaacgtggggacgtagttcgaccggngtaccggggaccgtacgggaacccgttcgggtacgacccggttaccctccgttaccgacgtccccgtaccgaacccgaacccgggacccctacggtaccccggttacccgttccccccggtcggacccccgtccccgtacgccccgtaccgaccggtcgaccccgtacccgtaccggacgtaccgaccgtaaacccggcggacccgggaccccggttcgggaccggttcgttaccccgggtcggttaacccggggaccggtaacccggtttaccccgtttcccgggttcgtttacccggtcggttaaccgttcggaccgggtacccgggg

SEQ ID NO: 119482 - DNA, 542 bp, Homo sapiens
  misc_feature: GYAE6OF01EHVUB.13.63.F08.1.454.CMB.1.raw
  modified_base (529)..(529): a, c, t, g, unknown or other
  misc_feature (529)..(529): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtgatcagttgttacaacggtgacacagtactttgcacagtaagtttgagggcagagtcaccctgaccacagacacatccgacgaaacacacgacctacataggaactgaaggaatctagacatctagacgacacggcatatattactgtgacgagtaaggtacggttttgggcgtcggacctcgtctgagtagtcgtgggcgagggacagtcggtcacgtntcttcgcgtcccg

SEQ ID NO: 119483 - DNA, 529 bp, Homo sapiens
  misc_feature: GYAE6OF01B1FDU.13.63.F08.1.454.CMB.1.raw
  modified_base (487)..(487): a, c, t, g, unknown or other
  misc_feature (487)..(487): n is a, c, g, or t
  modified_base (523)..(523): a, c, t, g, unknown or other
  misc_feature (523)..(523): n is a, c, g, or t
tcagtcacgtactacacgaccggtgctcgatttagcgatcgtataaggggacccaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgagaatctgacatctgacgacacggccatatattactgtgcgagtaaggtacggttttgggcgcggactcgtcttgagngtcgtgggcgagggacaagtcggtcacgtctctcgngtcccg

SEQ ID NO: 119484 - DNA, 735 bp, Homo sapiens
  misc_feature: GYAE6OF01DQSF1.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcattcctttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgcgtggggtggatcagttgttacaacggtgacacagacttttgcacagaagtttgaggtcagagtcaccctgaccacagacacactcccgagaaacacacgtcctacgactaggtaaccgagtaggaaagtactacggtaactaacgtacgttacgaacggaacccgtaaaccgggacccgaacgttaacttaaacgtttaacgttacggtttagtaccggtaaaggtaaacgggggttaaccggggttttttacggggggtttaccggggaccgggttacccgggttaacccgtttccgtttacggttaacggtaacgtttcgggtttacgggggaccccgggttaaaccggggggaacgggtaaaaccgtttacggggtacccggtttaacccggacccgtttcccttttacgtacccggttacccccgg

SEQ ID NO: 119485 - DNA, 644 bp, Homo sapiens
  misc_feature: GYAE6OF01DZM9Q.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgagttcagttggttcagtctggaggagggtgaagaagccgtggggcctcagtgcgaggtcgcctgcgagggcctctggttaccctattttcgactaactttggctatctacgtgggtgcgacgacggccccgtggccacggccttgagtcgcgtgggtgatcgtagttgtacgaacggtgacacgagtactttgcagtagtagtttggaggcagacgtcacctgaccacgagacactactccgacgaacacacgcctaacagtacggaactaggaagaatcgtagactagtcgtagaacgaccgacggacctaagttaataactttacgtaggtaggtacggaagggtaacgggttaacggggttttcggggaccggtaccggtaccttccgttcgtacggtagtaccgtcgggtacgggaccggaaggggtaacctaaggttcggtaccgtaccccgttgttacccttcgaccggtaccccg

SEQ ID NO: 119486 - DNA, 549 bp, Homo sapiens
  misc_feature: GYAE6OF01APYKK.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgcgtggggtgatcagttgttacgaacggtgacacagtactttgcacagtaagtttgagggcagagtcacctgaccacagacacactccgacgaacacacgacctacatagaactgagaatctgacatcacgacgacacgcatatacttatgtagcgagtaaggtacgggttttgggcgacggtacctcgtctagagtagtcgcgggacgacggggactagtcggtcaccgttctccgttgtcgtcccg

SEQ ID NO: 119487 - DNA, 669 bp, Homo sapiens
  misc_feature: GYAE6OF01EC9WM.13.63.F08.1.454.CMB.1.raw
  modified_base (243)..(243): a, c, t, g, unknown or other
  misc_feature (243)..(243): n is a, c, g, or t
  modified_base (273)..(273): a, c, t, g, unknown or other
  misc_feature (273)..(273): n is a, c, g, or t
  modified_base (365)..(365): a, c, t, g, unknown or other
  misc_feature (365)..(365): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacnttttcgactaactttggcatctactgggtncgacaggccctggccacggccttgagtcgcgtggggtgagtcgaggttgttacgaacggtgacacagactttgcacagtaagttgaggcagngtcacctgaccacgagacacacgtcccgacggaaacacgacgacctaacgactacggaaactggaacggtaactcgtagaacctactacgtacgaaccgacgtaaccggacctaattacttaacgttaacgtgtacggacggtaagggtaaacgggtttacgggttttcggggaccggaccgggtaccgttaccgttcgttacgggaacgtagttccgggtacgggggaccggtaacgggggaactaaacggttcgggttaaccgtacccggttaccgttaccgtttccgaacggtaccccccg

SEQ ID NO: 119488 - DNA, 531 bp, Homo sapiens
  misc_feature: GYAE6OF01AM9EF.13.63.F08.1.454.CMB.1.raw
  modified_base (273)..(273): a, c, t, g, unknown or other
  misc_feature (273)..(273): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
  modified_base (518)..(518): a, c, t, g, unknown or other
  misc_feature (518)..(518): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtncgacaggcccctggccacggccttgagtcgctggggtgatcgagttgttacaacggtgacacagactttgcacagagtttgaggcagagtcaccctgaccacagacacactccgacgaacacacgcctacataggaacctgaggaatctagacatctacgacgacacggccaatatacttactgtgcgagtaggtacggtttgggcgcgacgtctgtgngagtcgngggcgngggacagtcgtcncgtntctngtccc

SEQ ID NO: 119489 - DNA, 944 bp, Homo sapiens
  misc_feature: GYAE6OF01D35IV.13.63.F08.1.454.CMB.1.raw
tcagtcacgtactacacgaccggtgctcgatttagcgatcgtataaggggacccaaaaaaccacacccctccttgggagaatcccgtagatcacagctcctcaccatggactggacctggagcacttcctttttcgttggtggcagcggcaacgaggtgtccaccctgaggttcagttggtcagtctggaggagggtagaagagccgtggggcctcgaggtcgcgacggtccgcctgccgacgggtccttcgttacggttactacgttttccgaacgttaacgttttggctatccgttacgtggggtcgccggtaccgaccgggtcccccttggacccgaccgggtccctttggacggttccgtcgggtgggggtggtacttcgtacggtttacggttaaaccggtaaccgggttgaaccctacgtaggttaccgttttcgacctaacgtaagggttaaaggttttcgggaacggggtactaaggtaaccgttcccgaaccccgttacggaaccccaacgacggtaaccaacgtacctccccggaaccgaaaccaccgaccgtacccgtaaacgacggttaacggaaaccgttacgggaaaggtaaacgttcgtaacggtaacctaacgttaccggttaccggaaccggaacccgtaccgggtaaccctaaacgtttaacgttattttaaccggtggttaacgggaaccgggtaaagggggtttaaaccggggttttaacgggggtttttacggggacccgggttaccgggtaaccccgtttcccggtttacggttacgggtaaacgttacgggttacccgggggttaccgggggaacccgggttaaacgggggtaacccgttaaaccgggtttccgggtttaaccccggtaccccggtttaccgtttaccccggtttacccggtacccgttaacccccccggg

SEQ ID NO: 119490 - DNA, 697 bp, Homo sapiens
  misc_feature: GYAE6OF01BELN6.13.63.F08.1.454.CMB.1.raw
  modified_base (318)..(318): a, c, t, g, unknown or other
  misc_feature (318)..(318): n is a, c, g, or t
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagccgtggggcctcgagtgcaggtcgcctgcagggcctcgtggttactattttcgactaactttggcatctacgtgggtgcgacacggcccctggccacggccttgagtcgcgtggggnggatcgagttgttacgaacggtgacacagtactttgacacagtaagtttggaggcagagtccaccctgaccacagacacacgtcccgacaaacacacgtacctacagtacggaacgtaggaaggaactacgtacgaactagtaccgtagaccgaaccgaccggaccctaattaacttaacgttacgttggtacgtacggtaagggttaacggggttacggggttttacgggggaccggtaccggtacccgttcccgttacgttacgggtaacggttacggtccgggtaccgggggaccgggtaacggggtaaccgtaaacgggttcgggtacccggtacccggttccgtttacccgttaccggtcccggtaacccccgg

SEQ ID NO: 119491 - DNA, 557 bp, Homo sapiens
  misc_feature: GYAE6OF01AU2Q6.13.63.F08.1.454.CMB.1.raw
  modified_base (309)..(309): a, c, t, g, unknown or other
  misc_feature (309)..(309): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggngatcagttgttacaacggtgacacagactttgcacgagaagtttgagggtcaggagtccaccctgaccacacgacacatccgacgaacacagacctacatagaactgagaatcagacatctagacgacacgcatatattactgtgacgaggtaaggtacggttttagggcgccggactccgtcgttgagtagtcgtaggggaccgaggggactacgtcggtacaccgttcctcttccgacgtaccccg

SEQ ID NO: 119492 - DNA, 693 bp, Homo sapiens
  misc_feature: GYAE6OF01CGMYO.13.63.F08.1.454.CMB.1.raw
  modified_base (380)..(380): a, c, t, g, unknown or other
  misc_feature (380)..(380): n is a, c, g, or t
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcagtgcaggtcgcctgcagggcctctggttacattttcgactaactttggcatctactgggtgcgacacggcccctggccacggccttggagtcgctggggtggatcgagttgtacaacggtgacacagtactttgcacagaagtttgaggcagagtcaccctgaccanacgacacatccgacgaacacacgtcctaacagtacgggaaacctaggaaacgtactacgacaactcgttacgacgaaccgaccggaccgaactaacttacttaacgttacgtggacggacggtaaacggggttaggggtttttaacgggggtttaccgggccgggttacccgttaccgttaccggtttacggttagggtaaccgttacgggttccgggggtaccggggaaccggggtaaacggggtaacgttacgggttacccggtacccgttacccggttccttaccgttacccggtcccttaaacccccgg

SEQ ID NO: 119493 - DNA, 666 bp, Homo sapiens
  misc_feature: GYAE6OF01CE57K.13.63.F08.1.454.CMB.1.raw
  modified_base (347)..(347): a, c, t, g, unknown or other
  misc_feature (347)..(347): n is a, c, g, or t
tcagtcacgtactacacgaccggtgctcgatttagcgatcgtataaggggacccaaaaaccacacccctccttgggagaatcccgtagatcacagctcctcaccatggactggaccctggagcatcctttttcttggtggcagcggcaacaggtgtccactcccaggtgcaactggtgcaatctgggtctgagttgaagaaaccgtggggcctcagtgaaggtttcctgcaaggcgtctggatacacgttcactacttatggctatgaattgggtgcgacaggctccgtggacaagggcttgagtggagtgggatggatcgacatcaacacgtgggaacccaagtancgcccgagggccttcgacgagggtacggtttgtcctttccgtccgttggaccgtaccgtctcgtcaggcgtacgggtcgttatcgttaacaggtatacgagcaacggtacctaaagggcgtaggacggactacgttcgacctaattttacttacgtggtagtagtagtacgttattttccgtttaccgttggtaacccgtttagggttacctttaccgttcggtttcccgtttaagtacccgttaccggttacgggggtacccctaaaccgggggtaccccttaggggttacccacgggttccgttcccgttaccccgg

SEQ ID NO: 119494 - DNA, 697 bp, Homo sapiens
  misc_feature: GYAE6OF01BWCB4.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcgagtgcaggtcgcctgcgagggcctcgtggttactattttcgactaactttggctatctacgtgggtcgcgacgacggcccctggcccacggccttgagtcgcgtggggtgatcagtttgtacgaacggtgacacagtactttgcacagtaagtttgagggcagacgtcacccgtgaccacgagaaccacactcccgacgaaacaccgacgtaccctaacacgtacggaaccgtaggaacggtaactacgtacgaactaagttaccgtacgaaccggaaccgaaccggaccaattaagttaacttaacgttgtacggtacggtaaggtaacggggttacggggtttttcggggaccgggtaccggtacccgttccgttcgttacgggtacgtacggttccggtacggggtacccggtaacggggaaccgtaaggttccggtacgtacccggtttaccgttcccgtttacgtacccggtacccccg

SEQ ID NO: 119495 - DNA, 692 bp, Homo sapiens
  misc_feature: GYAE6OF01CWTLB.13.63.F08.1.454.CMB.1.raw
  modified_base (390)..(390): a, c, t, g, unknown or other
  misc_feature (390)..(390): n is a, c, g, or t
tcagtcacgtactacacgaccggtgctcgatttagcgatcgtataaggggacccaaaaaccacaccccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcagtgcaggtcgcctgcagggcctcgtggttactattttcgactaactttggcatctactgggtgcgacgacggcccctggcccacggtccttgagtcgcgtggggtgatcagttgtacgaacggtgacacgagactttgacacagtaagtttgagggcagacgtcacccgtgaccanacgacacactccgacgaaccacgacgtcctaactatacggaacctaggaaggtaactacgtacgaacacgttaccgtaggtaaccgaacgaaccgggaccctaacttaattaacgtttaacttacggtacgacggtaacgggtaacgggttacggggtttttacgggggaccggtaccgggtaccgttaccccgttacgttacggtaggtacggttcggtacgggggacccggaaacgggggaccgtaaaggttccggttaccgtaccccggttaccttaccgttccgtaccggtacccccg

SEQ ID NO: 119496 - DNA, 634 bp, Homo sapiens
  misc_feature: GYAE6OF01EOAPB.13.63.F08.1.454.CMB.1.raw
  modified_base (625)..(625): a, c, t, g, unknown or other
  misc_feature (625)..(625): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgctgcagggcctctggttactattttcgactaactttggcatctactgggtgcgacacggccctcggccacgccttgagtcgcgtggggtggatcgaggttcgttaacgaacgggtgaaccacgacgtaactttgaccacgaggtaagtttggacgggcaggacgtacacccgtgaccacgacgacgacacgtccgacgaacacacgacctacagtacggaactaggaagaactcgtacgactactcgtacgaacgtaccgaccggtaccattaatattacgtgtacggacgaggtaagggttacggggttttcggggacgtaccggtacgtccgtcgttacgtagacgttcggtacggggacggacggggactaaggtcggtacgtaccgtacctcggttccngtacccccg

SEQ ID NO: 119497 - DNA, 769 bp, Homo sapiens
  misc_feature: GYAE6OF01ED21A.13.63.F08.1.454.CMB.1.raw
tcagtcacgtactacacgaccggtgctcgatttagcgatcgtataaggggacccaaaaaaccacacccctccttgggagaatcccgtagatcacagctcctcaccatggactggacctggagcatccctttttcttggtggcagcggcaacaggtgtccaccctgaggttcagttggttcagtctggaggaggggtgaagaagcctggggcctcagtgcaggtcgcctgcgaggcctctggttactattttcgactaactttggcattctacgtgggtgcgacgacggcccctcggccacggtccttgagtcgcgtggggtgatctagttgttacgacggtgacacgagtactttgcacgagtaaggtttggagggcagacgtccacccgtacgaccacgaacgacacactcccgacgaaccacgacgtacctaacagtacggaacgtaggaagtaacttcgtacgtaacgtacttaccgacggtaaccgaaccgaaccggacctaacttaacgtttaacttaacgttcggttaacgggtacggtaaacggggtaaacgggggtttttaccggggttttttacgggggacccggtacccgggttaccgtttccccgttacggtttacggtaccggtaacggtttcccggggtaccggggggtaccccgggtaaacggggggtaaaccgttaaacgggttacccggggtttacccggttaacccccggtttaccgttttacccggtttacccgacccggttacccccccg

SEQ ID NO: 119498 - DNA, 553 bp, Homo sapiens
  misc_feature: GYAE6OF01BHGQA.13.63.F08.1.454.CMB.1.raw
  modified_base (383)..(383): a, c, t, g, unknown or other
  misc_feature (383)..(383): n is a, c, g, or t
  modified_base (413)..(413): a, c, t, g, unknown or other
  misc_feature (413)..(413): n is a, c, g, or t
  modified_base (545)..(545): a, c, t, g, unknown or other
  misc_feature (545)..(545): n is a, c, g, or t
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagccgtggggcctcagtgcaggtcgcctgcagggcctctggttactattttcgacaactttggcatctacgtgggtgcgacaggcccctggccacggcccttgagtcgcgtggggtgatcagttgttacaacggttgacacagactttgcacagaagtttggagggcagagtcaccctgaccanacgacacactcccgacgaacacacgcctanagtaggaactgaggatcagacatctgacgacacggaccatatattctgagcgaggaaggttcgggtttggggcgcggtactcgtcgttgagtgtcgtggggcgagggacagtcggtcgaccgttctcttcgngtaccccg

SEQ ID NO: 119499 - DNA, 773 bp, Homo sapiens
  misc_feature: GYAE6OF01DOLJO.13.63.F08.1.454.CMB.1.raw
  modified_base (237)..(237): a, c, t, g, unknown or other
  misc_feature (237)..(237): n is a, c, g, or t
tcagtcacgtactacacgaccggtgctcgatttagcgatcgtataagggacccgaaaaaccgaccacccctccgttgggagaatcccgtagatcacagctcctcaccatggactggaccctggagcattccttttcttggtggcagcggacaacgaggtgtcccaccctgaggttcaggttggttcagtcgtggaggaggggtgaaagaagccgtggggccctcgagtcgcgggtcnccgtgcagggcctcgtggttactagtttcgacgttaacgtttcggctatcgtcgttggggtcgaccggacgtccggcccgtcggtaccgccggtccttggcgtccgcggtgggtgcgtagtagtttcgaacgtacggtgacgtacgtagtaccttggacgtataggttaacgttggaggtcgaagtacgtcctaccggagaaccgacgtagacgtacgacgttaccgaccgaaacgacgaacggccttaacgacgtacgtaacgtaggaacgtcgttacgtacgaactcgtacccggttacgaaccggtacccgtacgtacccttaagtttacccgttaaagtttcccgggttaaagtccggtaaacgggtaacgggttaccgggggttttaaccgggtttccggggacgggttaaccgtccggtttaccgtaccggtttagaaccgggtacgttccggggtaccggacgggtaacggaaccggtgttcccgggtaactcccggttactacccgttcgaaccccgtcggtaccccg

SEQ ID NO: 119500 - DNA, 718 bp, Homo sapiens
  misc_feature: GYAE6OF01C6J3H.13.63.F08.1.454.CMB.1.raw
  modified_base (283)..(283): a, c, t, g, unknown or other
  misc_feature (283)..(283): n is a, c, g, or t
  modified_base (347)..(347): a, c, t, g, unknown or other
  misc_feature (347)..(347): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccctttttcttggtggcagcggcaacaggtgtccaccctgaggttcagttggttcagtctggaggaggggtgaagaagcgtggggcctcgagtgcaggtcgcctgcagggcctcgttggttactattttcgactaacgttttggctatctactggggtnacgacacggtcccctggcccacggtccttgagtcgcgtggggtgatcgagtttgtacgaaggtnacacgtagtactttgacacaggtaagtttggaggacaggtagtccaccctgaaccacgagaacctacacgtacccgacgaacaaccgacgtacctaacgtacgtacggtaaaccgttaggaacggtaaacttccgtagaactacgttccgtaacggacccgtaaccgaccggtaccctaagttaacttagtttaacgcgtacgaacgggtaacgggtaacgggtttacggggttttcggggaccgtcgggtaacgttccccgttagtacggtacgtacgtcgggtacggggtacccgggtaagggtaacccgtaaggttcgggtacccgttaacccgttccgtttccgttaccggtcccgttaacccccgg

SEQ ID NO: 119501 - DNA, 897 bp, Homo sapiens
  misc_feature: GYAE6OF01D1KAC.13.63.F08.1.454.CMB.1.raw
  modified_base (247)..(247): a, c, t, g, unknown or other
  misc_feature (247)..(247): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcgagtgcgaggtcgcctgcagggcctctggttactnttttcgactaacgtttggcattctacgtgggtcgccgacgacggtccccgtggcccgaccggtccttaggagtccgcggtggggtgtacgtcgtaagtttcggttaacgaacgggtgaaccgtacgtagtactttgacctaagaagtaaggtttggacgggtacgaggtacgttacccgacccgtacggaaccctaacgaacgaacctaaccgtacgtacccggaacgaaaaccctaaccgaacgtacccgtaaaccgtaaggttaccgggtaaaccgttacgggtaaaacgggtaacgtttacgtaacggtaaacctaacgttacggtaaccggtaaacccggaaacccggacccgggtaaccctaacgtttaactttaacgtttaaccgtagggtaccggtaaccgggtaaacgggttaaccgggggttttacgggggttttttaccgggggacccgggttaccgggttacccggttaccccggtttacggtttacgggtaaccggttaaccgggttcccggggttaaccggggggacccgggtaaaacggggggtaaaaccgttaccgggtttaaccgggtaccccggtttaaaccccggtttaccccgtttaacccgttacccggtaacccggttaacccccccgg

SEQ ID NO: 119502 - DNA, 720 bp, Homo sapiens
  misc_feature: GYAE6OF01A5ZUA.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcattcctttttcttggtggcagcggcaacaggtgtccaccctgaggttcagttggttcagtctggaggaggggtgaagaagcctggggcctcagtgcaggtcgcctgcagggcctctggttactatttcgactaactttggcatctacgtgggtgcgacacggccctggccacggccttgacgtcgcgtgggtggatcgagttgttacacggtgacacagtactttgcacgagtaagtttcgaggtcagagtctacccgtagaccactaacggaccactacgtacccgacgaaacaccgacgaccctaacaagtacggaactgggaaacgtaactacgtacggtaaccaacgttccgtacggaacgtaacccgaccgggtaaccctaagttaacttaacgtttaccgttagtacgggtaacggaagggttaaacggggtttacgggttttacggggacccgtaccggtaaccttcccggttacgttaggtaaccggtacggttaccggggtcgggggacccggtaacgggggtaaccgttaaggtaccgggttaccgtaaccccggtttcgttacccgttcggaccgttaaccccccgg

SEQ ID NO: 119503 - DNA, 797 bp, Homo sapiens
  misc_feature: GYAE6OF01EM6IF.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcattcctttttcttggtggcagcggcaacaggtcgtccaccctggaggttcagttggttcagtcgtgggagggaggggtagaagacgccgtgggcctgagtgcgaggtcgcctgcgagggcctcgtggttactagttttcgaacttaacgtttggactagttcgtacgtgggtcgcgacgacggccctggccacggtcctgacgtcgcgtggggtgacttcgaggtttcgtacgtacggtcgaacgacgacgttacgtttcgacaacgtaaggttaacgttggacggtacgagtacgtccgaacccgtcgaacccagaacgactaacgacgtaccgacgtaaacacgacgtaccctaacgagtacggaacttaggaacggtataccgtacggaacttacgtaccgtaacgaacccggaaccgtaaccggacctaaacgttaacgttaacgtttaacgtacggttaaccgggtacgtaaagggggttaaccgggttttacgggggtttttacgggggaccggttacccgggttaaccgttccgtttaccggtacggtaaacgggttcccggtacggggttaccgggggaccggtaaacggggtaacggtaacgggtttaccggtacccggttaacccggtttaccgtttccgttaaccgtcccgttaaacccccggg

SEQ ID NO: 119504 - DNA, 644 bp, Homo sapiens
  misc_feature: GYAE6OF01ENN1R.13.63.F08.1.454.CMB.1.raw
  modified_base (373)..(373): a, c, t, g, unknown or other
  misc_feature (373)..(373): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaacgtttcggcattctacgtgggtgcgacacggccctggccacggccttgagtcgcgtggggtgatcaggttgtacgtacggtgacacagtactttgccatagaagttgaggcagcgtacnccgtagaccacgagtacacgacgtcccgacaacactacgaccgtaacagtacggtaacgtaggaacggtaactcgtagaacgtactacgtacgaacgtaccgacggacctaagtaactagttacgtagtacggaggaggtaacgggttacgggttttacggggcggaccggtaccgtccgttacgttaggacgtacgtcgggtacggggaaccggtacgggggaactaacggcggtaccgtccggttaccttacgttcgtaacgtaccccg

SEQ ID NO: 119505 - DNA, 722 bp, Homo sapiens
  misc_feature: GYAE6OF01BG7K3.13.63.F08.1.454.CMB.1.raw
  modified_base (454)..(454): a, c, t, g, unknown or other
  misc_feature (454)..(454): n is a, c, g, or t
  modified_base (503)..(503): a, c, t, g, unknown or other
  misc_feature (503)..(503): n is a, c, g, or t
tcagtcacgtactacacgaccggtgctcgatttagcgatcgtataaggggacccaaaaaaccacacccctccttgggagaatcccgtagatcacagctcctcaccatggactggacctggagcatccttttcttggtggcagcggcaacaggtcgtccaccctgaggttcagttggttcagtcgtggaggaggggtgaagaagccgtggggcctcaggtcgcgaggtccgccgtgcgacgggccttcgtggttactacgttttcgactaactttggctagtctacgtgggtcgcgtacgacggcccctcggccacggtccttgacgtcgcggtggggtgactcgtagttgtacgaacggtgacctagagtactttgcaagagtaagtttaggacgggacaggacgtccacccgtcgaacctacgacgaacaccgatccccgaacgaaccgaacncgaccctacagtagaacgtaggaaggtaactacgacgaactattaccgngaacccggaacgccggtaacctaagttaacgttacctttacggtagtaccgggtaggaaacggggttaacgggttttaccgggtttcgggggccgttaacccgggaccgtttcccgttacgttacggtaacgtacgtccgggtaacggggacccggtaaggggaacctaagttaccgggttccctaacccggtttccttcgttacccgccgtaaccccg

SEQ ID NO: 119506 - DNA, 719 bp, Homo sapiens
  misc_feature: GYAE6OF01CKD2N.13.63.F08.1.454.CMB.1.raw
  modified_base (554)..(554): a, c, t, g, unknown or other
  misc_feature (554)..(554): n is a, c, g, or t
tcagtcacgtactacacgaccggtgctcgatttagcgatcgtataaggggacccaaaaaccacacccctccttgggagaatcccgtagatcacagctcctcaccatggactggacctggagcattccttttcttggtggcagcggcaacaggtgtccaccctgagttcagttggttcagtctggagggaggggtgaagaagccgtggggcctcgaggtcgcgaggtccgcctgcgagggcctcgtggttactattttacgaactacgttttggctagtccgttacgtggggtcgtcggacgacggccccgtcggacccgacggtccgttgacggttcgcggttcgggggtggtacgttcgtaggtttacgtttaaccgtaacgggttcggaacctacgtacggttacttttacggaccgtaacgtaacggtaacgggttttaggaacgggtaccgtaaggtacggtaccctaccgacaaccgaagacgaaccacgtactacccggactaacacgacgacctacgagtacggaacgtagacgtatcgtagactancgtacgacgtaccgacgtactaactagttaccttacgtagtacgacggaacggttacgggtttagggttcggacgtccggtacgtttccgagttcggacgtcggtccgggacggtacgggaggtactacgggttaccgtccgtacgtcgtctcgacccggtaccc

SEQ ID NO: 119507 - DNA, 781 bp, Homo sapiens
  misc_feature: GYAE6OF01CW8H3.13.63.F08.1.454.CMB.1.raw
tcagtcacgtactacacgaccggtgctcgatttagcgatcgtataaggggacccaaaaaccgacacccctccttgggagaatcccgtagatcacagctcctcaccatggactggacctggagcatccttttcttggtggcagcggcaacgaggtgtccaccctgaggttcagttggttcagtctggaggaggggtgaagaagccgtggggcctcgagtgcgaggtccgcctgcgagggcctcgttggttaactattttccgaactaacgttttggctatctacgtggggtgacgtacgacggtcccctggcccaccgggtccttggtagtccggacgtgggggtacgatcgtagtttgttaccgtaacggtacgaaccacgtagtaccgttttcggacctaacgtaggtaaggtttaggaggtaccgaggtacgtcccgacccgttaccggaacccaacgtagacccaacgtaccgtcccgaacgtaaacccacaacggccctaatacgtacggaacgtacggaaaggtaactccgtaagtaccgtactacgttaaccggaacggaacccgaaccgggtactaacttaacttacgttaacgtgtacgacggtaaggggtaacggtttacggggttttcggggaccgtaccgggtacccttaccgggtttataccggtaggtacgttaccggggtaccggggacccggaaacgggggttaaccttacgggtacgggtaccccttacccggttacccgtttccggtcgtaccccgtaacccgg

SEQ ID NO: 119508 - DNA, 812 bp, Homo sapiens
  misc_feature: GYAE6OF01CH354.13.63.F08.1.454.CMB.1.raw
  modified_base (503)..(503): a, c, t, g, unknown or other
  misc_feature (503)..(503): n is a, c, g, or t
tcagtcacgtactacacgaccggtgctcgatttagcgatcgtataaggggacccaaaaaccacaccccctccttgggagaatcccgtagatcacagctcctcaccatggactggacctggagcatcctttttcttggtggcagcggcaacaggtgtccaccctgaggttcagttgtcagtcgtggaggtagggtgagaagccgtgggcctcgagtgcgagtccgcctgcgacggctcgtggttactagttttcgaactacgtttggctattcgtacgtgggtcgacgtacgccggtacccccgtggacccacggtcccttaggtacgtcggtcgttgggggtacgtacgtcgtacggttttacggttaaccgtaacgggtcgtaacgtaacgtacgtttactttcgaccgaacttaagggtaacgtttacgggaggtccgaaggacgttcccgaaccctgaacccgaacgacgaaccgtacgaccgtaacccgaccggtaaanacccgtacgtacccgtaactacgtaacggtaagtacgggtaacggtaacttacgacggtactaaccgtaccgtaccggaaccgtaaccgtaaccggacccgttaaacgttacgtttaacttacgggttaggttaacgggttaacccgggtaaagggtttaaccggggttaccgggtttttacggggcccggttaccggttacgttacccggttcgttagtaaccggttcggtaccgggttaccggggacccggtagggtaacctaggtacgtacccgtaccgttcttacctccggtaccgtacccccgg

SEQ ID NO: 119509 - DNA, 618 bp, Homo sapiens
  misc_feature: GYAE6OF01AETHF.13.63.F08.1.454.CMB.1.raw
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (319)..(319): a, c, t, g, unknown or other
  misc_feature (319)..(319): n is a, c, g, or t
  modified_base (403)..(403): a, c, t, g, unknown or other
  misc_feature (403)..(403): n is a, c, g, or t
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagcctgggcctcgagtgcaggtcgcctgcgagggcctctggttactattttcgactaactttggctatctacgtgggtncgacacggtccccnggccacggcttgagtcgcgtggggtgntcgtagttgttacgacggtgacactagtactttgacacagtagtttggacggtacagtacgtcaccctgaccacgagacacacncgacaacacacgacctacagtagaacgtagagtatactagacagtactcgaccgacacggcctagtatacttacgtgtacggacggaaggtaaggtttacggggtttacgggtaccggccggttaaccgtccgttcgttagacgtacggttcggcgggaccggtaggggtactaaggtcgtaacccgtcgttaccttacgttcgtccgtaccccg

SEQ ID NO: 119510 - DNA, 666 bp, Homo sapiens
  misc_feature: GYAE6OF01BOHFB.13.63.F08.1.454.CMB.1.raw
  modified_base (242)..(242): a, c, t, g, unknown or other
  misc_feature (242)..(242): n is a, c, g, or t
  modified_base (326)..(326): a, c, t, g, unknown or other
  misc_feature (326)..(326): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
tcagtcacgtactacacgaccggtgctcgatttagcgatcgtataaggggacccaaaaaccacacccctccttgggagaatcccgtagatcacagctcctcaccatggactggacctggagcattcctttttcttggtggcagcggcaacaggtgtccaccctgaggttcagttggttcagtcgtggagggaggggtgaagaagccgtggggcctcagtgcaggtcgccgtgcgagggcctntggttactattttcgactacgtttggcattctacgtgggtgcgacgacggcccctggccacggtccttgagtcgcgtggggtgntcgagttgtacgaacggtgacacagactttgcanagtaagtttggaggcagagtcaccctgaccanacgacacacgtccgacaacacgacncctacagtacggacgtaggaagtaactctagactagtctacgaccgacgacggacctatacttagttacgtgtcgacggaaggtaacggggtttacgggttttcggggacgtccgggtaaccgttccgttccgttggtacgttacggttccggtacgggggtacccggtaacgggggaaccgttaacgggttaccgggttcccgttaacccgggttcctttaccgtttccggacccggttaaccccccg

SEQ ID NO: 119511 - DNA, 642 bp, Homo sapiens
  misc_feature: GYAE6OF01EYZU5.13.63.F08.1.454.CMB.1.raw
  modified_base (236)..(236): a, c, t, g, unknown or other
  misc_feature (236)..(236): n is a, c, g, or t
  modified_base (457)..(457): a, c, t, g, unknown or other
  misc_feature (457)..(457): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagccgtggggcctcagtgcaggtcgctgcgagggcctntggttacattttcgactaactttggcatctacgtgggtcgcgacacggccccgtggacccacggtccttagaggtcgtacgtggggtgattcgaggtttcgttaacgaacgggttgaccacgtagtactttgacagagtagtttggaggcagcgtccacgtgaaccacgacgacacacgtccgacgacacgacgacctacagtagacgtagaggactcganacactctagaaccgacgaccggactatacttattacgtgtacggacgtaaggtaacgggtttacgggttttcgggccgtacggtaactccgttacgttggagttaggtccggtaggggaccggacggggtacgtacggttacggtaccgttacccgttacgttaccgttccgcgttaacccccgg

SEQ ID NO: 119512 - DNA, 876 bp, Homo sapiens
  misc_feature: GYAE6OF01DMSXC.13.63.F08.1.454.CMB.1.raw
  modified_base (196)..(196): a, c, t, g, unknown or other
  misc_feature (196)..(196): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
tcagtcacgtactacacgaccggtgctcgatttagcgatcgtataaggggacccaaaaaaccacacccctccttgggagaatcccgtagatcacagctcctcaccatggactggacctggagcattcctttttctggtgcagcggctaacaggtgtccacctgtaggttctagttggttcagtctggaggagggtnaaggagccgtggggcctgagtgactcggtccgcctcgcgtacgggcccttcggttacgtttactattttaccgaacttaccgttttggactactactacggtgggtacgacgaccggacggtcccccgtggacccgtaaccggtcctttaggacgtcggtcggtgggggtacgtatccgtagtttaggttaccgtaagggtnaaacctnacggttcttacgcaaacgtagttaagttcggaggctaagtcgtaccacccgtagactaacgaagacctaacgaccgtacccggaacgtaaaacaccggtactaccctaacgtaaggtacggaaacgttacgggtaaacgtaacgttaccgtaacggtaacctactttaccgggaagtaaaccccggacccgtaaacggtacccttaaagttaacgtttttaaaccgttacgtacgggttacggtaaaccggggtaaacgggtttaaacggggggtttttccgggtttttacccgggggaaccgtttaccccggggtaccttttaaccccgggtttggttaaacccggtcgggtaacgttaccggggggttaccggggaacgggttaacggggaaacccgtttaggggttacccgttacccgttaaacccggtttccggttacccttaaaccggtcccccgttaaaccccgg

SEQ ID NO: 119513 - DNA, 721 bp, Homo sapiens
  misc_feature: GYAE6OF01DORV3.13.63.F08.1.454.CMB.1.raw
  modified_base (441)..(441): a, c, t, g, unknown or other
  misc_feature (441)..(441): n is a, c, g, or t
tcagtcacgtactacacgaccggtgctcgatttagcgatcgtataaggggacccaaaaaaccacacccctccttgggagaatcccgtagatcacagctcctcaccatggactggacctggagcattcctttttcttggtggcagcggcaacgaggtgtccacctgaggttcagttggttcagtctggagggagggtgaagaagccgtgggcctcgagtgcaggtcgcctgcgagggcctgttggttaactagttttcgaactaacgtttggctagtcgtacgtgggtagccgaacgcggcccccgtggacccgaaccggtcctttggacgtccgcgtggggtgactcgtagttgtaacgaacggtgaacacgtaagtacgtttgactaacgtaaggtaaggtttggaagggtacgaaggtacgtccacccgtagaacccanaacgactacacgtccgaaacgaaaccacaaccgtacgtaacgtaacgtaacggtaacgtaggtaacggtaaacgttacgtaacgtacgtaacctcgtaacgaaccgaccgtaacgaccgtaataattacgttacgtggtagtacggtaagggtaacgggttacggggttttacgggccggtacggtaccgtcctacgttacgagtacgtccggtacgggaccggaagggtaacgtagttaccggtaccgtaccgttacgtaccgttccgtcgtaaccccg

SEQ ID NO: 119514 - DNA, 725 bp, Homo sapiens
  misc_feature: GYAE6OF01AK01R.13.63.F08.1.454.CMB.1.raw
  modified_base (356)..(356): a, c, t, g, unknown or other
  misc_feature (356)..(356): n is a, c, g, or t
  modified_base (445)..(445): a, c, t, g, unknown or other
  misc_feature (445)..(445): n is a, c, g, or t
  modified_base (547)..(547): a, c, t, g, unknown or other
  misc_feature (547)..(547): n is a, c, g, or t
  modified_base (662)..(662): a, c, t, g, unknown or other
  misc_feature (662)..(662): n is a, c, g, or t
  modified_base (711)..(711): a, c, t, g, unknown or other
  misc_feature (711)..(711): n is a, c, g, or t
tcagtcacgtactacacgaccggtgctcgatttagcgatcgtataaggggacccaaaaaccacacccctccttgggagaatcccgtagatcacagctcctcaccatcggactggacctggagcacttcctttttcttgggtggcagcggacaacgaggtcgtccaccctgaggttcaggttgtcagtctgggaggaggggtgaagacgccggtgggcctgagtcgcgacggtcgcgtgcgacggcctgtcgttatactttccgaactacgttacggctactcttacggtgggtcaccggtacgcccggtcccggtcgacccgtacggtccgttggcggttcggtcgggtaggggtntcgtacgttagtttacgtacggacgtcgaaccgtactagtttcgtcgacgtaagtacggttagtcgggaggaccgacggtacgtacccncgtaccgaccaacgacacgtaccgccgtaccggaacgacctaaccgaccgtacgtaacgacggtaacgaacggtagaacggttactaccggtactaaccgtntacccgggtacgaacccgtacggtacccgtaatgtttaactaacgttcggtaaggtaccgtaaggggaacgggtttacgggggtttcgggtacggcccgttacggtcctaacggngtttacgcggtacgtcgggacgggaggcaagtcgtaccgtcgtcgtacnctagcccgtacccg

SEQ ID NO: 119515 - DNA, 755 bp, Homo sapiens
  misc_feature: GYAE6OF01DB9FN.13.63.F08.1.454.CMB.1.raw
tcagtcacgtactacacgaccggtgctcgatttagcgatcgtataagggacccaaaaaccacacccctccttgggagaatcccgtagatcacagctcctcaaccatggactggacctggagcacttcctttttcttggtggcagcggcaacaggtgtccaccctgaggttcagttggttcagtctggaggagggtagaagagccgtgggcctcgagtgcgaggtcgcctgcgaggtcctgttgttactatttcgaactagtttggactatcgtacgtggtacgcgtaccgaccggtccccgtggaccccgaccggtccgtttggacggtccggcggtagggggtacgacgttcgtacggtttacggttaacgaacgggtcgaacctacgtacgttaccgtttagacaacgtagtaaggtttggaggacaggtaccgtccaaccgtcgaccacgaacgacctacacgtccgaccgaacaccgaacggtcctaacgtacgtaacggtaacgtagaacggtaacgtcgtacaacgtactacgtacgaaccggtacaccgggtactaagttacttacttacgttacgtacgtacggtaagggttacgggtttaacggggtttcggggaccggtaccggttacgttacccggttacgtacgtggtacggttacgggtaccgggtacgggaccggtaacggtaagttccgggtaacccgttacccggtttccgttacccgttccgtaccccgtaaccccgg

SEQ ID NO: 119516 - DNA, 891 bp, Homo sapiens
  misc_feature: GYAE6OF01AM7ZY.13.63.F08.1.454.CMB.1.raw
  modified_base (373)..(373): a, c, t, g, unknown or other
  misc_feature (373)..(373): n is a, c, g, or t
tcagtcacgtactacacgaccggtgctcgatttagcgatcgtataaggggacccaaaaaccacaccccctccttgggagaatcccgtagatcacagctcctcaccatggactggacctggagcattccttttcgttggtggcagcggcaacgaggtgtcccacccgtggtaggttctagttggttcagtcgttgggaggtaggggtgaagacggccgtcggggcctcgaggtgcgtaggtccgccgtgccgacgggtcccttcgttacggtttacttacgttttccggaaccttaacgtttcggactattccggttacggtcgggtgaccgaacgaccggtcccgtcggccgtaccggtccgtgacgtccggnggttggggtacgtacgttcgtaggtttacggttaaccggacggttacgacctaacggtacgttccgttacgactaacgggtaacgttagggtttaacgggacggtaccgtaaggtacccggtaacccgtaccccgtaacggaacccaaccggtaacgtaacccgaacgttaacccgtacccccgggaaactaaacccgtacccgtaaccgtaccccgtaaacgttaccggtaaacgggtaacgtaacgggtaacggttaacccgtccgtaacgtaaccgtaccgttaaccggtaccggtaaaccgaaccccgggtaaccgtaacccttagttaacgttacgttaccgtggtacggtacggtaacgggtacggggtttacgggtttcgggaccgttaccggtacgttccgtaggttacggacgtacgggtaccggggtacgggtaccggtaggggaaccgttacggttaccccggtcggttaccctaccggttaccgttaccgtacccgggttaccccg

SEQ ID NO: 119517 - DNA, 697 bp, Homo sapiens
  misc_feature: GYAE6OF01B2QRR.13.63.F08.1.454.CMB.1.raw
  modified_base (282)..(282): a, c, t, g, unknown or other
  misc_feature (282)..(282): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcgggcaacaggtgtccaccctgaggttcagttggttcagtctggaggaggggtgaagaagcctggggcctcagtgcaggtccgcctgcacggggcctcgtaggttacattttcgacaaacgttttggcatctactggggtncgacaggccctggccacggccttgagtcgcgtggggtggatcgagttgttacgaacggttgaactacgaggtactttacgacaacgtaagtaaagtttggagggtacaagtaacgttcgaacccctggaacccaaacaggaaccacaactacccggacaaaaccaaccagtccgttaaccagtacggaaccgttaggaaacgggaaacttcgttaagaaccgaatccgttaggacaacgacggaccaagtaaccgtataaccttgtagaccggtaaggtaacggtaccgggtttttaggggaccggtacggtaaccgtcccggttactttacggaaacgttacgtacgggttagggcccggttaaacggggacctaaagcggtaccgtacgtaccgttccttacgtacgaccccg

SEQ ID NO: 119518 - DNA, 530 bp, Homo sapiens
  misc_feature: GYAE6OF02GES5P.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctgacatctgacgacacggccatatattactgtgcgagaaggtacggttttggggcgcggactcctcttgagagtctggggccaggggacaagtggtcaccgtctcttcagtcc

SEQ ID NO: 119519 - DNA, 541 bp, Homo sapiens
  misc_feature: GYAE6OF02HJ66P.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtgatcagttgttacaacggtgacacagactttgcacagaagttgagggcagagtcacctgaccacagacacatccgacgaacacagcctacatcggaactgaggaatctagacatctgacgacgacggccatatattactgtgcgagaaggtacggttttggggcgcggactccgtctgagacgtcgtcgggccgagggacgaagtcggtacgaccgtctcgttcacgtcccg

SEQ ID NO: 119520 - DNA, 552 bp, Homo sapiens
  misc_feature: GYAE6OF02JDWFU.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtgatcgagttgttacaacggtgacacagactttgcacagaagtttgagggcagagtcacctgaccacagacacatccgcgaacacagcctacatggaactgaggatcgtgacatctagacgacacggccatatattactgtgcgagtaaggtacggttttggggcgtcggactccgttcgttgagtagtcggtcgggccgaggggacaaggtcggtacgaccgttcgtccttacgagtccccg

SEQ ID NO: 119521 - DNA, 541 bp, Homo sapiens
  misc_feature: GYAE6OF02HB1F6.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgaggcagagtcacctgaccacagacacatccgcgaacacagcctacatggaactgaggaatctagacatctgacgacacgccatatattactgtgcgagaaggtacggttttggggcgcggtactccgtcttcgagtagtcgtgggccaggggacgtaagtggtccaccggtctcgtcgacgtacccg

SEQ ID NO: 119522 - DNA, 555 bp, Homo sapiens
  misc_feature: GYAE6OF02GIAZH.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtgatcagttgttacaacggtgacacagactttgcacagaagtttgagggcagagtcacctgaccacagacacatccgacgaacacagcctacatggaactgaggaatctgacatctgacgacacgccatatattactgtgcgagaaggtacgggttttggggcgtcggactccgttcttgagagtcggtcggggtccgacggggacgaagttcgggtcgtaccggttcgttcgttcgacgtccccg

SEQ ID NO: 119523 - DNA, 538 bp, Homo sapiens
  misc_feature: GYAE6OF02HI137.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcacctgaccacagacacatccgacgaacacagcctacatggaactgagaatctagacatctgacgacacgaccatatattactgtgcgagtaaggacggttttgggcggtcggacgtcctcttgagtatcgtcgggccgaggggacagtcggtacacgtacgtcttcagtcccg

SEQ ID NO: 119524 - DNA, 561 bp, Homo sapiens
  misc_feature: GYAE6OF02IHRWU.13.63.F08.1.454.CMB.1.raw
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
tcagtcacgtactacacgaccggtgctcgatttagcgatcgtataaggggacccaaaaaccacaccccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcgagttggttacaacggtgacacagactttgcacagaagtttgaggcagagtcacctgaccacagacacactccgcgaacacagcctacatggaactgagaatcngaacatctagaccganacggaccatataattactgtgacgagaaggtacggttttacggggcgtacggacttccgtcttagagtagtcgtacggggccaggggacaagttggaccgtaccgtcgtcttaccgagtaccccg

SEQ ID NO: 119525 - DNA, 697 bp, Homo sapiens
  misc_feature: GYAE6OF02H7EAT.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagccgtggggcctcagtgcaggtcgcctgcagggcctctggttacattttcgactaactttggcatctacgtggtgcgacaggcccctggccacggccttgagtcgcgtggggtggatcgtagttacgttacgaacggtgacacacgtacttttgacacgagtaagtttggagggcagtacgtcacctcgaccacagacacactccgacgaacacacgacctaacacgtacggaaacttaggaacggaattactaggacctaatcgttacgacgaaccgaccggaccaataataactttacgtcgtagacggtaacggtaagggttacggggttttacggggccggtaccgggtaaccgttcccgttacgttacggtacgtacggttacggtaccggggggtacccggtaaacggggggtaaccgtaaacgggttaccgggttacccggtacccggtttacccgtttacccggtttacccgaccggttaaccccccgg

SEQ ID NO: 119526 - DNA, 552 bp, Homo sapiens
  misc_feature: GYAE6OF02IJJRQ.13.63.F08.1.454.CMB.1.raw
  modified_base (390)..(390): a, c, t, g, unknown or other
  misc_feature (390)..(390): n is a, c, g, or t
  modified_base (508)..(508): a, c, t, g, unknown or other
  misc_feature (508)..(508): n is a, c, g, or t
  modified_base (545)..(545): a, c, t, g, unknown or other
  misc_feature (545)..(545): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggagggtgaagaagcctggggcctcagtgcaggtcgcctgcagggcctctggttacattttcgacaactttggcatctactgggtgcgacgaggcccctggccacggccttgagtcgcgtggggtggatcagttgttacaacggtgacacagactttgcacagaagttggagggcagagtcacccgtgacacagacacaatccgnaacgacagacctacatggaactgaagaatctagacatctagacgtacacggccaatatattacgtgtagcgagaaggtacgggttttgggcgacggtaacctccgtctagagagtcgngggtaccgaagggacaagtcggtcaccgtctcgtacngtacccg

SEQ ID NO: 119527 - DNA, 547 bp, Homo sapiens
  misc_feature: GYAE6OF02F3DMI.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtgatcagttgttacaacggtgacacagactttgcacagaagtttgagggcagagtcaccctgaccacagacacatccgcgaacacacgcctacatggaactggaggaatctagacactctgacgacgacggccaatatattactgtagcgagaaggtacgggttttggggcgtcggaactccgtctgagagtcgtcgggaccgagggactagtcggtcgaccgtctcttcgacgtcccg

SEQ ID NO: 119528 - DNA, 535 bp, Homo sapiens
  misc_feature: GYAE6OF02GEE4E.13.63.F08.1.454.CMB.1.raw
  modified_base (529)..(529): a, c, t, g, unknown or other
  misc_feature (529)..(529): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctacgtgggtgcgacaggcccctggccacggccttgagtcgctggggtgatcagttgttacaacggtgacacagactttgcacagaagtttgagggcagagtcaccctgaccacagacacatccgcgaacacagcctacatggaactgaggaatctgacatctgacgacacggccatatattactgtgcgagaaggtacgggttttggggcgcggactccgtcttgagtacgtcgtgggccgagggacagtggtcaccgtctcttcngtcccg

SEQ ID NO: 119529 - DNA, 813 bp, Homo sapiens
  misc_feature: GYAE6OF02FWAP4.13.63.F08.1.454.CMB.1.raw
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
tcagtcacgtactacacgaccggtgctcgatttagcgatcgtataagggacccaaaaaccaacacccctccttggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctntggtacattttcgacaactttggcatctactgggtntcgacaggcccctggccacggcccttgacgtcggcgtggggtggacttcgaggttcggttaacgaacgggttgaaccgactaggtacctttaggtccaacgtagtaaggttttggaagggcaaggtacggtaccacccgttagaacccgaacgaggaaccaaccgtaacttaccccggaccggaaaaccctaaccgaacggtaccccgttaaccgaacgttaacgggtaaaccgttaacggaaaccgggtaagttaccgttacgggtaaacctaacgttaccgttaaggaacccggaaccgtaacccggacccgtaaactaacttaaacgtttacttacgttagggtaccgtaacgggtaaacgggttaacggggttttttcgggggaaccgggtacccggtaaaccggttcccgttacccggtttagtacggtacgttaccgggttaccgggggtaccgggtaacgggggtaacggtaaccggttacgggtaccgggttaaccccgttaccggttcccgttttaccgaccgttaacccccgg

SEQ ID NO: 119530 - DNA, 548 bp, Homo sapiens
  misc_feature: GYAE6OF02JB0MR.13.63.F08.1.454.CMB.1.raw
  modified_base (374)..(374): a, c, t, g, unknown or other
  misc_feature (374)..(374): n is a, c, g, or t
  modified_base (455)..(455): a, c, t, g, unknown or other
  misc_feature (455)..(455): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgcgtggggtggatcgagttgtacacggtgacacagactttgcacagaagtttgaggcagagtcacctgaccanagacacatccgcgaacacacgcctacatgaactagagaatcgtacgacatctgacgacgacgaccatactattactgtcgngagaaggtacgggttttcgggcgtcggactccgtctgagtcgtcgtcgggcgacgggacgtaagtcggtcgaccgtcgtcttacgcgtacccg

SEQ ID NO: 119531 - DNA, 749 bp, Homo sapiens
  misc_feature: GYAE6OF02G3KZH.13.63.F08.1.454.CMB.1.raw
  modified_base (333)..(333): a, c, t, g, unknown or other
  misc_feature (333)..(333): n is a, c, g, or t
tcagtcacgtactacacgaccggtgctcgatttagcgatcgtataaggggacccaaaaaccaacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggcagtcctactgggtgcgacaggcccctggccacggccttgagtcgctggggtgatcagttgttacaacggtnacacagactttgcacagaagtttgaggtcagagtccacccgtagacccgacaaggacctaaccagttacccggacggaaaccacctacggacccgtaccgaacgtacgggaaaaccttcgggaaagggtaaacttccgtaaggtaaccctaagttacctaacgggaaccgtaaccgtaacccggggaccctaaacttaaacggttaacttttaacccgttagggttacgggtaccggaaacgggttaaacggggtttacggggggtttttttaagggggcccgggtacggtacccgttacccgttggttttacggaacggtacgttccggttacgggggacccgttaaacgggggaccgttaagtccggggttacctacccgggtttaccttccgtttaccggacgttacccccgg

SEQ ID NO: 119532 - DNA, 558 bp, Homo sapiens
  misc_feature: GYAE6OF02GHA8D.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggcatctactgggtgcgacaggcccctggccacggccttgagtcgctggggtgatcaggttgttacaacggtgacacagactttgcacagaatttgaggcagagtcaccctgaccacagacacatcccgcgaacaccagcctacatcggaactgaggaatcgtagacatctgacgacgacggccatatattactgtagcgagaaggtacggttttggggcgtcggacttccgtcttgagacgttcgtggggtaccgaggggtacaagtcggtcgtaccggttacgtccttcgataccccg

SEQ ID NO: 119533 - DNA, 767 bp, Homo sapiens
  misc_feature: GYAE6OF02JWUUC.13.63.F08.1.454.CMB.1.raw
tcagtcacgtactacacgaccggtgctcgatttagcgatcgtataaggggacccaaaaaccaacacccctccttggagaatcccgtagatcacagctcctcaccatggactggacctggagcatccttttcttggtggcagcggcaacaggtgtccaccctgaggttcagttggttcagtctggaggaggggtgaagagcctggggctcagtgcaggtcgcctgcgagggcctctggttacattttcgactaacgtttggaccatctactgggtgcgtacaggcccctggccacggccttggacgtcgcgtggggtcgatccgtaggttgttaaccgacggtgacacgaggtaactttgacactaggtaagtttggagggcaggtagtcctacccgtgaaccagtaacgactaaccgagttccccggacgaaacccacgtacgacccgtaacacgtacggaactaacggaggaaacgttcgtagaacctacgtacgtacggaaaccggaaccgtaaccgggaccctaacgttaacttaacgtttaaccgttacggtacggtaacggtaaacggggtaaacggggtttaaccggggttttttagggggacccgggtaacggttaaccccgggttccgtttaccggttacggtaacgggttacggtccgggtttaccgggggaccgggtaaaccggggttaacgaaccggttaccgggttaccgtacccgggttaccctttaccggttaccggacccgttaacccccgg

SEQ ID NO: 119534 - DNA, 675 bp, Homo sapiens
  misc_feature: GYAE6OF02FVQQ0.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtgatcagttgttacgaacggtgacacgagactttgcacagagtttgagggcagagtcacctgaccacagacacatccgacgaacacacgcctacagtaggaactgaaggaatctacgactatacgtagaaccgacgaccgggacctaataactactttacctaggtacggacgggtaacggtaacggggttacgggtttttaggggggaccggtaccgggtaaccgttcccgtttacgtttacggaacggtacgttccgggtacgggggtacccggtaacggggggtaacctaaacggggttaccgggttaacccgttaccccgggtttaccttacccggttttacccgaccggttaaccccccgg

SEQ ID NO: 119535 - DNA, 884 bp, Homo sapiens
  misc_feature: GYAE6OF02IC5LZ.13.63.F08.1.454.CMB.1.raw
  modified_base (285)..(285): a, c, t, g, unknown or other
  misc_feature (285)..(285): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttgggtggcagcggcaacgaggtgtccaccctgaggttcagttggtcagtctggaggagggtgaagagccgtggggcctcagtgcgaggtcgcctgcgagggcctgtcggttactattttcgaactaacgtttggactatactacgtggggtanccgtacgacggtccccgtaggcccgtaccggtcctttggacgttccggtccggttagggggtcggtaacgttcgtaaggttttacggttaaaccgtaaacggggttcaacgtaacgtacggttaacgttttgaaccgtaacgtaacgggtttaagtttacggggaacggtacgtaaggtaccgttacccgaaccccgtacggtacccaacgaacggaactaccgtaaccgtacccggaacccgaaaccacgtaacccgtacccttaaacgtagtaaacgggtaaccgtaacgggtaaacggtaacgttaccgtaacggaacgtaccgttacgtaccggaaacccggtacgaaccggtaaccctaagttaacttaaaccgtttacgtacggttaacggacggtaaacgggttaacgggggttttccgggttttacggggaccgggttaccggtaaccgtttcccgttacgggtttacggaacggttaccggttccggggtaaccggggtaccgggtaacgggttaaaccgtaacggtttaccggggtacccgttaccccggtttaccgtttaccggtacccgtacccgggttacccccgg

SEQ ID NO: 119536 - DNA, 567 bp, Homo sapiens
  misc_feature: GYAE6OF02FURGE.13.63.F08.1.454.CMB.1.raw
  modified_base (560)..(560): a, c, t, g, unknown or other
  misc_feature (560)..(560): n is a, c, g, or t
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggagggtgaagaagcctggggcctcagtgcaggtcgcctgcagggccctctggttacattttcgactaactttggcatctacgtgggtgcgacacggcccctggccacggtccttggagtcgccgtggggtcggatcagttgttacgaacggtgacacagactttgcacagagtttgaggcagagtcacctgaccacagacacatccgacgaacacagcctacatagaactagaaggaatcgtagactaatctacgacgacgacgaccatatatactgtagacgagtaggtacggttttggggcgtcggtactccgttcttcgagtacgtcggtgggaccgagggaacgtagtcggtctccggtctcgttaccngtacccg

SEQ ID NO: 119537 - DNA, 676 bp, Homo sapiens
  misc_feature: GYAE6OF02FGPLT.13.63.F08.1.454.CMB.1.raw
  modified_base (236)..(236): a, c, t, g, unknown or other
  misc_feature (236)..(236): n is a, c, g, or t
  modified_base (333)..(333): a, c, t, g, unknown or other
  misc_feature (333)..(333): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggccctntggttactattttcgacaactttggcatctactgggtgcgacacggcccctggccacggccttgagtcgcgtggggtgatctagttgtacaacggtnacacagtacttgcacgagtaagtttgagggtcagagtccacctgaccacgagacacactccgacgaaccacacgaccctacacgtaggtaactaggaacggtaactacgtacgaactactaccgtacggaaccgaaccgaaccggcccaagttaacttattacgttaggtcggtacggaagggtaacgggtttacggggtttttacgggggaccgtaccgggtaccgttcccgtttacgttcgtaggtacgttccgggtcgggggtacccgaacgggggtaacctaacggttaccggttaccgtaccccggttcgttcccgtttaccgaccggttaacccccg

SEQ ID NO: 119538 - DNA, 638 bp, Homo sapiens
  misc_feature: GYAE6OF02FQ27G.13.63.F08.1.454.CMB.1.raw
  modified_base (338)..(338): a, c, t, g, unknown or other
  misc_feature (338)..(338): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggagggtgaagaagccgtggggcctcagtgcaggtcgcctgcgagggcctctggttactattttcgactactttggacatctacgtgggtgcgacacggcccctggccacggtccttgagtcgcgtggggtgatcgagttgtacgaacgggtnacgacgagtactttgacacagtagtttgagggcagngtccnccgtgaccacgacgacacactcccgacgaaacacgacgacctacgagtacggaactaggaaggtaacgtctacgaactacgtcgtacgacgacgacgaccatattacttactgtagacgaggtaacggttacgggttttcggggcggtaccggtacgttccgttcgttagtacgtacgttcggtacgggtaccggtaacgggaacgtaaggttcggttaccgttacccggttaccgttccgttaccgtaccgtaccccg

SEQ ID NO: 119539 - DNA, 611 bp, Homo sapiens
  misc_feature: GYAE6OF02IRH2P.13.63.F08.1.454.CMB.1.raw
  modified_base (503)..(503): a, c, t, g, unknown or other
  misc_feature (503)..(503): n is a, c, g, or t
tcagtcacgtactacacgaccggtgctcgatttagcgatcgtataaggggacccaaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctcgtggttacatttcgactaacttgtcactctactggtggtcgacgaggccccgtccggtccgaccggccgttcgtacggtcgcgtcggggttggggatcgaggtttggttacgaacgggtaggaccgacaagtacgtttcgcaacagtaagtttaggtagggacgtagagtcacccgtcgaccacagacacatccgcgaacacacgctacataggaactggaagatctgaactatacgtcgaacgaccgaccgacatactattactgngtacgagaagggttcgggtttcgggtcggcgtaacgtcctgttagagtgtacggtcgggacggagggaacgtagtacggtccgtccgtatccgtttcgacgtaccccg

SEQ ID NO: 119540 - DNA, 588 bp, Homo sapiens
  misc_feature: GYAE6OF02IYY12.13.63.F08.1.454.CMB.1.raw
  modified_base (120)..(120): a, c, t, g, unknown or other
  misc_feature (120)..(120): n is a, c, g, or t
  modified_base (410)..(410): a, c, t, g, unknown or other
  misc_feature (410)..(410): n is a, c, g, or t
tcagtcacgtactacacgaccggtgctcgatttagcgatcgtataaggggacccaaaaaccacacccctccttgggagaatcccgtagatcacagctcctcaccatggactggacctggngcatccttttcttggtggcagcggcaacaggtgtccaccctgaggttcagttggttcagtctggaggagggtgaagaagcctggggcctcagtgcaggtcgcctgcagggcctcgtggttactattttcgactaacgtttggccatctacgtgggtgccgacacggcccctggcccacggccttgagtcgcgtggggtgatcagttgttacgaaggtgacacagtactttgcacgagtaagtttgaggcagagtcacctgaccacagacacatccgcgaacacagcctanagtcgaactgaggatcgtagacacgtcagacgacgacgactatactactactgtagacgtaagtacggttacgggtttcgggcgtccggtaaccttccgtcgttgagtacgttcggtacggggccgaaggggacctaaggtcggttaccgaccggttcgtccttacgaccgtaccccg

SEQ ID NO: 119541 - DNA, 924 bp, Homo sapiens
  misc_feature: GYAE6OF02HZHUV.13.63.F08.1.454.CMB.1.raw
tcagtcacgtactacacgaccggtgctcgatttagcgatcgtataaggggacccaaaaaaccacacccctccttgggagaatcccgtagatcacagctcctcaccatggacgtcgaccgtggagacactttcctttttcgttgggtcggcgacgcggcaaaccgaagggttcggtccccaacccgttcgaaggtttcctaacgttggttcgagtcgtggagggaggggtgaaggaaggccgtggggcctacgaggtcgcggacggtcgaccgtggacgtacgggtccttcgttacggttactagttttcggaccttaaccgttttcggtacctacgtttcctttaccggtcgggtacggtaccgtacgtaaccgggttccccgttacgggacccgtaccgggtaccgtttccgggaacggttccgggtaccggttgggggtacggtacggtacgtaacgggtttacggttaacggtaaccggtgtaaccgtaaccggtaacggtaaacgtttacggacgtaaacgtaaggtaacgttagggacgggaacgtaacggtaccgtaccggtaccgtaacgaaccgtaacgaacgtaaccgaacctaccggtacccggaacgaaaccgacgaacgtacccgtaacgaacgtaccgaaacgtacgtaacggtaacgtacggtaacgacgtaacgtacgtaccggaccgaacgtacccggtaccttaacgtaccgtaccgttaacgtcggtaacgtaaccggtaacgggtaacgggtttaccggggttacgggacggtaaccgtaaccgtttcgtaacgttacgtacggttacggttccgggtaccggggttaccggaacggttaaccgtacggttcccggttaacgtacccggttacccgtttacggttcccgggaacccgttccccgg

SEQ ID NO: 119542 - DNA, 673 bp, Homo sapiens
  misc_feature: GYAE6OF02JT9IR.13.63.F08.1.454.CMB.1.raw
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagagcctggggcctcgagtgcaggtcgccgtgcgagggcctcgtggttactattttcgactaactttggctagtctacgtgggtcgcgacgacggccctggccacggtccttgacgtcgcgtgggtgactcgaggttgtacgacggtgacacagtcttgcacgtagtagttgnggcagntaccaccgtgaccacacgaccactacgtcccgaacaaccgaccgacgtacctaacgtagtacggaaactacgggaagtaacgtacgtacgaactacttaccgagtaacccggaacgtaccggaacctaagtaacttacgtttaacgtggtacgacgggtaacggtaacgggttacggggttttaccgggacggtacccggtaccttcccgtagttacggtaagtccggtacggttacgggaccggtaagggaccttagggtccgttaccggccgttccggtcttaccggctaaccccgg

SEQ ID NO: 119543 - DNA, 728 bp, Homo sapiens
  misc_feature: GYAE6OF02HWREO.13.63.F08.1.454.CMB.1.raw
  modified_base (273)..(273): a, c, t, g, unknown or other
  misc_feature (273)..(273): n is a, c, g, or t
tcagtcacgtactacacgaccggtgctcgatttagcgatcgtataaggggacccaaaaaccacaccccctccttgggagaatcccgtagatcacagctcctcaccatggactggacctggagcatccttttcttggtggcagcggcaacaggtgtccaccctgaggttcagttggttcagtctggaggagggtgaagaagcctggggcctcagtgcaggtcgcctgcagggcctctggttacattttcgactaactttggcatctactgggtncgacaggcccctggccacggccttgagtcggctggggtggatcgagttgttacacggtgacacagactttgcacagtaagtttggagggcaggtacgtaccaccccttagacccgtaacacgtaaccaacgactcccggacgtaaccaaccgacgaccctaacacgtacggaaacctcggtaaggattacctagaacctaacgtacgtacgaaccggaacacgggaccctaatacgttaacgtttacgttaggtacggtacggaacgttaaacggggttaccggggttttttacggggggacccggttaccggttaccgttacccgtttccggttacgtaacggtaccgttcggttaccggggggtcccgtaaacggggggttaacgtaaacggttaccggggttaccgtaaccccggttccggtttacccgtttaccgaccggttaacccccgg

SEQ ID NO: 119544 - DNA, 630 bp, Homo sapiens
  misc_feature: GYAE6OF02HIM0I.13.63.F08.1.454.CMB.1.raw
  modified_base (334)..(334): a, c, t, g, unknown or other
  misc_feature (334)..(334): n is a, c, g, or t
  modified_base (367)..(367): a, c, t, g, unknown or other
  misc_feature (367)..(367): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcgagtgcaggtcgcctgcagggcctcgtggttacattttcgactaactttggcatctactgggtgcgacaggcccctggccacggccttgagtcgcgtggggtgatcaggttgttacaacggtnacacagactttgcacagtaagtttgagggcagngtcacccgtgaccacaggaccacacgtcccggacgaaaccacacgaccctaacagtacggaacttggaacggaacttcgtagacagttcgtacgacgaaccgaccggaccatatacttactgtagacgaaggtaacgggttacgggtttttaggggcggtaccggaccttccgttcgttagacgtacggttcggtcggggaccggtaacggggacgtaaggtcggttaccgtaccgttccgttcgttaccgtacgtaccccgg

SEQ ID NO: 119545 - DNA, 643 bp, Homo sapiens
  misc_feature: GYAE6OF02IGZPD.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgactaactttggcatctactgggtgcgacaggcccctggccacggccttgagtcgctggggtgatcagttgttacgacggtgacacagactttgacacagagtttgaggtcagagtcacctgaccacagacacatccgacgaaccacacgaccctacgacgtacggaaactacggaacggtaaacttccgtacgaactacgttaccgtacggaaccgaaccgaccggtaccctaattaacgttaacgtttaacgtggttaaccgacggtaacggtaaggggtttaccgggttttacgggggccgtacgggtaccttccgttacgttgaagtcgtcggtacgggtccggaagggacctaagtcggtacctaccggtcgtccttacgacgtaccccg

SEQ ID NO: 119546 - DNA, 863 bp, Homo sapiens
  misc_feature: GYAE6OF02JPS5R.13.63.F08.1.454.CMB.1.raw
  modified_base (296)..(296): a, c, t, g, unknown or other
  misc_feature (296)..(296): n is a, c, g, or t
tcagtcacgtactacacgaccggtgctcgatttagcgatcgtataagggacccaaaaaccaacacccctccttgggagaatcccgtagatcacagctcctcaccatggactggacctggaggcattcctttttctttggtggcagcggcaacaggtgtccaccctgaggttcagttggttcagtctggaggaggggtgaagaagcgtgggcctcagtgcgaggtcgctgcgacgggtcctcgtggttaactagtttttacgaacgtaaccgtttggctactactacgttggggttnccgtacgacggcccctaggcccgaccggtccgttagacgtcggcgtggggtacgtatcgagtttcgttacgaacggttgacacgtacgtacgtttgcgaactagtacggtttaggacgggtacaagtacggtcctacccgtacgaacccgacgaacgacctaactaaccgtcccggaaacggtaaaccaacgtacctaccgtttaaccgacggttacggaaaccgtaagggtaacgttaaactaccgttaggtaacttaaccgtacgggttaccaaccggaaccgtaaccccgggtacctaaaatttaaccgtttacccgtttaaagggttcgttaaaccgggaccggggttaacgggttaaaaacgggggtttttcccggggttttaaggggtccccgggtaaaacccggtacccttttaccgggtttaccgttaggggtaaaccccgttaggtttcccggggtaaccggggttaccgggtaaaccggggtttaaacctaacggggtttacccggtccccggttaaactttccccttttacggtaccgttacccgtaacccccggg

SEQ ID NO: 119547 - DNA, 898 bp, Homo sapiens
  misc_feature: GYAE6OF02G63XT.13.63.F08.1.454.CMB.1.raw
  modified_base (361)..(361): a, c, t, g, unknown or other
  misc_feature (361)..(361): n is a, c, g, or t
tcagtcacgtactacacgaccggtgctcgatttagcgatcgtataaggggacccaaaaaccacacccctccttgggagaatcccgtagatcacagctcctcaccatggactggacctggagcattcctttttcttggtggcagcggcaacaggtgtccaccctggaggttcaggttggttcagtctggaggaggggtgaagagccgtgggcctagagtgcgaggtcgcgtgcgacggcctcgtaggttactatttcgactacgtttgcatctacgtggtgcgacgacggtccccgtcggccgacggcctttgacgtccggcgtgggggtgacgttcgtaggtttcgtaaccgaacgggttnaaccgtacgtaagggttaccttttacggacgtaacgtaggtttaaaggtttgggaacggggtacaacggtactcccgtaaaccccggtcgaaacccacggtaacaaccgaaccgtacgtaccccgaaccgggaaaccaccggtaaccgtacccgtaaccgtaacgtaacgggtaaccgtaacgggtaaagggtaaccttaccggtaacgttaccgtaacgttacggtaaccggtaaccgaaccccggtaacccggaacccttaaagttaaaccgtttaccgtttacggttacggttaccgggaacgggttaaaccggggttaacggggttttaacccgggggttttttagggggcccgggttaaacccggttaccggtttacccgtttaccgggttacgggttaaccggttcggtttcccgggggttaaccggggtaccggggttaaacgggggtaaacccgtttacgggttaaccgggttccccgttaacccggttttccgttaccccgtttaccggtaccccggtaaacccccgg

SEQ ID NO: 119548 - DNA, 627 bp, Homo sapiens
  misc_feature: GYAE6OF02IUGVD.13.63.F08.1.454.CMB.1.raw
tcagtcacgtactacacgaccggtgctcgatttagcgatcgtataaggggacccaaaaaaccacaccccctccttgggagaatcccctagatcacagctcctcaccatggactggacctggagcatcctttttcttggtggcagcagcaacaggtgcccactcccaggttcagctggtgcagtctgcagctgaggtgaagaagcctggggcctcagtgaagatctcctgcaaggcttctggttaccacctttagcagctatcttatcagtcgtgggtgcgacgacggccccgtggacgaggacgtcgaggtggagtgggatggactcacgtacccttaagaacggaaacacagtactagtacggaacacgaacctcgagggactacgacttccgacaagtcgacgaacacgtaacacaactaaccgaacgaaacacaacgtacctaacgacgtaggaacggtaggaacggacgtaccgtagaacgatagtacggaaccgtacgaccggtcgttagtaacgtttagttacggtgacggtagaggttacggaggttcggacgtaagggtcggtaattaacggttaccgaaaacgttaaccgttaacttaacgttaacgttactaacggg

SEQ ID NO: 119549 - DNA, 660 bp, Homo sapiens
  misc_feature: GYAE6OF02GHII5.13.63.F08.1.454.CMB.1.raw
  modified_base (355)..(355): a, c, t, g, unknown or other
  misc_feature (355)..(355): n is a, c, g, or t
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagcctggggcctcgagtgcaggtcgcctgcagggcctcgtggttactattttcgactaactttggcatctacgtgggtgcgacacggcccctggccacggccttgacgtcgcgtggggtgatctagttcgtacacggtgacacagtactttgacanagtaagtttggaggcagagtccaccgtgaaccacacgacacactccgacgaacacacgcctacgatacgaacgtagagaactcgtagactacgtcgtagacgaacgacgacctaacgtaattaacgttacgtacggttagacggtaaggtaacgggttacggggtttttacggggacggtaccgggtaaccgttacccgttacgttaggtacgtacgttccggtacggggtacccgggaacgggtaccgtaacggtacggttaccgttacccgttaccgttaccgttaccgtaccgttaccccgg

SEQ ID NO: 119550 - DNA, 800 bp, Homo sapiens
  misc_feature: GYAE6OF02IS0ME.13.63.F08.1.454.CMB.1.raw
tcagtcacgtactacacgaccggtgctcgatttagcgatcgtataaggggacccaaaaaccacaccccctccttgggagaatcccgtagatcacagctcctcaccatggactggacctggagcatcctttttcgttggtggcagcggcaacaggtgtccaccctgaggttcagttggttcagtcgtggaggagggtgaagaagccgtgggcctcagtgcgaggtcgctgcgagggcctcgtggttactatttcgactaacgtttggctatctacgtgggtgcgacacggccccgtggcccgaccggtccgttaggacgtcgtcgttgggggtggacttcgtagtttaggttaaccgacgggttacgacctaacgagttaccgttttgactaacgtaggttaaggtttggaagggtcgaaggtacgtaccgaacccgtcgaacctaacaacgaaccgactaccgtcccgacgtaaaccgaccgtacgaccctaactacgtacggtaaacgtaggaacggtaacttccgtacgaactacgttacgtacggtaaaccgaccgtaccggacctaaagttacgtttaacttacgtacggtacggtaccggaaggggtttaaaccgggttttcgggggttttacgggggcccggttacccgggttaacccgtttaccgttacgtttagggacgtttaaccggtcggggttaaccgggggtacccggtaacggggtaaccgttaacggttccgggttaacccgttacccggttacgtttacccggttccgacccggttaacccccgg

SEQ ID NO: 119551 - DNA, 729 bp, Homo sapiens
  misc_feature: GYAE6OF02HUEJ9.13.63.F08.1.454.CMB.1.raw
  modified_base (421)..(421): a, c, t, g, unknown or other
  misc_feature (421)..(421): n is a, c, g, or t
tcagtcacgtactacacgaccggtgctcgatttagcgatcgtataaggggacccaaaaaaccacaccccctccttgggagaatcccgtagatcacagctcctcaccatggactggacctggagcattccttttcttggtggcagcggcaacaggtgtccaccctgaggttcagttggttcagtctggaggaggggtgaagaagccgtgggcctcgagtgcaggtcgcctgcaggctcgtggttactatttcgactaactttggctatctacgtggtgcgacgacggtccccgtggcccgaccggcctttaggacgtccggcggtggggtgacgttcaggtttcgttaacgacggttgacaacgagtctttacgcaacgtagtaagtttggacgggacaggacgtccaaccgtcgaaccaanaacgaacacgacctacccggaccgaaaccacgaccggtacccaacgtacgtaacggaactaggaaacggttaactcgtacgactactcgagaccgaacaccgtacctaaacttacgttaactttcgtcggttagaaccggtaaagggttacggggtttacggggttttacgggccggttacgttaaccgttccgttacgttagggtaagtccggttcgggtaaccggggtaccggaacgggtaacggttaaccggtcgggttaacccgtacccggttacctttacccgttacgaccccgttaacccgg

SEQ ID NO: 119552 - DNA, 779 bp, Homo sapiens
  misc_feature: GYAE6OF02IKS89.13.63.F08.1.454.CMB.1.raw
  modified_base (146)..(146): a, c, t, g, unknown or other
  misc_feature (146)..(146): n is a, c, g, or t
tcagtcacgtactacacgaccggtgctcgatttagcgatcgtataaggggacccaaaaaaccacacccctccttgggagaatcccgtagatcacagctcctcaccatggactggacctggagcatccttttcttggtggcagcggnaacaggtgtccacctgaggttcagttggtcagtctggaggagggtgaagaagccgtgggcctcagtgcaggtcgcctgcgagggcctcgtggttactattttcgactaactttggcatctacgtgggtcgcgacaggccccgtggccacggcctgacgtcgcgttggggtggacgtcgtagtttggttaaccgtaaggtacgacaacctagtacgttttgaccaacgtaagaacggttttggaagggtacgaagtacgtaccgtaaccccgtacgaacctaaacgacgaaacctaacgtaacgtacccggaccgtaaaaccaaccgaacggtaccctaacgtacggtacggtaaacgttacgggtaaacggaaagtttaccgtaggtaaaccgtacttaccgttacgaaaccgggtaacccgaaaccgggacctaacgttaattaacgtttaacgtacggtacggtacgggtaaacgggtaaacggggtttaccggggtttttacgggggacccgggttacggtacccggttcccgtacggtttagacggttacggtaccggtccggggtacggaaggggtaaccgtaggttacggtccggtaccgtccgttaccgttccgacgtacccccgg

SEQ ID NO: 119553 - DNA, 628 bp, Homo sapiens
  misc_feature: GYAE6OF02GIPOQ.13.63.F08.1.454.CMB.1.raw
  modified_base (281)..(281): a, c, t, g, unknown or other
  misc_feature (281)..(281): n is a, c, g, or t
  modified_base (356)..(356): a, c, t, g, unknown or other
  misc_feature (356)..(356): n is a, c, g, or t
  modified_base (389)..(389): a, c, t, g, unknown or other
  misc_feature (389)..(389): n is a, c, g, or t
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggaggggtgaagaagccgtggggcctcagtgcaggtcgcctgcagggcctctggttacattttcgactaactttggcatctacgtgggtgcgacncggcccctggccacggccttgagtcgcgtggggtagactcgagttgttaccaacggtgaacacagtactttgcanacgtagttgaggcagagtcacctagacctacanacacactccgacgaacacactacctacaagtacggaactgaacgtaactacgtcgaacacgttacgacgaacggacctaaccgggaccctaattaacttactttaaccgtgtagtaccgtaagggtaacgggtttaacgggttttcggggaccggtaccggaccgttctacgttcgaagtcgtcggtcgggacgtaggggactaagtcggtaccgtaccgtcctcgttcgacgtacccg

SEQ ID NO: 119554 - DNA, 945 bp, Homo sapiens
  misc_feature: GYAE6OF02H1I8N.13.63.F08.1.454.CMB.1.raw
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctgaggttcagttggttcagtctggaggagggtgaagagccgtggggcctcagtgcgacggtcgccgtgcgacgggtcctcgttggttactattttcgactaacgtttcggctatctacgtgggtcgacgtacgacggtcccgtcggacccgacggtcccgttacggtacggtccggtcggttgggggtaggtaacgttcgttaggtttacggtttaaccgaacgggttacgaaccgtacgtaacggttaccgtttcgacctaacgtacgggttaaacggttttagggaacgggtacggtaacggtaaccggttacccgtaaccccgttaaccgtaaccccgtaaccgaaacggaacccgaaccgtaaccgttaaccccggaacccgtaaaaacccgaccgtaacccgtacccgtaaacccgaacggttaaccgggtaaacgtacgggtaaacggttaaacgttaccgtaaccggtactaacgttacccgtaccggtaaaccgaccggtaacccgtaaccgtaacgtttaaaccttaaacgtttaaccgttaagggtaaccgtaaccgggtaaacgggggttaaaccggggttttaacgggggtttttaccgggggacccggttacgggttaaccccgtttacgtttaccgggtttacggaacggtttaccggtccgggttaaccgggggtaccgggtaaacggggtaaccgttaaccggttacgggttacccgttaacccggtttccgtttaacccgtttacccggaccggtttaaccccccgg

SEQ ID NO: 119555 - DNA, 745 bp, Homo sapiens
  misc_feature: GYAE6OF02FKHC4.13.63.F08.1.454.CMB.1.raw
  modified_base (253)..(253): a, c, t, g, unknown or other
  misc_feature (253)..(253): n is a, c, g, or t
  modified_base (331)..(331): a, c, t, g, unknown or other
  misc_feature (331)..(331): n is a, c, g, or t
tcagtcacgtactacacgaccggtgctcgatttagcgatcgtataaggggacccaaaaaccacacccctccttgggagaatcccgtagatcacagctcctcaccatggactggacctggagcatcctttttcttggtggcagcggcaacaggtgtccaccctggaggttcagttggttcagtctgggaggaggggtgaagaagccgtggggccctcgagtgcaggtccgccgtgcagggtcctctggttactntttcgactaacgtttgcatcgtacgtgggtcgcgacgacggcccctggccacggtccttggagtcgcgtgggggtagngtacgtagttcgttaacgaacggttacgaacgtacgacgtacgtttgactaacgaggttaaacggtttcgaaggggtcaaggtacgtccgacccgttacgaaccaccgtaacggactaacgaccgtcccgtaacggaaacaccacggtacctaacgacgtaacggtaactacggtaacgggtaaattcgtacgaactactacggtaacaccggaaccgtacggccctaaagttactacgtttagtacggtcggtaacgtaacggttaaacgggtttcgggttttacggggccggtccgggtactttcccgttagttacggacgttacgggtccggtacggggaccggtaaggggaaacccgtagggtccgggttccttaacccggttccggttcttacggacccgttaacccgg

SEQ ID NO: 119556 - DNA, 680 bp, Homo sapiens
  misc_feature: GYAE6OF02HOYH0.13.63.F08.1.454.CMB.1.raw
  modified_base (281)..(281): a, c, t, g, unknown or other
  misc_feature (281)..(281): n is a, c, g, or t
tcagtcacgtactacacgaccggtgctcgatttagcgatcgtataaggggacccaaaaaccacacccctccttgggagaatcccgtagatcacagctcctcaccatggactggacctggagcattcctttttcttggtggcagcggcaacaggtgtccaccctgaggttcagttggttcagtctggaggagggtgaagaagcctggggcctcagtgcaggtcgccgtgcgagggtcctcgtggttaactattttcgactaactttggcatctacgtgggtncgacgacggcccctggccacggccttgagtcgcgtgggtggatcgagttgttaacgaacggtgacacgagtactttgacctaatagtaagtttggacgggcaggactcgaaccctgaaccacacgacacactcccgaacgaaccacacgaccctaacgtacgtacggaaacttaggaaggtaacgtcgtacgtaactacgtacgtacgtaacggaaccgaccggaccaattattaattaacgtgtacgtacgaagggtaacgggttacgggttttaggggccggtacggaaccgttccgttacgttcgacggtacgttccggtacggggaccggtaacggggtacgtaacggttcggtaacccgtaccggttcccgttaccgttcccgacgtaaccccg

SEQ ID NO: 119557 - DNA, 709 bp, Homo sapiens
  misc_feature: GYAE6OF02FWY2H.13.63.F08.1.454.CMB.1.raw
  modified_base (286)..(286): a, c, t, g, unknown or other
  misc_feature (286)..(286): n is a, c, g, or t
tcagtcacgtactacacgaccggtgctcgatttagcgatcgtataaggggacccaaaaaccacacccctccttgggagaatcccgtagatcacagctcctcaccatggactggacctggagcatccttttcttggtggcagcggcaacaggtgtccaccctgaggttcagttggttcagtctggaggaggggtgaaggaagcccgtggggcctcgagtgcaggtcgcctgcagggcctcgtggtactatttcgactacgtttggctatctacgtgggtgtcccganacggccctcggccacggtccttcggacgtccgcgtgggtgactcgtagttcgtacgaacggtgaccacgacgtactttgactacgtaagtaacggtttgacgggtcaggacgtcccaccgtagaaccgacgaagtaccaacgtacgtccgaaccgtaaacaccaacgccgtaacgagtacggaacgtaggaacggtaatacgtacgtaactagtcgtaacgacgaaccgaccggacctaatacttacttaacgtcggtaacgtcggtaaggtaagggtttcggggttttaggggaccggtacggttaccgttaccgttacgttcggacggttacggttaccggtcgggtaacccggggaacgggttaaccggtaacgttaccggtacggtacccgtccgtttacgttaccgaccggtaccccg

SEQ ID NO: 119558 - DNA, 764 bp, Homo sapiens
  misc_feature: GYAE6OF02IKV30.13.63.F08.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (436)..(436): a, c, t, g, unknown or other
  misc_feature (436)..(436): n is a, c, g, or t
tcagtcacgtactacacgaccggtgctcgatttagcgatcgtataaggggacccaaaaaccgacaccccctccttgggagaatcccgtagatcacagctcctcaccatggactggacctggagcattccttttcgttggtggcagcggcaacgaggtcgtccaccctgaggttcagttggttcagtctggaggtaggggtnaaggagccgtggggcctcagtgcagggtcnccgtgcgagggcctgttggttacttgtttcgaacttacgttggcagtcttacgtgggtcgacgacgacggtccccgtggacccgacggtaccgttggacggtaccgcggttggggtacggtactcgttaggttttacggttacggaacggtcgtaacacgtacggtacgtttcgactaacgtaaggtaaacgtttggacgggtanacggtacgtaccgaacccgtacgtaccgaaacgcgaacaccgtactaccgaaccggtaacaacaccggacctaacagtacggaacttagggaaacgtaagttcgagaacctacgttacgtacggaaacccgtcgaaccggtaacctaaggttaacttaacgtttaacgtggtacgtaacggtaaacgggtaacggggttttaaccggggttttcggggaccggtaccggtaaccgttccgttacgggttacggcgttacgggcggggacgtacgggtacgtagtccggttcgtaccggttcttaaccgtcgtaccgaccttaacccgg

SEQ ID NO: 119559 - DNA, 533 bp, Homo sapiens
  misc_feature: GYAE6OF01C75ZJ.35.83.H06.1.454.CMB.1.raw
  modified_base (293)..(293): a, c, t, g, unknown or other
  misc_feature (293)..(293): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggtctggtatcagcaagaaaccaggacaaaaaaccctaatcctagatttanaagcctataagttacaaagtgggtacccagcaaggttcggcgcagtggatcgtagggacagatttcactctacaccatcagcaactgcagctgaggtacttgactaacttgtactgaccaatagtaataatacgttaccctacttaacgttcggacggaaggtaccaaggtagaacgaaccaaacgtaactgtacggctggaccaccattctcgtccttacagtcccttcccgcttaacg

SEQ ID NO: 119560 - DNA, 258 bp, Homo sapiens
  misc_feature: GYAE6OF01BWWYH.35.83.H06.1.454.CMB.1.raw
  modified_base (258)..(258): a, c, t, g, unknown or other
  misc_feature (258)..(258): n is a, c, g, or t
tcagtacagatcgtcacgaccggtgctcgatttagatcacgtgcgtcgcgggaagatgaagacagatttcactctcaccatcagcaacctgcagcctgaggactttgcaacttattactgccaacagtataatagttaccctctaactttcggcggagggaccaaggtagagaccaaacgaactgtggctgcaccatctgtcttcatcttcccgccatctgaacgatctgtactgagcgggctggcaaggcgcatagn

SEQ ID NO: 119561 - DNA, 544 bp, Homo sapiens
  misc_feature: GYAE6OF01B3SRM.35.83.H06.1.454.CMB.1.raw
  modified_base (293)..(293): a, c, t, g, unknown or other
  misc_feature (293)..(293): n is a, c, g, or t
  modified_base (425)..(425): a, c, t, g, unknown or other
  misc_feature (425)..(425): n is a, c, g, or t
  modified_base (447)..(447): a, c, t, g, unknown or other
  misc_feature (447)..(447): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcaagaaaccaggacaaaaaccctaatcctagtatttanaaggcctactaagttacaaaggtcgggtaccaggcaaggttcggcggcaggtggaatcgtagggactagatttcactctcaccatcagcagtctgacaactgaatatttcgactaaccttatatttgacaanaggtaattacacgtaccgcccngattcgagtcttaccgggacaagggacacgacgtagggaagtaaattaaaggacttggtggaccttaggacctaaccctattccctgttccgttaac

SEQ ID NO: 119562 - DNA, 309 bp, Homo sapiens
  misc_feature: GYAE6OF01B9463.35.83.H06.1.454.CMB.1.raw
  modified_base (262)..(262): a, c, t, g, unknown or other
  misc_feature (262)..(262): n is a, c, g, or t
  modified_base (269)..(271): a, c, t, g, unknown or other
  misc_feature (269)..(271): n is a, c, g, or t
  modified_base (273)..(309): a, c, t, g, unknown or other
  misc_feature (273)..(309): n is a, c, g, or t
tcagtacagatcgtcacgaccggtgctcgatttagatcacgtgcggtacggccgggaaagatcgaagacgagatttccactctcaccatcagcaacctgcagcctgaggactttgctaactttattactgccaacagtataatacgttaccctctaactttcggcggtagggaccaaggtagagaccaaacgactgtggctgcacatctgtcttcatcttcccgcatctgaacgatctgtactgagtcgggctggcaaggcncagtagnnncnnnnnnnnnnnnnnnnnnnnnnnnnnnnnnnnnnnnn

SEQ ID NO: 119563 - DNA, 631 bp, Homo sapiens
  misc_feature: GYAE6OF01BRSFA.35.83.H06.1.454.CMB.1.raw
  modified_base (193)..(193): a, c, t, g, unknown or other
  misc_feature (193)..(193): n is a, c, g, or t
  modified_base (234)..(234): a, c, t, g, unknown or other
  misc_feature (234)..(234): n is a, c, g, or t
  modified_base (291)..(291): a, c, t, g, unknown or other
  misc_feature (291)..(291): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagngactggttggcctggtatcagcagaaaccaggacaaaaaccctaactcctagattanaagcctatagttacaagtgggtccagcaaggttcgcgcagtggatcgtgggacagtactttcactctcaccatcagcaacctgcagcctagacgtacttgactaactttatactgaccctaagtagttaattaaacgttacgtttaacccccttagttaaaccggttttccggggacgggtaaacgggtaacctaaaggggttaagaaaccggtaaacccgtaaaaacggtaaaccggttacgggtacgggtaccgttacggaccctaaaccccgtagtttacccgttaggtttaccctttacgtaaacccgttttccctttccccccggctttaaaccg

SEQ ID NO: 119564 - DNA, 557 bp, Homo sapiens
  misc_feature: GYAE6OF01CX43J.35.83.H06.1.454.CMB.1.raw
tcagtacagatcgtcacgaccggtgctcgatttagatcacgtgcgtcgcgggggagtacgagacccagtcaggacacagcatggacatgaggtccccgctcagctcctggggctcctgctgctcgtggctcccaggtgccaaggtgtcgacagttcgaaatgaccctagttctccttccaccctgtctgcatctggtgggagacgagcgtcgatcattcacttgccgtggccagtcagactattagtgactggttcggtcttgggtatcagtcaagaaaccaggacaaaaaccctaactcctagattcgtttaaggctactacttagaggaggtcgggtccagtcgaaggttcagcgactagtgatcgtaggactagtacttcactctacacctatacaccgagcctgcacgtcctgatgtatttacgacctaacctattacctgaccctaatagttctggtactacttccgtataccgtttccggccgtaaggacctaaaggtcggaatacgtcaaacgtattgtacggtctgacctacgtattcctgttccttac

SEQ ID NO: 119565 - DNA, 519 bp, Homo sapiens
  misc_feature: GYAE6OF01BQ0UA.35.83.H06.1.454.CMB.1.raw
  modified_base (293)..(293): a, c, t, g, unknown or other
  misc_feature (293)..(293): n is a, c, g, or t
  modified_base (407)..(407): a, c, t, g, unknown or other
  misc_feature (407)..(407): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcaagaaaccaggacaaaaaccctaactcctagatttanaaggctactagtttacaaagtgggtccagcaaggttcgcgcagtgatctgggacagatttcactctcaccatcagcaacctgcagcctagaggtactttgactaacttattacngaccaatagtataatacgttaccctataacgtttgggacggaggaccaagggtagaacgaaccaaacgactggtaggctgacctacatctagtcttacatccttcccgctac

SEQ ID NO: 119566 - DNA, 626 bp, Homo sapiens
  misc_feature: GYAE6OF01EPWK0.35.83.H06.1.454.CMB.1.raw
  modified_base (193)..(193): a, c, t, g, unknown or other
  misc_feature (193)..(193): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgacgtggttggcctggtatcagcaagaaaccaggaaccaaaaaccctaactcctagtaatttaagaacggtccttacgttaagttttaacgaaaggttcggggttacccaaggtaccgtaagggttccggacggtacaggtggacttcgtaggggacaggtatttcgacttctacacctatcacgcaacctgacagtcctaggtacggtactttgacttaactttatacctcgaccctaaagtagttaataacgttaacgttaacccttacgttaaccgtttcggggaccggtaacgggtaaccaagggtacaacgtaaaccaaacggtaacgtggtacggctacgactaccctattccgtgttcccttactacttcccgttcccgcctacg

SEQ ID NO: 119567 - DNA, 565 bp, Homo sapiens
  misc_feature: GYAE6OF01AG32X.35.83.H06.1.454.CMB.1.raw
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
  modified_base (416)..(416): a, c, t, g, unknown or other
  misc_feature (416)..(416): n is a, c, g, or t
tcagtacagatcgtcacgaccggtgctcgatttagatcacgtgcgtcggcgggggagtcagacccagtcaggacacagcatggacatgagggtccccgctcagctcctgggctcctgtcgttgctctggctcccgaggtgccaaggtgtgacatcgaaatgacccagtctccttccaccctgtctgcatctgtggganacagcgtcatcatcacttgcctggccagtcagacgattagtgactggttgcctggtatcagcagaaaccaggacaaaaaccctaactcctgatttaanaaggcctactagtttacaaagtgggtcccagcaaggttcggcgacagtggatcgtgggacagtatttcactctacactatcagcaacctgcagcctgagtacttgactaactttattacngaccaactagttaataattacgttaacccctattaacgtttcgggacggtaagggacctaaagggttacaacgtaaacccaaacgaaacgttgtacgggtctaggaccaccctattcctagttccttacgattccgttcccgcctaacg

SEQ ID NO: 119568 - DNA, 574 bp, Homo sapiens
  misc_feature: GYAE6OF01CPMV9.35.83.H06.1.454.CMB.1.raw
  modified_base (294)..(294): a, c, t, g, unknown or other
  misc_feature (294)..(294): n is a, c, g, or t
  modified_base (378)..(378): a, c, t, g, unknown or other
  misc_feature (378)..(378): n is a, c, g, or t
  modified_base (420)..(420): a, c, t, g, unknown or other
  misc_feature (420)..(420): n is a, c, g, or t
  modified_base (431)..(431): a, c, t, g, unknown or other
  misc_feature (431)..(431): n is a, c, g, or t
tcagtacagatcgtcacgaccggtgctcgatttagatcacgtgcgtcgcgggggagtcagacccagtcaggacacagcatggacattagggtccccgctcagctcctggggctcctgctgctctggctcccaggtgccaagtgttacatcgaaatgacccagtctccttccaccctgtctgcatctgtgggagacagcgtcatcatcacttgcctggccagtcagacgattagtgactggttggtctggtatcagcaagaaaccaggaccaaaaaccctaactcctagatttanaacggccttactagtttaacaaaggttcggggtacccaggcaagggttcggcggcaggtggatcgtgggacagtatttcactcncaccatcagcaacctgcagcctgacgtactttgactaacttntactgaccaanagtaataatacgttacccttcttaacgttcgggacggtacgggtaaccaaggtacgaacgaccaaaacggacgttggacggctggacctaccgtatccgttacgttctttcctaacttcccttaccccgactagtccgtaacg

SEQ ID NO: 119569 - DNA, 595 bp, Homo sapiens
  misc_feature: GYAE6OF01EYIH9.35.83.H06.1.454.CMB.1.raw
  modified_base (193)..(193): a, c, t, g, unknown or other
  misc_feature (193)..(193): n is a, c, g, or t
  modified_base (440)..(440): a, c, t, g, unknown or other
  misc_feature (440)..(440): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttggcctggtatcagcaagaaaccaggaaccaaaaaccctaactcctagtaatttaataacggtccctacgttaagtttaacaaaggttcggggtaccccaaggtcgtaaagggttcggcggtacaggtggatcgtgggacagtatttcactctacaccatcagcaacctgcagcctgacgtacttgactaacttatacngaccaatagttaataagttacgttaaccctagttaacgtttcgggacggtaacgggtacctaaagggtacgaacgtaacccgaaaacgtacgtggtacggctaggacctaaccagttccttagttaccttacacgttccctttccccgcttaacg

SEQ ID NO: 119570 - DNA, 605 bp, Homo sapiens
  misc_feature: GYAE6OF01D5DWV.35.83.H06.1.454.CMB.1.raw
  modified_base (194)..(194): a, c, t, g, unknown or other
  misc_feature (194)..(194): n is a, c, g, or t
  modified_base (441)..(441): a, c, t, g, unknown or other
  misc_feature (441)..(441): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctggtggganacagcgtcatcatcacttgcctggccagtcagacgattagtgactggttggcctggtatcagcagaaaccaggaccaaaaaccctaactcctagtaatttataacggccttactaagtttaacaaaggtcggggtacccaggtcgaagggttcggcggcaggtcggatcgtgggacaggtatttcactctacacatcagcaacctgcagcctgacggtactttgactaacttattactcgacctaanagttaataatacgttacccttacttaaccgtttcgggacggtaacggaacctaaagggtacgaacgaaacccgaaaacggtactaggtcggaccttaggaccctaaccctagttcccttacggtttaccctttacctaacgtttccccttccccggacctaacg

SEQ ID NO: 119571 - DNA, 614 bp, Homo sapiens
  misc_feature: GYAE6OF01DYDFO.35.83.H06.1.454.CMB.1.raw
  modified_base (193)..(193): a, c, t, g, unknown or other
  misc_feature (193)..(193): n is a, c, g, or t
  modified_base (296)..(296): a, c, t, g, unknown or other
  misc_feature (296)..(296): n is a, c, g, or t
  modified_base (369)..(369): a, c, t, g, unknown or other
  misc_feature (369)..(369): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttcggcctggtatcagcaagaaaccaggaccaaaaaccctaactcctagatttaanaaggtcctacttaagtttacaaaggtcgggtacccagcaagggttcggacggcaggtgatcgtagggacagtntttcactctcacctatcagccaactgacacgtcctgaggtactttgaccttaacttattacctacgacctaacgtagttaattaacttacgttaaccccttagttaaccgttttcggggacggtaacgggacctaaagggtacgaacgtaaccaaaacggtacttaggtacgggccttaggaccctaacctacgttccgttacggttaccctttacaccgtttcccttacccccggtacttaacg

SEQ ID NO: 119572 - DNA, 648 bp, Homo sapiens
  misc_feature: GYAE6OF01CGDKU.35.83.H06.1.454.CMB.1.raw
  modified_base (98)..(98): a, c, t, g, unknown or other
  misc_feature (98)..(98): n is a, c, g, or t
  modified_base (229)..(229): a, c, t, g, unknown or other
  misc_feature (229)..(229): n is a, c, g, or t
tcagtacagatcgtcacgaccggtgctcgatttagatcacgtgcgtcgcgggggagtcagacccagtcaggacacagcatggacatgagggtccccgntcagctcctggggctcctgctgctctggcctcccgaggtcgaccaagtgtagacatacgaaatcgaccagtcctccggcctcctgtctggtgctggtcggagacagactcgaccatcacgttcggccgganaagtcacggtaccgttcgcgtacttaatttaagttggtatacgagacaacgaaaccgaacgggaaccgtccctacgacgctgctgcctactactactgtactcttacgtttacctacgtttcggttcgggtaccctagttacgtaaggttccgaggtcggacgtaggttcggtttcgtaggggtaactaggttactttcactctactacttactcgacgctacgtcgtacgacctaaccgtgaagtacgttgttacgaaccttaaactttactacttcgtaacaactacgtaacttacgaccggtacccttaattccgtaaccgtttccggacccgtcggaacctacgtacgtaacgaaactccgaagtaccgtaacgttcggtacgcttacgacctaacctagttcctgttccttacc

SEQ ID NO: 119573 - DNA, 590 bp, Homo sapiens
  misc_feature: GYAE6OF01EKKNQ.35.83.H06.1.454.CMB.1.raw
  modified_base (294)..(294): a, c, t, g, unknown or other
  misc_feature (294)..(294): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcagaaaccaggacaaaaaccctaactcctagtaatttanaacggtcctactaagttttaacaaaggttcggggtaccccaaggtccgtaaggttcggcggacaggtggatcgtagggacagtactttcactctacacctatcagcaactgcagctagagtactttgactaacttatactgaccaatagttaactaagtacgtttaacccctgttaaaccgttcgggacggtaacggtacctaaagggtacgaacgaaaccgtaaacgtaaccgtggtacggacttagacctaccattcgtacgttaccttacctaattcccgttcccggctaacg

SEQ ID NO: 119574 - DNA, 770 bp, Homo sapiens
  misc_feature: GYAE6OF01BNGLC.35.83.H06.1.454.CMB.1.raw
  modified_base (98)..(98): a, c, t, g, unknown or other
  misc_feature (98)..(98): n is a, c, g, or t
  modified_base (196)..(196): a, c, t, g, unknown or other
  misc_feature (196)..(196): n is a, c, g, or t
  modified_base (238)..(238): a, c, t, g, unknown or other
  misc_feature (238)..(238): n is a, c, g, or t
tcagtacagatcgtcacgaccggtgctcgatttagatcacgtgcgtcgcgggggagtcagacccagtcaggacacagcatggacatgagggtccccgntcagctcctggggctcctgctgctctggctcccaggtgccaagtgtgacatcgaaatcgacccagtcctccttccaccctgtctgcatctggtggganacagcctcatcatcacttgcctggccagtcagacgtattagngtacgtggttgccttaggtatcgagcaaagaaaccaggaaccaaaaaaccctaactcctagtaattagtaacgtccttactaagttttaacgaaagggttcggggtaccccaaggtacgtaaacggggttccggaccgggtacgtaggtacggtaatccggtaggggaactaaggttacttttcgaaccttcctaacgaaccctaataccgaagaccctaaaccgtcgaccgtaacgtcccgttaggtaacggtaacttttacggaacttaaacctttagttaacctaccggtaaccctaaaagtaacgttaaactttaaacgtttaacccggttttaacccctttaaccgttaaaccggtttccggggaaccgggtaacgggtaaacccgtaaaggggttaacgaaaccggtaaaacccggtaaaaccgtaaaccggttagggtaccggtaccttaaccggacctaaaccccgttattccgttacggttaccctttaccgtacctttaccccgtttccccggaccttaacg

SEQ ID NO: 119575 - DNA, 817 bp, Homo sapiens
  misc_feature: GYAE6OF01C6UEL.35.83.H06.1.454.CMB.1.raw
  modified_base (136)..(136): a, c, t, g, unknown or other
  misc_feature (136)..(136): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtnccaagtgtgacatcgaaatgacccagtcctccttccacctgtctgcatcgtggtgggagacagcgtcatcactctaccttcgcctcggccagtcagtacgtagttagtgtacgtcggttcggtcctcggtatacacgacaaacgaaccgaacggaaaccctaaaaaccctaactacgttacgttaagttaacgtacggtaccttacgttaacggtttaactaaagggtcggggttacccaggtacgtacggggttaccggcggacgtagggtggtacgttcggtaggggaactaggttactttacctacctccgttaccaacctataccgaacgtaaccgtaccttacggactaccggtacccgttagggtaaaccggtttacctttagaaccctttaacgttttacgttaacctacggaaccctaaacgttaagtttaaaccttaaccgtttaaccggtttaacccccttacggttttaaacgggttccggggaaccggggtaaccggtaaaccgtaaacggggtaacgaaccggtaaaacccgtaaaccgggttaccggttcggtacgggtaacccgttacgaaccccggttaacccctaaagttttcccggtttaacccgttacccgtttaaccctttaaccccggtttcccccttacccccgggtaactttaaccgg

SEQ ID NO: 119576 - DNA, 741 bp, Homo sapiens
  misc_feature: GYAE6OF01CPM86.35.83.H06.1.454.CMB.1.raw
  modified_base (237)..(237): a, c, t, g, unknown or other
  misc_feature (237)..(237): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtcctccttccaccctgtctgcatctggtgggagacagcgtcatcatcacttgcctggccagtcagacgtattagngactggtggctggtatcagacagaaaccaggaaccaaaaaaccctaactccgtagtaacttttaagaaacggtccttagttaacgtttaaccgaaaaggtttcgggggaccccaaaggtaccggtaaaaggggtttcccgggacgggaccgtaaggggtgggtaaacgttccggttaagggggaaacctaaggtaactttttacccaaacgttccttaccaaaccctaagttacccaacggtacccaaaccggttgacccgaaacggtcccgttagggtaaggttacctttaggaacccttaaactttacgttaactcggaacctaagtaagttacgtgggtacgtaacgtttcccgttacgtacccgttttcccgggacccgttaaggggaaccctaaagggttcgaaactttagaaacccggtaaaagtaccgtgggtaccggacttcgacccgtaacttacgttccgttaagttactttacccacgttcccgttaccccgg

SEQ ID NO: 119577 - DNA, 604 bp, Homo sapiens
  misc_feature: GYAE6OF01CYSZ4.35.83.H06.1.454.CMB.1.raw
  modified_base (192)..(192): a, c, t, g, unknown or other
  misc_feature (192)..(192): n is a, c, g, or t
  modified_base (297)..(297): a, c, t, g, unknown or other
  misc_feature (297)..(297): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccacctgtctgcatctgtggganacagcgtcatcatcacttgcctggccagtcagacgtattagtgactggttcggccttggtatcagcaagaaaccaggaaccaaaaaccctaactcctagatttanaacgtcctacttaagttacaaaggtcgggtacccagacgtaaggttcggacgctaggtggatcgtagggacagtactttcacttctccaacatacacgacaaccgtgcacgcctggacgtactttacgacttaactttattacctacgaccctaataagttaactaacgttaacgtttaacccctaagtttaaccgtttccgggacggtaacgggaacctaagggtacgaaccgaaaccgtaaaccgtaacgtggtacggctagacctaccgattactcgttaccttacacttcccttcccgctacg

SEQ ID NO: 119578 - DNA, 571 bp, Homo sapiens
  misc_feature: GYAE6OF01EQQ78.35.83.H06.1.454.CMB.1.raw
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctggtgggagacagcgtcatcatcacttgcctggccagtcaggacgtattagtgactggttggcctggtatcagcaagaaaccgagggaaacgacccctaaactcctagtagttacgtttaaggcgtactacgtttaggagtaggtcggggtacccatacgtaaggttcaggcggacaggtggatcgtagggacagtactcactctacacctatccaccacgcctgacagtcctgtattagttattttcgacctaacctacttactcgaccctaagagttagtggttacgtactttccgtcttaccgttccggaccgtagggaacctaaggtagtaatacgtaacgaaacgtactggtacggtctacgacctactatctgtcttacc

SEQ ID NO: 119579 - DNA, 556 bp, Homo sapiens
  misc_feature: GYAE6OF01CMOC9.35.83.H06.1.454.CMB.1.raw
  modified_base (291)..(291): a, c, t, g, unknown or other
  misc_feature (291)..(291): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcagaaaccaggacaaaaaccctaatcctagatttanaagctactagtttacaaagtcgggtccagcaaggttcggcgcagtgatcgtgggacagtatttcactctcaccatcagcaactgcagcctgacgtacttgctaacttatactgacctaatagttaactaattacgtttaacccctattaacgtttcgggacggtaacgggaacctaagggtagaacgaacctaaacggtaactggtaggaccttggaccacctagtccttcgttacctttacactttcccgttcccgccttaacg

SEQ ID NO: 119580 - DNA, 593 bp, Homo sapiens
  misc_feature: GYAE6OF01BXQQ0.35.83.H06.1.454.CMB.1.raw
  modified_base (193)..(193): a, c, t, g, unknown or other
  misc_feature (193)..(193): n is a, c, g, or t
  modified_base (293)..(293): a, c, t, g, unknown or other
  misc_feature (293)..(293): n is a, c, g, or t
  modified_base (382)..(382): a, c, t, g, unknown or other
  misc_feature (382)..(382): n is a, c, g, or t
  modified_base (417)..(417): a, c, t, g, unknown or other
  misc_feature (417)..(417): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttggcctggtatcagcaagaaaccaggaccaaaaaccctaatcctagatttanaacggtcctattaagtttaacaaagtcgggtacccagcaaggttcggcggcaggtgatcgtagggacagtatttcactctacacatcancaactgcagcctgacgtacttgacttaattatacngaccaatagtaattaacttacgtttaaccccttagttaaaccgtttcgggacgggtaacgggaaccctaaaggggtaacgaacgaaaccctaaaacggtaacctggtacggaccttacgaccttaacctacgttcttacggttcctttacaaccgtttccccttaccccgctaacg

SEQ ID NO: 119581 - DNA, 662 bp, Homo sapiens
  misc_feature: GYAE6OF01DD495.35.83.H06.1.454.CMB.1.raw
  modified_base (123)..(123): a, c, t, g, unknown or other
  misc_feature (123)..(123): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (479)..(479): a, c, t, g, unknown or other
  misc_feature (479)..(479): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctntggctcccaggtgccaagtgtgacatacgaaatcgacccagtcctccttccaccctgtctgcatctgtggganacagctnatcatcacttgcctggccagtcagacgtattagtgtacgttggttcgcctggtatcgagacaagaaaccagaaacctaaaaaccctaactcctaagtatttaagaacgtcctacgttaagtttaacgaagggttcgggtacccagtacgtaacgggttcgacggacgtaggtaggtactcggtagggaactagtactttcaccttcgacaacctatacaacgacctaacctgacctagaccctaggtaagttaccttagacctaaactttgttacncgtaacaacgttagttaataacgttaacctttaccctaacggttaaccggtttcgggaaccgggtaacggtaaaccgtaaacgggtacgaaaaccgtaacgtaaaaccgtacgtaggtaccggtaactacgaacctactacgttccgttacgtacccttcaaccgtttccctcccgattaccg

SEQ ID NO: 119582 - DNA, 809 bp, Homo sapiens
  misc_feature: GYAE6OF01DY800.35.83.H06.1.454.CMB.1.raw
  modified_base (192)..(192): a, c, t, g, unknown or other
  misc_feature (192)..(192): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccacctgtctgcatctgtggganacagcgtcatcatcacttgcctggccagtcagacgattagtgacttgggttggcctggtatcagcaagaaaccaggaccaaaaaccctaactcctagtaatttagaacggtccttacgttaaggtttaacaaaggttcggggtaccccaaggtaccgtaaacggggttcgggacggacgtaggtacgggaacttcggtaggggaactaaggttaacttttccaccgttcctaccaaccctagttccaacgtaccctaaacccgtggaccctaacggtcccgttagggaacgggtttaaccttttacggaaccctttaaaccgttttaactttaacccgtacgtaaacccctaaaacgttaacggtttaaactttaaaacgtttaacccggttttaacccccctttacggttttaaaaccccgggtttttccggggggaaccggggttaaaccgggggtaaaccctaaaagggggttaaccggaaaccggtaaaaccccgtaaaaacgggtaaccggtttacgggtacgggtaccctttacgggaacccttaacccgttaagtttcccgttacggtttaccctttaactaccctttccccgttcccccgacttaaccg

SEQ ID NO: 119583 - DNA, 613 bp, Homo sapiens
  misc_feature: GYAE6OF01CRIXH.35.83.H06.1.454.CMB.1.raw
  modified_base (295)..(295): a, c, t, g, unknown or other
  misc_feature (295)..(295): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgacgtggttggcctggtatcagcaagaaaccaggaccaaaaaccctaactcctagatttanaagccttatagtttacaaagtcgggtacccaggcgaaggttcggcggcaggtggatcgtgggactagtactttcgactctacaccatcagccaactgacagcctagacgtacttgctaacttattactcgacctaatacgtaattaaacgtacgtttaaccccttagttaaaccggttttccgggaccgggaacgggtaaccaaaggggttacgaaacggtaaacccgaaaacggtaccgttgggtacgggtactacggaccctaacctacgttccgttcgttacccttacgaccttttacccgtccccgccgttaac

SEQ ID NO: 119584 - DNA, 560 bp, Homo sapiens
  misc_feature: GYAE6OF01E174T.35.83.H06.1.454.CMB.1.raw
  modified_base (238)..(238): a, c, t, g, unknown or other
  misc_feature (238)..(238): n is a, c, g, or t
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
tcagtacagatcgtcacgaccggtgctcgatttagatcacgtgcgtcgcgggggaggtcagacccagtcaggacacagcatggacatgagggtccccgctacagctcctggggctcctgctgctctggctcccaggtcgccaagtgtgacatcgaaatgacccagtctccttccaccctgtctgcatctgtgggagacagcgtcatcatcacttgcctggccaggtcagacgattagngactggttggcctggtatcagcagaaaccnggcaaaaaccctaactccgtgatttanaaaggcctctaggtttacaaagtgggaccagcaaggttcgcgcagtggatctagggacaggatttcactctcaccatcagcaacctgcagcctgaggacttgctaacttntaactgacccaaacnggtaactaagtacgttaaccctntaaactttcgggacggaagggacccaaagggtacagaaccaaaacgtaaactggtacggtcttaggcctaacccaatctggttaccttaccgaattaccctttccccgaccgtaacg

SEQ ID NO: 119585 - DNA, 648 bp, Homo sapiens
  misc_feature: GYAE6OF01B8T43.35.83.H06.1.454.CMB.1.raw
  modified_base (241)..(241): a, c, t, g, unknown or other
  misc_feature (241)..(241): n is a, c, g, or t
  modified_base (338)..(338): a, c, t, g, unknown or other
  misc_feature (338)..(338): n is a, c, g, or t
tcagtacagatcgtcacgaccggtgctcgatttagatcacgtgcgtcgcgggggagtcagacccagtcaggacacagcatggacatgagggtccccgctcagctccgtggggctcctgctgctctggctcccaggtgccaagtgtgacatacgaaatcgacccagtcctcccttccaccctgtctgcatcgtggtgggagacagcgtcatcatcacttgcctggccagtcagacgattagngacgtggttggcctggtatcagcaagaaaccaggaaccaaaacctaactctagtattagagcctatagttacgaagtcggtccagcgaaggtcgcgnagtgatcgtggactagtacttcactctacacctatcgacgactaaccgtgacagccgtaggaacggttactttacgaccttaagtttactaccgcgaaccctaagtaagttaacttaaacttaccggttaacccttacgttaaccggtttcggggaaccgggtaaacggtaacccgaaaggggttacgaaaccgtaaacccgtaaaacgggtaccgttagggtaccggaccgttacgaacccttaacccgtacgtttccgttaccggttaccttaccgtaacctttcccccgttccccgaaccttaaccg

SEQ ID NO: 119586 - DNA, 879 bp, Homo sapiens
  misc_feature: GYAE6OF01CZB4I.35.83.H06.1.454.CMB.1.raw
  modified_base (97)..(97): a, c, t, g, unknown or other
  misc_feature (97)..(97): n is a, c, g, or t
  modified_base (195)..(195): a, c, t, g, unknown or other
  misc_feature (195)..(195): n is a, c, g, or t
tcagtacagatcgtcacgaccggtgctcgatttagatcacgtgcgtcggcggggagtcagacccagtcaggacacagcatggacatgagggtccccnctcagctcctgggctcctgctgctctcggctcccaggtgccaagtgtagacagtcgaaatcgacccagtctccttccgacctgtctgcatctgtgganacagcgtcatcatctacttgcctggccagtcgaagaccgtattagtcgacgtggttacggccttggtatcgagtcgaagaaaacccaggaacctaaaaaaccccttaaacgttcctagtaacttttaacgtaacggtcccttacgttaaacggttttaaccgaaaaacgggtttcgggggttacccccaaggaccggttaaaacggggtttccgggtaaccggtacgtaacgggttacgggtaaacgttcccggtagggggaaaccttaaggtaactttttaccgaaccctttacgttacccaaaccgtaacttacgtaacggtaccttaaaccccgttggaacccgtaaccggtacccgttaacggtaaacgggttaacccgttttacgtaacccgttaaacttttaacgttaacccgttacggtaacccgaaaccgtttaacggttaaaacttaaaaccgttttaaccgttttaaacccccttaacgtttaaacccggtttttacgggggaccgggttaaaccggggtaaccgtaaaagggttacgaaaccgggtaaaacccaaaaaccgggtaaccgttaggtaccgggtaccttaacgggaccctaaaccctaaaccgttcgttaccggttaccctttaacctaaccgttaccccgtttacccccgacccgtttaaccgg

SEQ ID NO: 119587 - DNA, 768 bp, Homo sapiens
  misc_feature: GYAE6OF01CBAGM.35.83.H06.1.454.CMB.1.raw
  modified_base (98)..(98): a, c, t, g, unknown or other
  misc_feature (98)..(98): n is a, c, g, or t
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
tcagtacagatcgtcacgaccggtgctcgatttagatcacgtgcgtcgcgggggagtcagacccagtcaggacacagcatggacatgagggtccccgntcagctcctgggctcctgctgctctggctcccaggtgccaagtgtgacatcgaaatgacccagtctccttccaccctgtctgcatctgtggganacagcgtnatcatcacttgcctggccagtcaagacgattagtgactggttggcctggtatcagcaagaaaccaggaaccaaaaacctaactcctagtatttaacgtaacggccttactaagtttaacaaaagggttcgggggtaccccaaggaccgtaaaggggttccgggacggtacgtaagggtcgggtaacgttccggtaggggacaaggtacttttccgaaaccttcctacgaacccctaagttacccaaacggtacccaaaccccgttggacccgtaacggtccccgtttagggaaaccgggtttaacccttttagggaaccctttaaaacgttttacgttaaacccgtcgtaaccctaaaacgtacggttaaatttaaaccgtttaacggtttaaacccccttacgtttaaaaccggttttccggggaacgggttaacgggaacccgtaaagggttacgaaaccggaaacccgtaaaaacggtaccgttgggtaacggcctaggacccttaacccgaatttccgttagttacccttacgtaaccgttccccgtttccccgaccttaaccg

SEQ ID NO: 119588 - DNA, 648 bp, Homo sapiens
  misc_feature: GYAE6OF01AVOA0.35.83.H06.1.454.CMB.1.raw
  modified_base (98)..(98): a, c, t, g, unknown or other
  misc_feature (98)..(98): n is a, c, g, or t
  modified_base (193)..(193): a, c, t, g, unknown or other
  misc_feature (193)..(193): n is a, c, g, or t
tcagtacagatcgtcacgaccggtgctcgatttagatcacgtgcgtcgcgggggagtcagacccagtcaggacacagcatggacatgagggtccccgntcagctcctggggctcctgctgctctggctcccaggtgccaagtgtgacatcgaaatgacccagtctccttccaccctgtctgcatctgtggganacagcgtcatcatcacttgcctggccagtcagacgtattagtgacgtggttggcctaggtatacgagacaacgaaaccgacggaacctaaaaaccctaactacctagtaatttacgtaacggtccttacgtaacgtttaacgaaaggtcggggtaccccaggtaccgtaacgggttcggcggtacgtaggttgggacttcggtaggggaactaggtactttacgaacctcttaccaaccagttcaacgactaacctcgctacgcccgtagaacgtacttacgactaactttattaacgtcgtacctaactagttagtaggtcgtaacttacccgtcttaccgtttccggaccgttaaggtaaccgtaaggttcgaagttacctaaacggtaaaccgtaacgttcggagtactacgaccgacctattccgttctaccttcacgttcccgttacccg

SEQ ID NO: 119589 - DNA, 784 bp, Homo sapiens
  misc_feature: GYAE6OF01AQQ2S.35.83.H06.1.454.CMB.1.raw
  modified_base (197)..(197): a, c, t, g, unknown or other
  misc_feature (197)..(197): n is a, c, g, or t
tcagtacagatcgtcacgaccggtgctcgatttagatcacgtgcgtcgcgggggagtcagacccagtcaggacacagcatggacatgagggtccccgctcagctccgtggggctcctgctgctctggctcccaggtgccaagtgtgacatcgaaatcgacccagtcctccttccaccctgtctgcatctggtggganacagcgtcatcatcacttgcctggccagtcagacgtattagtgtacgtgggttcggccgtggtactcgagacaaagaaaccgacggaaacctaaaaaaccctaactcctagtactttaacgtaacggtccttacgttaagtttaacgaaagggttccggggtaccccaaggtaccgtaaacggggttccggacgggtacgtagggttggtaacgttcggtagggaacctaagttacttttaccaaccttccgtaccaaccctaagttaccgaacggtaccctaaacccgtggtaacccgacggttaccccgttagggtaaccgtttaccgtttacgaaaccctttaaacgtttacgttacccgtaacgtaaccctaaacgtaagtttaaaccttaaacgttttaaccgtttaacccctttaaccgtttaaaccgggtttaccggggaaccgggtaaacgggtaaaccgtaaagggttaacgaaaccggtaaaccgtaaaacggtacgttacgggtacgtacctaggacccgtaacctacgtttccgttacgttacctttaccgaccgttcccttaccccgcttaacg

SEQ ID NO: 119590 - DNA, 581 bp, Homo sapiens
  misc_feature: GYAE6OF01BIKL1.35.83.H06.1.454.CMB.1.raw
  modified_base (98)..(98): a, c, t, g, unknown or other
  misc_feature (98)..(98): n is a, c, g, or t
  modified_base (193)..(193): a, c, t, g, unknown or other
  misc_feature (193)..(193): n is a, c, g, or t
  modified_base (549)..(549): a, c, t, g, unknown or other
  misc_feature (549)..(549): n is a, c, g, or t
  modified_base (574)..(574): a, c, t, g, unknown or other
  misc_feature (574)..(574): n is a, c, g, or t
tcagtacagatcgtcacgaccggtgctcgatttagatcacgtgcgtcgcgggggagtcagacccagtcaggacacagcatggacatgagggtccccgntcagctcctggggctcctgctgctctggctcccaggtgccaagtgtgacatcgaaatgacccagtctccttccaccctgtctgcatctgtggganacagcgtcatcatcgacttgcctggccagtcagacattagtgactggttggcctggtatcagcaagaaaccaggaaccaaaaaccctaacgtcctgaatttataacggcctactaagtttacaaaggttcgggtacccagcgtaaggttcggacggcaggtggatcgtgggacagtatttcactctcaccatcagccaactgactagcctaggacgtactttgactaacttattacgcgaacctaatagttaataacgttacttaaccctattaaccgtttcgggacggtaacggtacaaggtagtaacgaaccgtaaacgtactaggtacgctacggacctaaccgattaccgtnttccttactaaccttccttccccgnttaaccg

SEQ ID NO: 119591 - DNA, 762 bp, Homo sapiens
  misc_feature: GYAE6OF01CE9FD.35.83.H06.1.454.CMB.1.raw
  modified_base (122)..(122): a, c, t, g, unknown or other
  misc_feature (122)..(122): n is a, c, g, or t
  modified_base (193)..(193): a, c, t, g, unknown or other
  misc_feature (193)..(193): n is a, c, g, or t
tcagtacagatcgtcacgaccggtgctcgatttagatcacgtgcgtcgcgggggagtcagacccagtcaggacacagcatggacatgagggtccccgctcagctcctgggctcctgctgctntggctcccaggtgccaagtgtgacatcgaaatgacccagtctccttccaccctgtctgcatctggtggganacagcgtcatcatcacttgcctggccagtcagacgtattaggtgacgtggttggtctggtatcagcaagaaaccaggaacctaaaaaaccctaactccttagtaattttaacgaacggtccttacgttaagttttaacgaaaagggttcgggggtaccccaaggtaccgtaaacggggtttccgggacggtacgtaaggggttcgggtaacttccggtagggggtaacctaggttaacttttcccaaccgtttaccctaaccaaccctaagttacccgaacgacctaaacccgtgaccgacgtcccgtaggtaacggtacttttacggaccttaaacttttactttaaccgtacgtaacccgtaaacgttaagttaaacttaaaccgtttaaccgtttaaccccctttaacgttaaaccggttttaccggggacgggtaaaccgggtaaacccgtaaaggggtaacgaaacggtaaacccgaaaacggtaaccgtagggttacggtccgtacgaaccgtacctactttccgttacgttccttaccgtactttcccgtccccgtctaacg

SEQ ID NO: 119592 - DNA, 599 bp, Homo sapiens
  misc_feature: GYAE6OF01CJOAI.35.83.H06.1.454.CMB.1.raw
  modified_base (98)..(98): a, c, t, g, unknown or other
  misc_feature (98)..(98): n is a, c, g, or t
  modified_base (123)..(123): a, c, t, g, unknown or other
  misc_feature (123)..(123): n is a, c, g, or t
  modified_base (194)..(194): a, c, t, g, unknown or other
  misc_feature (194)..(194): n is a, c, g, or t
  modified_base (444)..(444): a, c, t, g, unknown or other
  misc_feature (444)..(444): n is a, c, g, or t
tcagtacagatcgtcacgaccggtgctcgatttagatcacgtgcgtcgcgggggagtcagacccagtcaggacacagcatggacatgagggtccccgntcagctcctggggctcctgctgctntggctcccaggtgccaagtgtgacatcgaaatcgacccagtctccttccaccctgtctgcatctgtggganacagcgtcatcatcacttgcctggccagtcagacgtattagtgacgttggttggcctggtatcgagcaagaaccagaacaaaaaccctatcctagtatttaagaacgtccttagttaagtttaacgaaaggttcggggacccaaggcgtaaagggttcggacggacgaggtggatcggtagggactagtactttcacgtctacaccatcacgaccaactgacgagtcctggaacgtacttcgactaactntactcgacctaagagttagtggttctacttccgtactaccgtttccggaccgttagggaacctaaggtcgaaattacgaaccgaaacgtacggtcggttaggacttccggactacccgtattccgttacgttaccttactccgttcccgtacccg

SEQ ID NO: 119593 - DNA, 315 bp, Homo sapiens
  misc_feature: GYAE6OF01BZEX9.35.83.H06.1.454.CMB.1.raw
  modified_base (98)..(98): a, c, t, g, unknown or other
  misc_feature (98)..(98): n is a, c, g, or t
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
  modified_base (311)..(315): a, c, t, g, unknown or other
  misc_feature (311)..(315): n is a, c, g, or t
tcagtacagatcgtcacgaccggtgctcgatttagatcacgtgcgtcggcgggggagtcagacccagtcaggacacagcatggacatgagggtccccnctcagctccgtggggctcctgctgctcgtggcctcccaggtgccaagtgtagacatacgaaatcgacccagtcctccttccaccctgtctgcatcgtggtggagacagcgtcatcatcacttgcctggccagtcagacgtattagngacgttggtcgccttggtaanccagcaaagaaaccgaggaaaccaaaaacccctaatccgtattatnnnnn

SEQ ID NO: 119594 - DNA, 645 bp, Homo sapiens
  misc_feature: GYAE6OF01CIAMJ.35.83.H06.1.454.CMB.1.raw
  modified_base (615)..(615): a, c, t, g, unknown or other
  misc_feature (615)..(615): n is a, c, g, or t
tcagtacagatcgtcacgaccggtgctcgatttagatcacgtgcgtcgcgggggagtcagacccagtcaggacacagcatggacatgagggtcccccgctcagctcctggggctcctgctgctctggctcccaggtgccaagtgtgacatacgaaatgacccagtcctcccttccaccctgtctgcatcgtgtgggagacagcgtcatcatcacttgcctgcctagtcagacgtattagtgtacgtggttcggcgtggtatcgagacaagaaaccacggaaccaaaaaccctactctagtatttaagaacgccttacgttaagttaacaaaggtcgggtacccaggtaccgtaagggttcggacggtactaggtggtacgtcggtagggactagttactttcaccttctaccacctataccaacgacctaaccgtcgacctagcccgtaggtacgtactttagaccttaactttactacctacgaacctaaactagttaaacttaacgtttaacgttacccgttacgtttaaccgttcggggaccgggtaacgggtaacctaagggtacaacgaaacccgtaaaggtaaccgtgtacgggctacgactaaccgtnttcgtactccttcacttccctccgtctacg

SEQ ID NO: 119595 - DNA, 600 bp, Homo sapiens
  misc_feature: GYAE6OF01DV6H4.35.83.H06.1.454.CMB.1.raw
  modified_base (192)..(192): a, c, t, g, unknown or other
  misc_feature (192)..(192): n is a, c, g, or t
  modified_base (422)..(422): a, c, t, g, unknown or other
  misc_feature (422)..(422): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccacctgtctgcatctgtggganacagcgtcatcatcacttgcctggccagtcagacgattagtgactggttggcctggtatcagcagaaccaggacaaaaaccctaactcctagtatttataaggtcctactagtttacaaagtcggggtacccagcgaaggttcggcggcgagtggatcgtgggactagtatttcactctcaccatcagccaacctgacagcctggacgtactttagactaacttattacncgaccaactagtaataacttacgtttaacccctacgtttaaccgtttcgggacggtaacgggtaaccctaaaggggtacgaacgaacccgtaaaacggaaccgttggtacgggtctaggacccaaccctagttccttacggttacctttacccgatttccccgtttccccgactaccg

SEQ ID NO: 119596 - DNA, 522 bp, Homo sapiens
  misc_feature: GYAE6OF01BCAG5.35.83.H06.1.454.CMB.1.raw
  modified_base (193)..(193): a, c, t, g, unknown or other
  misc_feature (193)..(193): n is a, c, g, or t
  modified_base (291)..(291): a, c, t, g, unknown or other
  misc_feature (291)..(291): n is a, c, g, or t
  modified_base (518)..(518): a, c, t, g, unknown or other
  misc_feature (518)..(518): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttggcctggtatcagcaagaaccaggacaaaaaccctaactctagatttanaaggctactagttacaagtgggtccagcaaggtcgcgcagtgatctagggacagtattcactctacactatcagcaacctgcagctgaggtcttgactaacttatactgaccaatagtaataattcgttaaccctacgttaacgtttcgggacggtaagggaaccaagggtacgaacgaaccaaagacgtgaggctaggcactatctcgtcttacattccttcccgntacg

SEQ ID NO: 119597 - DNA, 649 bp, Homo sapiens
  misc_feature: GYAE6OF01EZA7A.35.83.H06.1.454.CMB.1.raw
  modified_base (223)..(223): a, c, t, g, unknown or other
  misc_feature (223)..(223): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctactctggctccgaggtgccagatgtgacatccagatgacccagtcctccatccctccctgtctgcatctggtaggagacagcgtcaccatcacttcgccggganaagtcagcgctagttggctagttctttaaattgtatacaacggaaacaggaaacgcccctaaactcctagatctatgctgctatacctattttcgacgtaaacggtcggggtcccgacgtaaggttcgaggtcggacgtaggtaggtacttaccggtagggaactaaggtaactttcaacgttcgtaccacctatcctaagcctagttctcgtaactaacgtagaaagttacgtttacgacctaaccttacttacttacgtaacctaactaggtaacgttaacgacgttacccgtacccgacgtactacgtacgtaccgtacgggtaacccgaaacggggtaaccctaacgggtaacgtaagggaacgttaaaagttaaaaccggaacttacgggtacggtactacggacctaccgtatttacccg

SEQ ID NO: 119598 - DNA, 765 bp, Homo sapiens
  misc_feature: GYAE6OF01EKZDE.35.83.H06.1.454.CMB.1.raw
  modified_base (263)..(263): a, c, t, g, unknown or other
  misc_feature (263)..(263): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccgaggtgccaagtgtgacatacgaaatcgacccagtcctcccttccaccctgtctgcatctggtgggagacagcgtcatcatcacttgcctgccagtcagtacgtattagtgtacgttggttcgccgtggtancgagacaagaaaccacggaaacctaaaaaccctactaccgttagtaatttacgaacggtccttagttaagttaacgaaaggtccggggtaccctaggacgtaacggggttccggacggtacgaacggttggaacgtcgtagggactagtaactttccactcgtaccaacctagtacctacggacctaaccgtggacctacgggccttagggtaaccgttacgtttaccgaaactttaactttacgttaaccgtaccggtaaccctaaacgtaaggtttaaaccttaagtttaaccccgtttaacccctaacggtttaaccccgggtttccgggaaaccggggtaaaccggggttaaaccgtaaagggtaaccggtaacggaaaacccggttaaacccgtaacgttacggtacggtacccgttaagtaccccgaaacgttacgttacccggttagtttaccctaccggttaaccctttccccggttaaccccgacctttaacg

SEQ ID NO: 119599 - DNA, 687 bp, Homo sapiens
  misc_feature: GYAE6OF01BWSYD.35.83.H06.1.454.CMB.1.raw
  modified_base (208)..(208): a, c, t, g, unknown or other
  misc_feature (208)..(208): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcncttaaaacgcctcggccagtcagacgtattagtgtacgtggttggccgtggtatcagacaacgaaaccaacggaaccaaaaaccctaaacctacctagtaatttaacgtaacggtacctacgttaacgtttaacgtaaaggtacggggtacccgtaggacgtaacgggttcgggcggacgaggtaggtagtcgtagggacgagtactttctactctaccaaccactaccgacgacctaaccgtgacctacggtccctaggacggttactttacggaaccttaactttacgttaaccacgtaaccctaaactaagttaattaaaccgttaccgtttaaccccttacgtttaaccggtttcggggaaccgggtaacgggaacctaaagggtaacgaacgtaaaccgtaaacggtaactggtacggtactcgaaccctactacttcgtacgttacttaccactttccccttcccgacctacg

SEQ ID NO: 119600 - DNA, 820 bp, Homo sapiens
  misc_feature: GYAE6OF01BPYVM.35.83.H06.1.454.CMB.1.raw
  modified_base (196)..(196): a, c, t, g, unknown or other
  misc_feature (196)..(196): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatacgaaatcgacccagtctccttccaccctgtctgcatctggtggganacagcgtcatccatcctacttcgcctcggccagtcagtacgtatttaggtgtacgttgggttcggaccgtggtactcgagaccgaaacgaaaaccgaacggaaaccctaaaaaacccctaaacttacccgttagtaacttttaaacgtaacggtacccttacgttaacgtttaacgtaaaacggttcgggggttacccaaggtacgtaaacgggtttcgggacggtacgtaggtagggtacgtacggtaggggaactagttaacgtttcctaccgttactacctaacctaacgttaccgaacgacctaaccgtcgacctacggtacgtacggtaacggtaacttttcgaaccttaaacctttactttaaccgtacgtaaccccgtaaacgttaacgtttaacttaaaccggttttaacctttaaccccctttaacggtttaaacccggtttaccgggggtaacgggaaaccggggtaaacccgtaaaggggtaaccgtaaaacggtaaacccgaaaacggtaaccgttacgggtaccggtccgttaacgtaccctaacctacgttacccggttacggtttccctttaacgtacccgtttccccgttccccgaccttaaacccgg

SEQ ID NO: 119601 - DNA, 747 bp, Homo sapiens
  misc_feature: GYAE6OF01COJSN.35.83.H06.1.454.CMB.1.raw
  modified_base (193)..(193): a, c, t, g, unknown or other
  misc_feature (193)..(193): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatctacttgcctggccagtcagacgtattagtgacgtggttggcctaggtatcgaagcaacgaaaccgaggaacctaaaaaaccctaactacctagtactttaagaacggtccttattaaggttaacaaaggtcggggtacccaggacgtaacgggttccggacggcgtaggtggtataccggtagggaactaggtacttttccgaccttcctaccgtaacccgtaataccgaacgtaccctaaacccgttgaccgaacgtcccgtaagggtaacgggtttacctttagaaccctttaaactttaacgtttaccgacgaaccctaaagtaacggtttaaacttaaaccgtttaccgtttaaacccccttaggtttaaacccgtttccgggggaacgggaacgggtaaaccctaaagggggtaccaaaccgaaacccgtaaaacggtacgtacggttacggtaccgtgaacccttaaccgtaactttccctttacggttacccttacccgtaacctttccccttacccccggtacttaaaccgg

SEQ ID NO: 119602 - DNA, 834 bp, Homo sapiens
  misc_feature: GYAE6OF01A49FL.35.83.H06.1.454.CMB.1.raw
  modified_base (193)..(193): a, c, t, g, unknown or other
  misc_feature (193)..(193): n is a, c, g, or t
tcagtacagatcgtcacgaccggtgctcgatttagatcacgtgcgtcgcgggggagtcagacccagtcaggacacagcatggacatgagggtccccgctcagctcctgggctcctgctgctctggctcccaggtgccaagtgtgacatcgaaatgacccagtcctccttccacctgtctgcatctggtggganacagcgactactctactactacgttcgccgtcggcctacgtacaggacgtaagttacgtgtacgtggttcggtccgtggtatcagacaacgaaaccgaacggaacctaaaaaccctaactacctagtaatttaacgtaaccgtaccttacttaacgttttaacgaaacggttacggggtaccccgaaggtacgtaacgggtttacgggccggacgtaggtaggtacgttcggtacgggaacgaacgttactttacgtacctacgttaccaacccgtactacgtaacgaccctaacccgtacggactacgtacccgttacggtaacggttaaccgttttcgtaaccgtaaacctttttaaccgtttaaccgttaccggtaccctaaaacccggttaattaaaccgttttaaaactttaacccgggtttaccccctttaaaggttttaaccccgggttttaaccgggggtaaccggggtaacggggttaaacccggtaaggtaaaccgggtaaaccggttaaaccccaaaaaccgggttacgttaaccgggtacggtaccggttacaacccggtaaacctacgtttcctttagttacccgttttaccctaaccggttcccccgtttcccggaacccttaccgg

SEQ ID NO: 119603 - DNA, 616 bp, Homo sapiens
  misc_feature: GYAE6OF01BIPIQ.35.83.H06.1.454.CMB.1.raw
  modified_base (137)..(137): a, c, t, g, unknown or other
  misc_feature (137)..(137): n is a, c, g, or t
  modified_base (164)..(164): a, c, t, g, unknown or other
  misc_feature (164)..(164): n is a, c, g, or t
  modified_base (452)..(452): a, c, t, g, unknown or other
  misc_feature (452)..(452): n is a, c, g, or t
  modified_base (594)..(594): a, c, t, g, unknown or other
  misc_feature (594)..(594): n is a, c, g, or t
  modified_base (612)..(612): a, c, t, g, unknown or other
  misc_feature (612)..(612): n is a, c, g, or t
tcagtacagatcgtcacgaccggtgctcgatttagatcacgtgcgtcgcgggggagtcagacccagtcaggacacagcatggacatgagggtccccgctcagctccgtggggctcctgctgctctggctcccaggtnccaagtgtgacatacgaaatgaacccngtcctcccttccaccctgtctgcatcgtggtgggagacgacgcgttcaattcaatcctacgtttgcctcgggcctaaggttcagtacgaagtttcggtgacgttgggttcggccgttggtactcgaagacgagaaacccaggacctaaaaaaccctaactctagtaatttacgaaggccttataagtttaacgaaacgtcggggtaaccagtagtaacgggtgcggtacgaggtacgagtcgtagggataggtactttacgacttcacgaacctagccgaactcaacngacagtcctagacggttacttacgaactaagttacttacgaccgacctaagtagtaacttaataccgttcctaagtaccgttcgggaggacgacgaagtacgaacgaacctaggactgaggctagcgtaattcgaccgtttntcctacacgtcctaccgntacg

SEQ ID NO: 119604 - DNA, 659 bp, Homo sapiens
  misc_feature: GYAE6OF01CLWSJ.35.83.H06.1.454.CMB.1.raw
  modified_base (191)..(191): a, c, t, g, unknown or other
  misc_feature (191)..(191): n is a, c, g, or t
tcagtacagatcgtcacgaccggtgctcgatttagatcacgtgcgtcgcgggggagtcagacccagtcaggacacagcatggacatgagggtccccgctcagctcctgggctcctgctgctctggctcccaggtgccaagtgtgacatcgaaatgacccagtctccttccacctgtctgcatctgtggganacagcgtcatcatcacttgcctggccagtcaggctattgtgacgttggttcggctggtatcgaagacaagaaaccaggaaccctaaaaaaccctaactccgtagtatttaagaacggtccttagttaagtttacaaagggttccgggaccagtacgtaagggttcgacgtacgaggttggactcgtaggaacagtactttacgaccttcaccacatacgacgtacctaaccgtgacctagcctaggtacgtactttacgacttaactttcttaacgtcgaaccgtaactaagttaacttaacgtttaccgttaaccctttacgtttaaccggttacgggacgggtaacggtaaacccgtaaagggttacgaaaccgtaaaccgtaaaaacgtccgtggtacggaccttggaaccctaccgtatttaccgtcgtttacctacgtacctttaccccttccggaacctacg

SEQ ID NO: 119605 - DNA, 599 bp, Homo sapiens
  misc_feature: GYAE6OF01EPHV9.35.83.H06.1.454.CMB.1.raw
  modified_base (298)..(298): a, c, t, g, unknown or other
  misc_feature (298)..(298): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcaagaaaccaggaccaaaaaaccctaactcctagtaattttanaacggccttacgtaagttttaacgaaaaggttcgggggtaccccaaggtccgtaaagggttccgggacggacgtaggtgggattcgtgggacagtactttcactctcaccatcagcaacctgcagcctagaggtacttgactaacttatactgaccaatagttaataacttacgttacccctagttaacgtttcggggacggtaacgggaacctaaagggtacgaacgaacccaaaacggtacgtagtacgggcttagacctaccgtatccgtcgttcttaccaatttccctcccgctaac

SEQ ID NO: 119606 - DNA, 715 bp, Homo sapiens
  misc_feature: GYAE6OF01COBXV.35.83.H06.1.454.CMB.1.raw
  modified_base (187)..(187): a, c, t, g, unknown or other
  misc_feature (187)..(187): n is a, c, g, or t
tcagtacagatcgtcacgaccggtgctcgatttagatcacgtgcgtcgcgggggagtcagacccagtcaggacacagcatggacatggagggtccccgctcagctccgtggggctcctgctgctctggctcccaggtcgaccaagtgtgacatacgaaatcgaccagtcctcctccacctgtctgcntcgtggtgggagacagctcatcatctactgcctggccagtcgaagacgtagtagtgacgtggtcgcgtggtatcagacaacgaaaccgaaggaaacctaaaaaccctaactacctagttacttaacgtacgtcttaacgttaagttaacgtaaaggtccggggtaccaggacgtaacgggttcggacggtacgaggtggtacgtcggtagggtaactaggtattaccgtactacctacgactacacggtaccacctaaccgtcgacgtacgcgtaggtacggttacttacggaccttaatacgttacacgaacctaagtaagttaataaaccgtttaccgtttaacccttaacgtttaaccgggttacgggtaaccgggtaaccgggtaaaccaaaggggttaaccaaacgggtaaaaccgtaaaccggacgttacggacgggttcctacgggaacccttaacgtactttacccggtacgtttaacccgttaccttaacccgttacccgttccccgaactttaaccgg

SEQ ID NO: 119607 - DNA, 660 bp, Homo sapiens
  misc_feature: GYAE6OF01DGS1C.35.83.H06.1.454.CMB.1.raw
  modified_base (97)..(97): a, c, t, g, unknown or other
  misc_feature (97)..(97): n is a, c, g, or t
  modified_base (213)..(213): a, c, t, g, unknown or other
  misc_feature (213)..(213): n is a, c, g, or t
  modified_base (626)..(626): a, c, t, g, unknown or other
  misc_feature (626)..(626): n is a, c, g, or t
  modified_base (632)..(632): a, c, t, g, unknown or other
  misc_feature (632)..(632): n is a, c, g, or t
  modified_base (642)..(642): a, c, t, g, unknown or other
  misc_feature (642)..(642): n is a, c, g, or t
tcagtacagatcgtcacgaccggtgctcgatttagatcacgtgcgtcgcgggggagtcagacccagtcaggacacagcatggacatgagggtccccntcagctccgtgggcctcctgctgctctcggctcccgaggtcaccaaggtgtcgaacatacgaaatcgaccctagtccttcccgttccaccttgtctgctatcgtggagggacgacngtcgtacatcatcattcgcctggacctagtacgagtacgtagttagtcgacgttggttcggaccttaggtactcgagtaccgaaacgaaaccgacggtaaacctaaaaaaccctacgtacctaagttaacttttaagaccggtcttaacgttaagtttaacgaaggttcgggacctagacggtacggtcgcgacgtaggtgacgtcggtagggaactagtactttacaccgttactaccgtaactacgtacgacgaacctacccgttagaccgtacggtccgtaggtaacggttactttaacgaacttaacgttacttaccaacgtacctaagttactaacttaacggtttactccgttaacgttacgtcgggaggacgtaacgagtacgacgaaactagacgtgacgactanactatnttcgcttacncctactctcccgagtacg

SEQ ID NO: 119608 - DNA, 630 bp, Homo sapiens
  misc_feature: GYAE6OF01B7FE8.35.83.H06.1.454.CMB.1.raw
  modified_base (196)..(196): a, c, t, g, unknown or other
  misc_feature (196)..(196): n is a, c, g, or t
tcagtacagatcgtcacgaccggtgctcgatttagatcacgtgcgtcgcgggggagtcagacccagtcaggacacagcatggacatggagggtccccgctcagctcctgggctcctgctgctctggctcccaggtgccaagtgtgacatcgaaatcgacccagtcctccttccaccctgtctgcatctggtggganacagctcatcatcacttgcctggccagtcagacgtattagtgtacgtggttcggcctggtatcgagacaacggaaaccaggaaccaaaaaaccctaactcctagtaatttaacaacggtccttacttaaggtttaacaaacggttcggggtaccccaggtacgtaagggttccggacggtctaggtggtactacggtgggaactagtatttcactcctacacatcacgtacaaccgtgacacgtcctaggtacggtacttcgaactaactttagtacctgaaccaactagttactaaattccgtttaaccctagttaaccgttcgggacggtaacgggtacaagggtacaaacgaacctaaacgtacgtaggtacggtctacgaccgtcctagttcctaggttacctacgtacttacccctcccgtaccttacg

SEQ ID NO: 119609 - DNA, 1022 bp, Homo sapiens
  misc_feature: GYAE6OF01BP0VV.35.83.H06.1.454.CMB.1.raw
  modified_base (148)..(148): a, c, t, g, unknown or other
  misc_feature (148)..(148): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacntcgaaatgacccagtctccttccaccctgtctgctatcgtggtagggacacgaggtccgtacaactcgtacttcacgtttcgccgtcggaccgagttacgaacggtacgtaagtttacggttcgtaacggtttcggggttcggtcccgttagggttacttacgaacggtaacccaaaacggaaaaaccccgtaacgggaaaacccctaaaaaaaccccgtttaaccgtaccgttaacgttaaaacgtttttaaacgtaacgggttaccctttaaccgtttaaacgggttttaacgaaaaaccggggtttccggggggttacccctaacgggtaccggttaaaacgggggtttccggggcccggggtaacgtacggggttacgggtacgttaccgggtacgggtaaacgttaacgggttaacttttaccgtaaccttcccggttaccgaaacccttaacttacggtaaccgtaacccgtaacccgttacggacccgtaacggtaccccgttaggggtaaaccggtttaccggtttactaacccgtttaaacctttaacgtttaaccgtacccggtaaccctaaaaccggttaacgtttaaaccgttaactttaaacccggttttaaccctttaaccccgttttaaaccgggttttacccggggaaccgggggttaaccgggttaaaaccccgggtaaggggttaaacccgggtaaaccgggtaaaaacccccgttaaaaaccgggaaacccggttttcgggttaaaccgggtcccggttacgtaacccgttaaccccgttaacgttacccggtttcgttttacccgtacccgttttaccctacccggttttaacccccggtcccgtttaaaaccg

SEQ ID NO: 119610 - DNA, 758 bp, Homo sapiens
  misc_feature: GYAE6OF01BV6OU.35.83.H06.1.454.CMB.1.raw
  modified_base (98)..(98): a, c, t, g, unknown or other
  misc_feature (98)..(98): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
tcagtacagatcgtcacgaccggtgctcgatttagatcacgtgcgtcgcgggggagtcagacccagtcaggacacagcatggacatgagggtccccgntcagctcctggggctcctgctgctctggctcccaggtgccaagtgtgacatacgaaatgacccagtcctccttccaccctgtctgcatcgtgtggganacngcgtnatcatctacttgcctggccagtcagacgtagttagtgacgttgggttcgccgttggtactcgaagacgaagaaacccgaggaaacccaaaaaacccgttaactcctagtaactttaagtaacggtccttacgttaaggtttaacgaaaacgggttcggggtacccctaggtaccgtaacgggttccggacggtactagggtggtaacgtcgtacggggaactaggttactttaccgacctccttacaaccgtataccgaacgtacctaacgcggtaccgacggtccgttaggtaacggttacttttacggaacctttaaacgttttacgttaccgtaccgtaaaccctaaacgttaagtttaaacttaaacgtttaccccgttaaaccctttaccggtttaaacggtttcccgggggaaccgggtaaacgggtaacccggtaaagggtaacccgaaccgaaacccggtaaacgtaccgtaggtcgggtacttaccggactacccgtagttacccgttgttaacccttcacccgtttaccctaccccgcgtaacg

SEQ ID NO: 119611 - DNA, 848 bp, Homo sapiens
  misc_feature: GYAE6OF01AU59D.35.83.H06.1.454.CMB.1.raw
tcagtacagatcgtcacgaccggtgctcgatttagatcacgtgcgtcgcgggggagtcagacccagtcaggacacagcatggacatgacgggtccccgctcagctccgtggggctcctgctgctctggctcccgaggtcgaccaagtgtgacagtcgaaatcgacccagtcctcccttcccaccctgtctgccattccgtggtggggacacgacgcgtacactccattcctacctttcgccgtcggcctagtaccgacgacgtattaggtgtacgtgggttacgccgttaggtatccgagaccaacggaaacccgaacggaaacccctaaaaaccccgtaacttccgttaagtaacgtttaacgtaacggtacccttaacgtttaaacgtttaaccgaaacgggttcggggtaccccgtaaggtaccggtaaacggggttccgggacggtacgtaggttcgggtacttcgggtagggaactaacgtttactttaccgtaccttccctaaccgaaccctagtaccgaacgtacccgtaacccgtacggacctacggtccgttaacggtacgttaccgtttacggtaaacctttaactttaccgttaccgtaccgtaaacccgtaattaacggtttaaacttaaacccgtttacccgttttaaccccgttaacggttttaaacccgggtttaccgggggaaccggggtaaaccggaacgggttaaacggtaacgaaacccgtaacgaaaccgttaccgggtggaacccgggttctaacgaccccgttaacgttccgttagttaccgttaccttacgttaccccgttccccttaaccccggtccttaacgg

SEQ ID NO: 119612 - DNA, 735 bp, Homo sapiens
  misc_feature: GYAE6OF01A2T7U.35.83.H06.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatcgacccagtctccttccaccctgtctgcatcgtggtggganacngcgtnatcatcacttgcctggcctagtcagacgtagttacgtgacgttggtgtccgtggtactacagcaacgaaccgagaaccaaaaaccctactctagtaacttanaacggtcctagttaagttaacgaacggtcgggtaccctaagacgtaagggttcggacggacgtaggtacggtaagtcgtagggactagttacgttacctaccgttaccgtactaaccgtatacgaacgtacccgaaccttcggaacgtaccgtacgtaacggtaacggttaccgttaacgtaccgtttaaaccgtttattaaccgtaaccgtaaccgtaacgttaacgtttaagttaaacccgttaacccgtttaccccgttaacggttttaacccggttcgggtaaaccgggtaacgggttaaccgtaaagggtaccggaaaccctaaaccggttaaaccggacgtttaacgggccgtacgtacccgtaactcccggttattcccggttactccgtttactaaccttcccccttaccggccttaaccg

SEQ ID NO: 119613 - DNA, 938 bp, Homo sapiens
  misc_feature: GYAE6OF01DAQTG.35.83.H06.1.454.CMB.1.raw
  modified_base (99)..(99): a, c, t, g, unknown or other
  misc_feature (99)..(99): n is a, c, g, or t
  modified_base (234)..(234): a, c, t, g, unknown or other
  misc_feature (234)..(234): n is a, c, g, or t
tcagtacagatcgtcacgaccggtgctcgatttagatcacgtgcgtcggcgggggagtcagacccagtcaggacacagcatggacatgagggtccccgntcagctcctgggctcctgctgctctggctcccgaggtgccaagtgtgacatcgaaatcgacccagtctccttccacctgtctgcatcgtagtgggacacagtctcatcatcattcgcctaggccagtcagacgtnttagtgtacgttggttcggccgtaggttatcgaagtaccgaaacgaaaacccggacggaaaacccctaaaaaaaccccgtttaaacgtcccgttaaggttaacgttttaaaccgtaaaccgggtacccttttaacgttttaaaggttttaaaccgaaaacggggtttcccgggggttacccaacggtaaccgttaaacggggtttccgggacggtacgtaacgggttacgggtacgttacggttacggggaactaacgggttacttttaacgaccctttactacccaaccgtacttaacgacgtaaccctaaaccgttcggaacccgttaccgtaaccggttaggttaaccggttaaccgttttacggaaccctttaaaccgttttaacggtttaacccaacgggtaaccccgttaaaattaacgggtttaaaactttaacccgggtttaaacccgtttttaacccccgttaacggttttaaacccggggtttaccggggtaacccgggggtaaacgggtaaacccgttaaggggttaaaccgaaacccggtaaaacccggtaaaacggttaaccggttaacggtaccggtaaccccggtaaggtaaaccccttacccggttaaagtttccccggttaaacgttttccccgttaacccgttttacccggttcccccggtttaacccccggtcgtttaaacccgg

SEQ ID NO: 119614 - DNA, 895 bp, Homo sapiens
  misc_feature: GYAE6OF01CXPF3.35.83.H06.1.454.CMB.1.raw
  modified_base (98)..(98): a, c, t, g, unknown or other
  misc_feature (98)..(98): n is a, c, g, or t
tcagtacagatcgtcacgaccggtgctcgatttagatcacgtgcgtcgcgggggagtcagacccagtcaggacacagcatggacatgacggtccccgntcagctccgtgggctcctgctgctctggcctcccgaggtgccaagtgtgacatcgaaatgaccctagtcctccttccaccctgtcctgctacgttccgtaggtcgggacgaacgcgtacgtctaacttccagttaccacgtttcggaccccgttgggaccctaaggttaccaaggtaaccgttaagtttaggtcggtaacggttgggttcggcccgttagggtaacttaccggaaggaaccgaaaccggaaaaacccggtacggtaaaacccctaaaaacccgttaaacgttcccgttaagttacttttaaacggtaaccggttcccgtttaacggtttaaacggtttaaccgtaaaacgggtttccgggggtaccccaaggtacgggtaaacgggtttccggacggtacggtaacggtacgggtaacgtccggtaacggggtactaacggtacttttacaacgtttcctaacgacctacgttcgacgaccgtaacctcggacggtacgttccgtacggtaacggtttacttaccgaagtttaacccgttacgtttactaaccgacccgttaataacggtttaacttaacgtttaaaccgttaccccgttaacgttttaacccggtcgggggtaaccggtaaacggggtaacccgtttaaagggtaaaccgaaaccgggtttaaaccgaaaacggccgggtttaaggccggtacccgtaaggttccccaaacggttacttcccgtaacgggtttaacccttggtttaaccccgtcccgttcccgtaccgttaaccgg

SEQ ID NO: 119615 - DNA, 768 bp, Homo sapiens
  misc_feature: GYAE6OF01AOUAQ.35.83.H06.1.454.CMB.1.raw
  modified_base (195)..(195): a, c, t, g, unknown or other
  misc_feature (195)..(195): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatcgacccagtctccttccaccctgtctgcatctggtggganacgagcgtcatcatcacttgcctggccagtcagacgagttagtcgtacgtggttcgcctggtatcgagacaagaaccacggtaaccaaaaccctaactctagtacttacgtaacggtccttactaagttaacgaaggttcgggtaccagtcgtaacggtccggacgacgtaggtaggtactcggtagggaactacggttactttaccgactaccgtactacctactacaacgtaccgtaacctggaccgtacgtaccgttaggtaacggtaccttttacggtaaccttaaccgtttaacttaccgtaaccgtaaccgttaaaccgtaagtttaacgttaaaccgtttaacccgtttaaccccgttttaaccgttaacccgggtttaccggggtaaccggggtaaacccgggtaaaccgttaaacgggtaaccggtaaaccgtaaaacccggtaaacggtaaccgttacgggtaccgggtaccgtaccggtacccgtaaccgttaccgttaccgtttacgttacccgtttaccgtaaccccgtttccccgttaacccccgttccgttaaacccg

SEQ ID NO: 119616 - DNA, 624 bp, Homo sapiens
  misc_feature: GYAE6OF01E2HOY.35.83.H06.1.454.CMB.1.raw
  modified_base (194)..(194): a, c, t, g, unknown or other
  misc_feature (194)..(194): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctcccttccaccctgtctgcatctgtggganacagtcgtcatcatcacttgcctggccagtcagacgattagtgactggtggcctggtatcagcagaaaccaggaaccaaaaaccctaactcctagtatttaacaacggtcctactaagtttacaaacgttcggggtcccaggacgtaaggggttcggcggcgtaggtaggacttcggtagggaactaggtacttttcgaactctacaccataccacgtacaacctgccgagcctggagtcttgaccttaagttactactcactaacgattaataacgttacgttacccgttactaacgtttcgggacggtaaggtaaccgaaggtaccgaacgtaaccgtaaacgacggttgtacggaccgtagaccctaccggtatttcccggttagttacccttacgtaaccttcccgttcccccgaactttacccgg

SEQ ID NO: 119617 - DNA, 820 bp, Homo sapiens
  misc_feature: GYAE6OF01C9KKI.35.83.H06.1.454.CMB.1.raw
  modified_base (194)..(194): a, c, t, g, unknown or other
  misc_feature (194)..(194): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtcctccttccaccctgtctgcatctgtggganacagcgtcatcatcacttgcctggccagtcaggacgtattaggtcgacgttggtcggaccttggtactcgacgacaacggaaaacccaggaacctaaaaaaccccgttaactccgttaagtaacgttttaactaacggtcccttacgtttaaggtttaaccgaaagggttccggggtaaccccagtaccggtaagggttccggacggtactaaggtggtactcggtagggactagtatttcactctacacctagtccagacctacgtcgacgtacggtacctagggtaacgttactttacggaaccgttaaacttttacgttaacccgtacgtaacccctaaacgttacggtttaaactttaaaccggttaaccgttttaacccccgtttaaccggtttaaccggttttacccgggggaacccgggggttaaaccggggttaaacccgaaaggggtttaaccggaaaaccggttaaaccccggaaaaacgggttaaccttaccgggggtaccggttacccgtaacgggtaccccttaacccggtttaacgtacccggttttacccggttaacccgttttaccaaacccggtttttccccctttaaacccccgggtcctttaaaccg

SEQ ID NO: 119618 - DNA, 710 bp, Homo sapiens
  misc_feature: GYAE6OF01BJAQ1.35.83.H06.1.454.CMB.1.raw
  modified_base (97)..(97): a, c, t, g, unknown or other
  misc_feature (97)..(97): n is a, c, g, or t
  modified_base (204)..(204): a, c, t, g, unknown or other
  misc_feature (204)..(204): n is a, c, g, or t
tcagtacagatcgtcacgaccggtgctcgatttagatcacgtgcgtcgcgggggagtcagacccagtcaggacacagcatggacatgagggtcccgntcagctccgtggggctcctgctgctcgtcggctcccgaggtgccaagttgtgacatacgaaatgacccagttcctcccttccaccctgtctgcattctggtaggganacagcgtcagtcatctacttcgcctggccagtccgaaggtacgtaattagtgacgttgggttcggccttggtatcagcaagaaccgacggaaccaaaaacccgtactccgtagtatttaacgtaacggccttacttaacgtttaacgaacggtcgggtacccaggtcgtaagggttcggcggactaggtcgatcggagggactagtactttcacgtactacaacccgtagtacacgtaccaaccgtgccaacggcttaggaccggttactttcggaaccttaactttcgttaacgccgttaaacccaagttacgttaaccgttaaaccgtttacgttaacccttacgtttaacccggttcggggaacggtaacccgggtaacgtaacgggttaacgaaaccgtaacccggtaaaacgttccggtaggttacccgtacgtacgaacccgttactacgttaccgttaggttaccccttattaacccttccccttacccgtccgttaac

SEQ ID NO: 119619 - DNA, 289 bp, Homo sapiens
  misc_feature: GYAE6OF01DPXKS.35.83.H06.1.454.CMB.1.raw
  modified_base (144)..(144): a, c, t, g, unknown or other
  misc_feature (144)..(144): n is a, c, g, or t
  modified_base (271)..(271): a, c, t, g, unknown or other
  misc_feature (271)..(271): n is a, c, g, or t
  modified_base (273)..(289): a, c, t, g, unknown or other
  misc_feature (273)..(289): n is a, c, g, or t
tcagtacagatcgtcacgaccggtgctcgatttagatcacgtgcgtcgcggggaagatgaagacagatttcactctcaccatcagcaacctgcagcctgaggactttgcaacttattactgccaacagtataatagttaccctntaactttcggcggagggaccaaggtagagaccaaacgaactggtggctgcaccatcgtgtcttcatccttcccgcatcgtagaacgatctgtactggacggtcgggctggacaaggcactaataggncnnnnnnnnnnnnnnnnn

SEQ ID NO: 119620 - DNA, 846 bp, Homo sapiens
  misc_feature: GYAE6OF01AMI4Q.35.83.H06.1.454.CMB.1.raw
  modified_base (151)..(151): a, c, t, g, unknown or other
  misc_feature (151)..(151): n is a, c, g, or t
  modified_base (211)..(211): a, c, t, g, unknown or other
  misc_feature (211)..(211): n is a, c, g, or t
  modified_base (797)..(797): a, c, t, g, unknown or other
  misc_feature (797)..(797): n is a, c, g, or t
tcagtacagatcgtcacgaccggtgctcgatttagatcacgtgcggtcggcgggggagtcagacccagtcaggacacagcatggacatggacgggtccccgctcagctccgtgggctcctgctgctgtggcctcccgaggtgcctaagtgngacagtacgaatcgaccctagtcctcccttccaccttgtctgcctagtccgtaggtgganacgtacgtacgtaccaatactaccttacgtaccgttcggccgtaacggtccaacggtaccgaggtaacgttagttaggtacggttacggttcgggttaccggtcgtacggtattccgaacgacgaaaccggaaaaccgaacggtaaaaccctaaaacccccgttaagtaccgttaaggtaacctttaaggtaacccgttaccgttaacgttttaaacggttaaccggtaagggttacccgggtaactaccgggtaacgtaacggggtttaccggacggttagtaacgggtacggttaacgtcgggtaccgtaacggtaaccttacttttacgaaaccccgtttctaaccgtaacccgtacgtaaccgaaccgttacccgtaaccgttcggaaccggtacccgtacgtaagttacccggttaaccttacgtaaaccgtttacgtttaaccgttagtcccgtaacgttaaacctacgttaaacctttaccgttaaacccgttacgttaacgggttacccggtagggtacccggaaacggtaccgtaaaggtaccgtaaccggaaacgataccgggcgtaagcccgttntaccgacttaggtactacgttacttaccgactttcgtcccctgttaacc

SEQ ID NO: 119621 - DNA, 785 bp, Homo sapiens
  misc_feature: GYAE6OF01CJDF6.35.83.H06.1.454.CMB.1.raw
  modified_base (100)..(100): a, c, t, g, unknown or other
  misc_feature (100)..(100): n is a, c, g, or t
  modified_base (211)..(211): a, c, t, g, unknown or other
  misc_feature (211)..(211): n is a, c, g, or t
  modified_base (778)..(778): a, c, t, g, unknown or other
  misc_feature (778)..(778): n is a, c, g, or t
tcagtacagatcgtcacgaccggtgctcgatttagatcacgtgcgtcggcgggggagtcagacccagtcaggacacagcagtggacatgacgggtccccntcagctccgtgggctcctgctgctctggctcccgaggtgccaagtgtgacatcgaaatcgaccctagtcctccttccacccttgtctagctatcgtggtggacacagcgtnactcatctacttgacctcggacctaggtcaacggtctaagtttacgcggtaacgttggggttcgtaccgttaggtaactacgacgaccaaacggaaacccgacggtaaaaccccaaaaacccgtttaactccgttaagtaaactttaccgtaaacggtcctttaacgttaaggtttaaccgaaacgggtcccggggtacccaagggtaccgtaacggggttccgggacggtaccgtagggttaccggacttcggaacggggtaactacggttaactttaccgactttacccggtacaaccctagtaacccggataacccgtaaccttcggaaccccgttcgtaacgttacgggtacgggttaactttacggaaaccctttaatttaaccggtacctaaccggaaccttaaacgggttacttaactttaacgttaccgttaaccttaacgttaccgggtttacgggacggtaacgaacgaacggttacgaaaccggaacctaaggtcttacgggcaccggtacaccggttacacgttctaacgttccgttacaccgttacccgttccncttaacg

SEQ ID NO: 119622 - DNA, 526 bp, Homo sapiens
  misc_feature: GYAE6OF02IW02H.35.83.H06.1.454.CMB.1.raw
  modified_base (193)..(193): a, c, t, g, unknown or other
  misc_feature (193)..(193): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (347)..(347): a, c, t, g, unknown or other
  misc_feature (347)..(347): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttggcctggtatcagcaagaaaccaggaccaaaaaccctaaacncctagatttanaaggcctctagtttacaaagtcgggtccagcaaggttcgcggcagtgatcgngggacagatttcactctcaccatcagcaacctgcagcctgaggtacttgactaacttattactgaccaactagtataatacgttaccctacttaacgtttcggacggtaggacctaaggtagaacgaccaaacgactgtaggctacgcaacctatctcgtcttacatccttcccgctac

SEQ ID NO: 119623 - DNA, 557 bp, Homo sapiens
  misc_feature: GYAE6OF02H56FR.35.83.H06.1.454.CMB.1.raw
  modified_base (194)..(194): a, c, t, g, unknown or other
  misc_feature (194)..(194): n is a, c, g, or t
  modified_base (291)..(291): a, c, t, g, unknown or other
  misc_feature (291)..(291): n is a, c, g, or t
  modified_base (552)..(552): a, c, t, g, unknown or other
  misc_feature (552)..(552): n is a, c, g, or t
tcagtacagatcgtcacgaccggtgctcgatttagatcacgtgcgtcgcgggggagtcagacccagtcaggacacgagcatggacatgagggtccccgctcagctccgtgggctcctgcctgctctggctcccaggtgccaagtgtgacatcgaaatgacccagtctccttccacctgtctgcatctgtggganacagcgtcatcatcacttgcctggccagtcagacgattagtgactggttggcctggtatcagcagaaccaggacaaaaaccctaactcctgatttanaaggcctctagtttacaaagtgggtcccagcaaggttcggcgcagtggatcgtgggacagatttcactctcaccatcagcaacctgcagcctgaggactttgactaactttattactgaccaaatagtaataaattacgtttaacccctattaacgttttcggacggtaagggtaaccaaagggtagaacgaacccaaacggaacttggtaggtctaggacctaaccctattccttgttccttcaactttccttaccccgntaacg

SEQ ID NO: 119624 - DNA, 560 bp, Homo sapiens
  misc_feature: GYAE6OF02GE0Z9.35.83.H06.1.454.CMB.1.raw
  modified_base (291)..(291): a, c, t, g, unknown or other
  misc_feature (291)..(291): n is a, c, g, or t
  modified_base (435)..(435): a, c, t, g, unknown or other
  misc_feature (435)..(435): n is a, c, g, or t
tcagtacagatcgtcacgaccggtgctcgatttagatcacgtgcgtcgcgggggagtcagacccagtcaggacacagcatggacatgagggtccccgctcatctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcagaaaccaggacaaaaaccctaactcctgatttanaaggcctctagttacaaagtgggtccagcaaggttcgcggcagtggatctgggacagatttcactctcacatcagcaacctgcagcctgacggtactttgcaactttattactgacccaacagtataaatacgtttaacccctntaaaccgttttccgggacggtagggaccaaaggtacgaagaacccaaacggacttggtacggcctagacctaacccgtattccgtaggttcctttaccgaactttcccgtttacccgccctaacg

SEQ ID NO: 119625 - DNA, 506 bp, Homo sapiens
  misc_feature: GYAE6OF02IL181.35.83.H06.1.454.CMB.1.raw
tcagtacagatcgtcacgaccggtgctcgatttagatcacgtgcgtcgcggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcagaaaccaggacaaaaaccctaaactcctagatttataaggcctctagtttacaaagtggggtcccagcaaggttcgcggcagtggatctgggacagatttcactctcaccatcagcaacctgcagcctgaggactttgacaactttattactgccaaacagtataatagttaccctattaactttcggcggaggaccaaggtagagaccaaagactgtaggctgcacatctgtcttcatcttcccgctac

SEQ ID NO: 119626 - DNA, 560 bp, Homo sapiens
  misc_feature: GYAE6OF02G6K3I.35.83.H06.1.454.CMB.1.raw
  modified_base (288)..(288): a, c, t, g, unknown or other
  misc_feature (288)..(288): n is a, c, g, or t
  modified_base (409)..(409): a, c, t, g, unknown or other
  misc_feature (409)..(409): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcagaaaccaggacaaaacctaatcctgatttanaaggcctctagtttacaaagtcgggtccagcaaggttcgcgcagtgatcgtgggacagatttcactctcacatcagcaacctgacagcctgagtactttgactaacttattactgaccaanagtataactacgttaaccctacttaacgtttcggacggtaacgggaacctaaagggtacgaacgaaccgaaaacgtacgtaggtacggtactaggaccaaccgtaattccgtacgttacctttaccgacgtttcccttaccccgacctacg

SEQ ID NO: 119627 - DNA, 635 bp, Homo sapiens
  misc_feature: GYAE6OF02HIB3D.35.83.H06.1.454.CMB.1.raw
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcaagaaaccaggaccaaaaaccctaactcctagtaatttaataaggccttactaagttttaacaaaggttcggggtacccagcaaggttcggcggcaggtggatcgtagggacagtatttcactctcactatcagcaactgcagcctgaggtactttgactaacttattactcgaccaaactagtaataacgttacgttaccccttacgttaaccgtttcgggacgggtaacgggtaacccaaagggttacgaacggtaaaccctaaaacggtaacgttcgggtacgggtaccttacggaccctaaacccgtacgtttacccgttacggtttaccctttaccgtaacgttttaccccgtttacccccggaccttaaccgg

SEQ ID NO: 119628 - DNA, 560 bp, Homo sapiens
  misc_feature: GYAE6OF02HO9RR.35.83.H06.1.454.CMB.1.raw
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (322)..(322): a, c, t, g, unknown or other
  misc_feature (322)..(322): n is a, c, g, or t
  modified_base (410)..(410): a, c, t, g, unknown or other
  misc_feature (410)..(410): n is a, c, g, or t
  modified_base (466)..(466): a, c, t, g, unknown or other
  misc_feature (466)..(466): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcagaaaccnggacaaaacctactctagattanagctntagttacaagtgggtccagcaaggttcggngacagtggatcgtagggacagtatttcactctcaccatcagcaacctgcacgcctagacgtacttgacctaattattactgacctaanagtaataattacgttaccctattaacgtttcggacggtaacggacctaaagggtanaacgtaaccaaacgacgttggtacggaccttaggacctaaccgtacgttacgttacggttccttaccgtacgttccctttccccgaccttaacg

SEQ ID NO: 119629 - DNA, 584 bp, Homo sapiens
  misc_feature: GYAE6OF02GI9YL.35.83.H06.1.454.CMB.1.raw
  modified_base (193)..(193): a, c, t, g, unknown or other
  misc_feature (193)..(193): n is a, c, g, or t
  modified_base (291)..(291): a, c, t, g, unknown or other
  misc_feature (291)..(291): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttgcctggtatcagcagaaaccaggacaaaaaccctaactcctagatttanaaggcctctagtttacaagtgggtcccagcaaggttcggcgcagtgatcgtgggacagtattcactctcaccatcagcaactgacagtcctggagtacctttgacctaactttattactgacctaactagtaataacgttacgtttacccttacttaaccgttttcggggacgggtaacgggtaacctaaagggtacgaacgaacccgaaacggtactggtacgggtactacggacctaaccgtattccgttacgttcctttaccgtactttcccgtttaccccgccttaacg

SEQ ID NO: 119630 - DNA, 549 bp, Homo sapiens
  misc_feature: GYAE6OF02G8PC7.35.83.H06.1.454.CMB.1.raw
  modified_base (292)..(292): a, c, t, g, unknown or other
  misc_feature (292)..(292): n is a, c, g, or t
  modified_base (409)..(409): a, c, t, g, unknown or other
  misc_feature (409)..(409): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcagaaaccaggacaaaaaccctaactcctagatttanaaggcctactagtttacaaagtggggtcccagcaaggttcggcggcaggtggatcgtgggacagatttcactctcacatcagcaacctgcagcctgagtacttgctaacttattacngccaactagtataatacgttaccctattaacctttcgggacggtaacgggacctaaagggtacaacgaaccaaacggtactggtacgggtctaggaccaaccctattcctagttccttacactttccttccccgactacg

SEQ ID NO: 119631 - DNA, 601 bp, Homo sapiens
  misc_feature: GYAE6OF02JOM0Q.35.83.H06.1.454.CMB.1.raw
  modified_base (297)..(297): a, c, t, g, unknown or other
  misc_feature (297)..(297): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgtattagtgactggttggcctggtatcagcaagaaaccaggaaccaaaaaccctaactcctagaatttanaacggcctataagtttaacaaaggtcgggtaccagtctaaagggttcgcggctaggtgatcgtagggacaggtatttcactctaccaactatcagaccaacctgacaagcctggaagtacttgactaaacttattctacgacctaatagtaataaacttacgttaaccctacttaacgtttcgggacgggtaacggaacgtaaaggtacggaacgtaaaccgaaacgtacgtacggtacggctaggacctaaccgtattccgttacgtttaccttacctaacgtttcccgttaccccgactacg

SEQ ID NO: 119632 - DNA, 673 bp, Homo sapiens
  misc_feature: GYAE6OF02HXATJ.35.83.H06.1.454.CMB.1.raw
  modified_base (669)..(669): a, c, t, g, unknown or other
  misc_feature (669)..(669): n is a, c, g, or t
tcagtacagatcgtcacgaccggtgctcgatttagatcacgtgcgtcggcgggggagtcaggacccagtcaggtacacctagcataggacagtgacgggtcccgctcagctcctggggctcctgctgctctgggcctcccaggtgaccaagtggtgactatcgaaatgacccagtctccttccacctgtcctgccatcctggtacgggagaccgacgccgtcactccatccacgttgcctcggccagtccagtacgattagtgtacgtaggttcgtctggtatcgtagacaaggaaaccgacggaaccaaaaaccctaactcctagtaacgtttacgtaacggtcctttacgtaacgtttaacgtaaacggttccgggggtaccctaggtaccggtaacgggttcggacggtactaggtcggacgtcgtaggggtactagtacgtttccacttctactaccataccgaagacctaaccgtggaccgtaggtccgtagggacgttacgttggaccttaacgtttagttacgtgacctaagtagtactaacgttacgttaccctacgttaaccggttcggacggtaacggtaccttaagggtacgaacgtaaccgaacgtacgtggtacggctacgaccaacgtattcgtgtcctacacgttccctcccgntacg

SEQ ID NO: 119633 - DNA, 573 bp, Homo sapiens
  misc_feature: GYAE6OF02IPRS3.35.83.H06.1.454.CMB.1.raw
  modified_base (193)..(193): a, c, t, g, unknown or other
  misc_feature (193)..(193): n is a, c, g, or t
  modified_base (296)..(296): a, c, t, g, unknown or other
  misc_feature (296)..(296): n is a, c, g, or t
  modified_base (435)..(435): a, c, t, g, unknown or other
  misc_feature (435)..(435): n is a, c, g, or t
  modified_base (447)..(447): a, c, t, g, unknown or other
  misc_feature (447)..(447): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttggcctggtatcgagcagaaaccaggaccaaaaaccctaactcctagattttaanaacggtcctacttaagtttacaaaaggttcggggtaccccaggtcaagggttcggcggcagtaggatcgtagggacaggtatttcacttctacaccatcagcaacctgacacgcctagaggtactttgacctaactttnttactgaccaanagttataattacgttacccttacttacgtttcggacggtagggaccgaaggtagaacgaccaaacgactaggtacggcttagacctaacctagtcttcgttacttccactccttacccgacctacg

SEQ ID NO: 119634 - DNA, 592 bp, Homo sapiens
  misc_feature: GYAE6OF02FWVHK.35.83.H06.1.454.CMB.1.raw
  modified_base (258)..(258): a, c, t, g, unknown or other
  misc_feature (258)..(258): n is a, c, g, or t
tcagtacagatcgtcacgaccggtgctcgatttagatcacgtgcgttcgcggggtaccgtaccagacccacgtcaggacacagccactggacatgagggtccccgctcgaggcgtcctggggctccctggactcgctcgtggacttcccaaggtgccaaggtgtgacgagtcgaaatgaacccagtctaccttccaacctgtcgtggcatctgtagggagacagcgtcagtcagtcacttgcctggccagtcaggacnttagtgacgtggttggcctgggtatcagtcagaaaccaggacaaaaccgtaacgtcctgatttataaggcctctaagttacaagtggggtacccagtcaaggttcgcgcaagtgaatcagggacagtattcacttcacacatcagcaactgcagcctgagtacttgactaacttattacgagacctaacagtaacttaactaccgtttacccctagttaacgtttccgggacggtacgggaacctaagggtacggacgaaccgaaacgtatacggacggtctcgaccaaccgtacttcgtacgttaccgtacctagtcccgttacccgcctacg

SEQ ID NO: 119635 - DNA, 600 bp, Homo sapiens
  misc_feature: GYAE6OF02F73TP.35.83.H06.1.454.CMB.1.raw
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcagaaaccaggacaaaaaccctaactcctagtatttataaggcctctagtttacaaaggtcgggtcccagcaaggttcggcggcagtggatcgtgggacagtatttcactctcacatcagcaacctgcagcctgaggtactttgactaacttattactcgaccaactagtaataacgttacgtttaaccctacttaacgtttcgggacggtaacgggtaacctaaagggtaacgaacgtaacccgaaaacggtacgttggtacgggtaccttacggacctaacccgtagttacccgttggttaccctttcctaaccgtttcccgtttacccccggaccttaaccg

SEQ ID NO: 119636 - DNA, 513 bp, Homo sapiens
  misc_feature: GYAE6OF02I8HS7.35.83.H06.1.454.CMB.1.raw
  modified_base (192)..(192): a, c, t, g, unknown or other
  misc_feature (192)..(192): n is a, c, g, or t
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccacctgtctgcatctgtggganacagcgtcatcatcacttgcctggccagtcagacgattagtgactggttggcctggtatcagcagaaaccaggaaacgcccctaaactcctgatctttaaggctctactttagagtagtgggtccagtcaaggttcagcggcagtgatcgtgggacagacttcactctcacatccacagctgcancctgatgatttgactaacttattacngaccaanagtatgtagactttccgtctacgtttccggcctagggacctaagtcgtaatactacgaaacgtactggtacgtctacgacctaccacttcgtagtccttaccg

SEQ ID NO: 119637 - DNA, 665 bp, Homo sapiens
  misc_feature: GYAE6OF02GBH23.35.83.H06.1.454.CMB.1.raw
tcagtacagatcgtcacgaccggtgctcgatttagatcacgtgcgtcgcgggggagtcagacccagtcaggacacagcatggacatgagggtccccgctcatctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcaagaaaccaggaaccaaaaaccctaactcctagtaatttaagaacggccttacgttaagtttaacgaaaaggttcggggtaccccaggtaccgtaagggttccggacggcgaggtggatcgtagggacagtactttacacttctacactatacgacgacctaacgtgacacgccgtagacggtactttacggaccttaaactttagttaaccgtacgaaccctaaacgtaagttaacttaaacgttaccgtttaaccccttacgtttaaaccggtttccggggacgggtaacgggaacctaaagggtacgaaacgaaccgaaaccgtacgttggtacggtcctagacccaaccgtagtttccgttcgttacctttaccaaccgtttcccgttacccccggtacctaacg

SEQ ID NO: 119638 - DNA, 551 bp, Homo sapiens
  misc_feature: GYAE6OF02GRQ0P.35.83.H06.1.454.CMB.1.raw
  modified_base (193)..(193): a, c, t, g, unknown or other
  misc_feature (193)..(193): n is a, c, g, or t
  modified_base (233)..(233): a, c, t, g, unknown or other
  misc_feature (233)..(233): n is a, c, g, or t
  modified_base (291)..(291): a, c, t, g, unknown or other
  misc_feature (291)..(291): n is a, c, g, or t
  modified_base (298)..(298): a, c, t, g, unknown or other
  misc_feature (298)..(298): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacattagngactggttggcctggtatcagcagaaaccaggacaaaaaccctaactcctagatttanaagcctntagtttacaagtgggtccagcaaggttcgcgcagtggatcgtgggacagatttcactctacaccatcagcaacctgcagcctggagtactttgactaacttattactgacctaacgtagttaataacttacgtttaaccctacttaaccgttttcgggacggtaaggaaccctaagggttacaacgaaccaaacgtacgtgtacgggctggaccaacctagttctgtccttacgacttccttacccgcctacg

SEQ ID NO: 119639 - DNA, 825 bp, Homo sapiens
  misc_feature: GYAE6OF02F7ZSQ.35.83.H06.1.454.CMB.1.raw
  modified_base (193)..(193): a, c, t, g, unknown or other
  misc_feature (193)..(193): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgtattagtgactggttggcctggtatcagcaagaaaccaggaccaaaaaccctaactcctagtatttaagtaacggcctacttaagtttaacaaaggttcggggtaccccaaggtaccgtaaacgggtttccgggaccggtacgtaagggttacgggtaacgttccggtagggggtaacctaagggtttaaactttttacccgaaccgtttcccgttacccgaaacccgtaacgttacccgaaacggtacccctaaaaccccgttggaccccgtaaaccggtccccgtttagggtaacgggttaaccgtttttacggaaccctttaaaacctttttaacgtttaacccgtacggtaacccctaaaacgtaaggtttaaactttaaaacgtttacccggtttttaaacccccttacgttttaaaccggttttcccggggaacgggtaaccggggtaaaccctaaaaggggttacggaaaccggtaaacccgtaaaacggtaccgttacgggtacggtaccttacggaccctaacccgtagtttccgttacggtttacctttacccgtaacttttccccgtttacccccggaccttaacg

SEQ ID NO: 119640 - DNA, 592 bp, Homo sapiens
  misc_feature: GYAE6OF02IY8TL.35.83.H06.1.454.CMB.1.raw
  modified_base (193)..(193): a, c, t, g, unknown or other
  misc_feature (193)..(193): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttggcctggtatcagcaagaaaccaggaccaaaaaccctaactcctagatttanaaggcctntaagttacaagtcgggtccagcaaggtcgcggcagtgatcagggacagtattcactctcaccatcagcaacctgacagcctgacgtacttgacctaattattactcgacccaaatagttaactaacttacgttacccttacttaaccgtttcgggaccgggtaagggaaccctaaagggtacgaaacgaacccgtaaaacggtacgttacggtacgggtacctacggaccctaaccctagttccgttacgttaccctttaccgaccgtttccctttacccccggactacg

SEQ ID NO: 119641 - DNA, 514 bp, Homo sapiens
  misc_feature: GYAE6OF02F3QLT.35.83.H06.1.454.CMB.1.raw
  modified_base (292)..(292): a, c, t, g, unknown or other
  misc_feature (292)..(292): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcagaaaccaggacaaaaaccctaactcctagatttanaaggcctctagttacaagtgggtccagcaaggtcgcggcagtgatctgggacagattcactctcacatcagcaacctgcagcctgagacttgacaacttattactgaccaatagtataattacgttaccctactaacgtttcggacgtaggaccaaggtacgaagaaccaaacgactgacggtctagccaacatcgtagtaccttcacttcctcccgctacg

SEQ ID NO: 119642 - DNA, 590 bp, Homo sapiens
  misc_feature: GYAE6OF02H9H8H.35.83.H06.1.454.CMB.1.raw
  modified_base (294)..(294): a, c, t, g, unknown or other
  misc_feature (294)..(294): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttgtctggtatcagcaagaaaccaggaccaaaaacctaactcctagtaatttanaacggcctctagtttacaaagtcggggtcccagcaaggttcgcggcagtggatcgtgggacagtatttcatctcacatcagcaaccgtgcagcctgagtacttgactaactttattactgaccaagtagtaataaatcgtttaaccctacttaaaccgtttcgggacggtaacgggtaaccctaaagggtacgaacgaacccaaaacggtacgttggtacggacctacggaccctaaccctagttaccttaggttaccctttcctaaccgtttcccctttcccccggaccttaacg

SEQ ID NO: 119643 - DNA, 577 bp, Homo sapiens
  misc_feature: GYAE6OF02GVQ0V.35.83.H06.1.454.CMB.1.raw
  modified_base (193)..(193): a, c, t, g, unknown or other
  misc_feature (193)..(193): n is a, c, g, or t
  modified_base (292)..(292): a, c, t, g, unknown or other
  misc_feature (292)..(292): n is a, c, g, or t
  modified_base (418)..(418): a, c, t, g, unknown or other
  misc_feature (418)..(418): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttggcctggtatcagcagaaaccaggacaaaaaccctaactcctagatttanaaggcctctaagtttacaaagtggggtcccagcaaggttcggcggcagtggatcgtgggacagatttcactctcaccatcagcaacctgcagcctgagtactttgactaacttattactgaccaanagtataaattacgtttaccctattaaaccgtttcgggacgggtaacgggtaaccaaagggttacgaacgaaccctaaacggtactggtacggactacggacctaaccctagttaccttcggttacctttccaactttcccgttacccccggacctaacg

SEQ ID NO: 119644 - DNA, 556 bp, Homo sapiens
  misc_feature: GYAE6OF02HNJEH.35.83.H06.1.454.CMB.1.raw
  modified_base (193)..(193): a, c, t, g, unknown or other
  misc_feature (193)..(193): n is a, c, g, or t
  modified_base (292)..(292): a, c, t, g, unknown or other
  misc_feature (292)..(292): n is a, c, g, or t
  modified_base (332)..(332): a, c, t, g, unknown or other
  misc_feature (332)..(332): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttggtctggtatcagcaagaaaccaggacaaaaaccctaatcctagatttanaaggcctctaagtttacaagtgggtaccagcaaggttcgngcagtggatcgtgggacagtatttcactctcacatcagcaactgcagctgagtacttgactaacttntactgacctaanagtaataacttacgttacccttacgttaacgtttcgggacggtaacgggaccaaagggtacaacgtaacccaaaggtacttggtacggctacgactaacctacttcgttcgttaccttactaacgttcccttaccccgactaacg

SEQ ID NO: 119645 - DNA, 685 bp, Homo sapiens
  misc_feature: GYAE6OF02GCGHH.35.83.H06.1.454.CMB.1.raw
  modified_base (193)..(193): a, c, t, g, unknown or other
  misc_feature (193)..(193): n is a, c, g, or t
  modified_base (299)..(299): a, c, t, g, unknown or other
  misc_feature (299)..(299): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgacttggttgcctggtatcgagcaagaaaccaggaccaaaaaccctaactcctagtaactttaanaacggccttacttaagtttaacaaagggttcggggtaccccaggtaccgtaaagggtttccgggacggtacaagggtcgggaactcggtaggggaactagggtactttacacgttcctacaacctataccacggacctaaaccgtgaccacggtacctaggaacggtacctttaggaccttaaactttacttaactacggaccctaaacgtagttaacttaaacgttaccgtttaacccttactttaaccgttttacgggaccgggtaacgggtaaccgtaaagggtaacggaacgaacccgtaaacgtacgttaggtacggtacgtacgaaccgtacctagttcctacgttaccttaccgtactttcccgttacccgacctaacg

SEQ ID NO: 119646 - DNA, 614 bp, Homo sapiens
  misc_feature: GYAE6OF02GSRGH.35.83.H06.1.454.CMB.1.raw
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (411)..(411): a, c, t, g, unknown or other
  misc_feature (411)..(411): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccacctgtctgcatctgtgggagacagcgtcatcatcacttgcctggccagtcagacgattagtgactggttggcctggtatcagcaagaaaccaggacaaaaaaccctaactcctagatttaagaaggcctacttaagtttacaaaggtcgggtcccagcaagggttcggcggnagtgatcgtgggacagtatttcactcncacntcagcaacctgcagcctgagtactttgactaacttnttacctgaccaatagtattaaactacgtttaaccctattaaccgtttccgggacgggtaacgggtaacccaaaggggttaaccaaacggtaaaccccgtaaaacggtaccgttagggtacgggaccttaaccgcctaaacccgtagttaccgttcgtttaccctttacgaaccttttcccctttacccccggacccttaaacg

SEQ ID NO: 119647 - DNA, 538 bp, Homo sapiens
  misc_feature: GYAE6OF02F5EKA.35.83.H06.1.454.CMB.1.raw
  modified_base (193)..(193): a, c, t, g, unknown or other
  misc_feature (193)..(193): n is a, c, g, or t
  modified_base (293)..(293): a, c, t, g, unknown or other
  misc_feature (293)..(293): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttggcctggtatcagcagaaaccaggacaaaaaccctaaactcctagatttanaaggcctctaagtttacaaagtggggtcccagcaaggttcgcggcagtggatctgggacagatttcactctcaccatcagcaacctgcagctgaggactttgactaacttattactgaccaatagtataacttacgttaccctacttaacgtttcgggacggtaggtaaccaaggtagaacgtaaccgaaagacgtgtacggcttagaccaccattcgtcgtcttacactccttcccgacctacg

SEQ ID NO: 119648 - DNA, 709 bp, Homo sapiens
  misc_feature: GYAE6OF02J1940.35.83.H06.1.454.CMB.1.raw
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgctatctggtgggagacagcgtcatcatcacttgcctggaccagtcagacgtattagtgactggttcggtccgtggtatccaagcaaggaaaccaggaccaaaaaccctaactcctagtaatttaagtaaacggtccttacgttaagtttaacgaaaggttacgaacgttaccccgaaggttaccgaaacgggttttcgggaaccggtctaacggtgggtacttacggtaggggactagttactttccactcgtaccaaccgtatccaggtaccaaaccttcggactacggacctagggtaacggttactttcggaccttaatttacgttacctacggacccaatacgtaattaacgtacgttttaaccctacggtttaacgtttccgggacgggttaaccgggtaaaccgttaaacgggtacgtaaacgaacccgtaaaggtaacccggtttggtacggtacctaacggcccgttaacctagttacccgttagttaccctttacgacctttcccgttacccccgtaac

SEQ ID NO: 119649 - DNA, 654 bp, Homo sapiens
  misc_feature: GYAE6OF02I237B.35.83.H06.1.454.CMB.1.raw
  modified_base (623)..(623): a, c, t, g, unknown or other
  misc_feature (623)..(623): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgacgtggttggtctggtatcagcaagaaaccaggaccaaaaacccgtaactcctagtaatttataaggtcctacttaagtttacaaaaggtcgggtaccaggcaaggttcggcgcagtggatcgtaggggacagtactttacacttctacacctatccaacgcctaaacccgtgtaccacgtcctgaacgggttactttacggacccttaaacgtttattaactggtaccctaaagagtttaacttaacgttaacgtttaacccttacgttaaccgttttcggggacggtaacgggtaacctaaagggtacgaacgtaaaccgaaaccggtagttacggttacggccttacggaccaacccgtaagtttcccgttacgttcccggttanaacccgtttcccttaccccggacttaaccgg

SEQ ID NO: 119650 - DNA, 556 bp, Homo sapiens
  misc_feature: GYAE6OF02HM42O.35.83.H06.1.454.CMB.1.raw
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (552)..(552): a, c, t, g, unknown or other
  misc_feature (552)..(552): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgtattagtgacttggttggcctggtatcagcaagaaaccaggaccaaaaaccctaactcctagatttanaaggccttntaagtttaacaaaggtcgggtcccagcgtaagggtcgcggcagtggatcgnggganagtatttcactcncaccatcancaacctgacagcctgacggtactttgactaacttattactgaccaactagtataacttacttaccctattaaccgttcgggacggaacgggaacctaaagggtacgaacgaaccaaacgtacttaggcggtactgaccacctatctgtccttcgacttccttaccccgntaac

SEQ ID NO: 119651 - DNA, 597 bp, Homo sapiens
  misc_feature: GYAE6OF02I2FVE.35.83.H06.1.454.CMB.1.raw
  modified_base (193)..(193): a, c, t, g, unknown or other
  misc_feature (193)..(193): n is a, c, g, or t
  modified_base (291)..(291): a, c, t, g, unknown or other
  misc_feature (291)..(291): n is a, c, g, or t
  modified_base (438)..(438): a, c, t, g, unknown or other
  misc_feature (438)..(438): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttggcctggtatcagcagaaaccaggacaaaaaccctaactcctgatttanaaggcctatagtttacaaagttcgggtcccagcaaggttcggcggcaggtgactcgtagggacaggtactttcacttctacgaaccatcagtccaaaccgttgcctagccctaggacggtaactttcggactaacgtttattaccgngacccaaagtagttaataaacgtaccgtttaccctagttaaacctttcgggacggtaacggacctaagggtacaacgaacctaaacgactggtacggcttacgacctaaccctagttccgttaggttcccttagaaccgtttcccttacccgactaacg

SEQ ID NO: 119652 - DNA, 626 bp, Homo sapiens
  misc_feature: GYAE6OF02JBIVR.35.83.H06.1.454.CMB.1.raw
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtnatcatcacttgcctgccagtcagacgattagtgactggttcggcctggtatcagcaagaaaccaggaaccaaaaaaccctaactcctagtaatttanaacggtcctactaagtttaacaaaggtcgggtacccagacaaggttcgcgcagtgatcgagggacagtatttccactctaccaacctatccgagcctaaacctgacagtccctaggagttactttgaccttaaacttacttacagaccctaaatacgttaataaacttacgttaacccttacgttaaacgtttcgggaccgggtaacgggtaacgtaaagggtaacggaacgtaaaccgaaaaggtaccgttggttacgggcttacgggaaccctaacgtagttccttacggttaccttactacgttacccttaccccggacttaacg

SEQ ID NO: 119653 - DNA, 607 bp, Homo sapiens
  misc_feature: GYAE6OF02IXG4D.35.83.H06.1.454.CMB.1.raw
  modified_base (195)..(195): a, c, t, g, unknown or other
  misc_feature (195)..(195): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctcccttccaccctgtctgcatctggtggganacagcgtcatcatcacttgcctggcctagtcagacgattagtgactggttggcctggtatcagcaagaaaccaggaccaaaaaccctaactcctagtattagaacggtcctataagtttacaaaggtcgggtccagactaagggttcgcggtacaggtagtatcgtgggacagtacttcactctcaccatcagtaccaactgacagaccgtgacggtacttcgactaacgtttacttacgacgacctaagtacgttaacttaacgttaccgtttaccttacgttacgtttacgggacggtaacggaaccgtaaaggtacgaacgtaaccgaaacgtacgttaggtacggctaccggactaacctagttccgttacgtccttaccgaccttacccgttaccccgattaaccgg

SEQ ID NO: 119654 - DNA, 580 bp, Homo sapiens
  misc_feature: GYAE6OF02G6821.35.83.H06.1.454.CMB.1.raw
  modified_base (292)..(292): a, c, t, g, unknown or other
  misc_feature (292)..(292): n is a, c, g, or t
  modified_base (441)..(441): a, c, t, g, unknown or other
  misc_feature (441)..(441): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccacctgtctgcatctgtgggagacagcatcatcatcacttgcctggccagtcagacgattagtgactggttggtctggtatcagcagaaaccaggaccaaaaaccctaactcctagatttanaacggcctctagtttacaaagtgggtacccagcaaggttcggcgcagtggatcgtggacagtactttcactctcaccatcagcaaccgtgcagcctgacggtactttgctaacttatactgacctaacagtactaattcgttaaccctnttaaacgtttcggacggtaacggaaccgtaaggtaacgaacgaacccgtaaacgtacgtacggtacggaccgttaggaacctaaccgtaattccgttacggttaccctttaccgtaacctttcccgttaccccgtaacc

SEQ ID NO: 119655 - DNA, 617 bp, Homo sapiens
  misc_feature: GYAE6OF02G688A.35.83.H06.1.454.CMB.1.raw
  modified_base (193)..(193): a, c, t, g, unknown or other
  misc_feature (193)..(193): n is a, c, g, or t
  modified_base (450)..(450): a, c, t, g, unknown or other
  misc_feature (450)..(450): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttgtctggtatcagcaagaaaccaggaccaaaaaccctaactcctagtatttaagaacggtccttacttaagtttaacgaaaggttcggggtacccaggcgtaaagggttcggcggtacaggtggatcgtagggactagtactttccacttctacaccatccagcctaacctgaccagccgtagacgtactttgacctaactttattacngacctaatagttaacttaacgttacgttaccccttagttaaaccgtttcgggacggtaacgggaacctaagggtacgaacgaacccaaacggagttcggtcggtcctagaccctaaccgtattccgttagttaccctttacgtaccgtttcccgttccccgactacg

SEQ ID NO: 119656 - DNA, 632 bp, Homo sapiens
  misc_feature: GYAE6OF02HJ0LW.35.83.H06.1.454.CMB.1.raw
  modified_base (193)..(193): a, c, t, g, unknown or other
  misc_feature (193)..(193): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttcgcctggccagtcaggacattagtgacgtggttggcctggtatcagcaagaaaccaggaaccaaaaaccctaactcctagtaatttaagtaacggtccttacgttaagtttaacgaaagggttcggggtaccccaaggtacgtaacggggttccgggaccggacaggttgggaactcggtaggggaactaggtactttccacttctaccaccatccagtacccaactcgaccacgcccgtaggacggtacctttggaacttaactttataacgtcacctaaatagtaactaagttaccgttacccttacgttaacgttcggggacggtaacggaaccgtaaggtagaacgtaaccaagtacgtggtacgtctcgaaccaactacgttctcgttccttacaccgtttccctcccgacctacg

SEQ ID NO: 119657 - DNA, 659 bp, Homo sapiens
  misc_feature: GYAE6OF02GIO7B.35.83.H06.1.454.CMB.1.raw
  modified_base (192)..(192): a, c, t, g, unknown or other
  misc_feature (192)..(192): n is a, c, g, or t
tcagtacagatcgtcacgaccggtgctcgatttagatcacgtgcgtcgcggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacattagtgatggtgcctggtatcagcacgaaaccaggacaaaaaccctaactcctagatttataaggcctctagtttacaaggtggggtacccagcgaaggttcggcggcaggtggtatccgtagggacagtaatttcactccttacgaacctatacacggcctaacctcgtcagtccgtcgtagggtacctttggccttaaacctttattaccgtacgtaccgtaaaccaggtttaaacttaaacgtttaaccgtttaccccggttactttaacccggttttaccgggcggggaaccgggttaaacccgaaagggtttaacgaaaccgggtaacccaaacccgggttaacgtccggttaggggcccttacgggaccttacccgattccgttagttccgttttaccaaccttaccgtttccccggtaccctaag

SEQ ID NO: 119658 - DNA, 787 bp, Homo sapiens
  misc_feature: GYAE6OF02HIM5H.35.83.H06.1.454.CMB.1.raw
  modified_base (192)..(192): a, c, t, g, unknown or other
  misc_feature (192)..(192): n is a, c, g, or t
  modified_base (234)..(234): a, c, t, g, unknown or other
  misc_feature (234)..(234): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccacctgtctgcatctgtggganacagcgtcatcatcacttgcctggccagtcagacgtattagngacgtggtggcctggtatcagcaagaaaccaggaaccaaaaaccgtaactccgtagtaattttagaacggtccttacgttaacgtttaacgaaaagggttcgggggttaccccaaggtaccgtaaaggggtttccgggacggtacgagggttacgggaacttccggtaggggaacctagggttactttttaccgaaccgtttacctaccaacccgtaacttccgaaacggtaccctaaacccgttggaaccccgtaaggtccccggttaagggtaaccgggtttaccttttacgggaaccctttaaaaccgttttagtttaacccgtacgggtaaacccctaaaacgttaaagtttaactttaaaaccgtttaccggttttaaaccccttaccgttttaaaccggttttccggggaccgggtaaacggggtaaaccctaaaggggttaaaccgaaccggtaaaccgtaaaccggtacgttcggtaccggtctacggacctaaccgtattccgttacgttccttactaccgtttcccgttaccccgacttaacg

SEQ ID NO: 119659 - DNA, 648 bp, Homo sapiens
  misc_feature: GYAE6OF02GACRK.35.83.H06.1.454.CMB.1.raw
  modified_base (199)..(199): a, c, t, g, unknown or other
  misc_feature (199)..(199): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctcctccacctgtctgcatctgtgggagacagcgtnatcatcacttgcctggccagtcaagacgtattagtgacgtgggttcggccttggtactcagcaaacgaaaccgacggaacctaaaaaccctaactcctagtaatttaacgtaacggtccttacttaagtttaacaaaggttcgggtacccaggacgtaagggttccgggcggacgtaggtggacttcggtagggactaggtacttcacttcacactacacacgtacacgtcgacgtacggacccgtaggtactttcgaacctaacttattacctacgtacctaaactagttaacttaacgttaccgttacccttaacgttacgtttcgggacggtaacggaaccgtaacgggtaacgaaaccgtaaaccgaaacggtacgttacgggtcgacgtaacaccgtaccaacgtttcctagttaccttctaccttccgtacccactacttacg

SEQ ID NO: 119660 - DNA, 663 bp, Homo sapiens
  misc_feature: GYAE6OF02IF4SM.35.83.H06.1.454.CMB.1.raw
  modified_base (409)..(409): a, c, t, g, unknown or other
  misc_feature (409)..(409): n is a, c, g, or t
tcagtacagatcgtcacgaccggtgctcgatttagatcacgtgcgtcgcgggggagtcagtctcagtcaggacacagcatggacatgaggctccccgctcagctcctggggctcctgctactctggctccgaggtgccagatgtgacatccagatcgacccagtcctccggccctcctgtctggtgctggtcggagaccagactgaccatctacttggccggacaagtcagtaccgttcgcgtcttaatttaaagttggtatcagtcaagaaacgacgggaaccgcccctacgagctgctgctctatactgtatcttagttcctatcgttgggtccctatacgtaaggttcaggtcggtacgtaggttcggttcgtagggaactagttatttcacgttctacgtacttntacagctacgttcgtcgaacctaaccgtagtaagtacttcggttacgtacgtaaacctttacgtacctgttaaccaaacgtaaccgttaaccgttaaccggaacccgggtacccccttactttacccgttaccggtttaccccgggacccgtaaccggtaccccgtaaaccggtcggtaaacccgtaaccgtaccgaaccggtaaccgttaacgtcggtacgggtccttaaccgccgtaaccctcgtttacccg

SEQ ID NO: 119661 - DNA, 594 bp, Homo sapiens
  misc_feature: GYAE6OF02JG0TS.35.83.H06.1.454.CMB.1.raw
  modified_base (97)..(97): a, c, t, g, unknown or other
  misc_feature (97)..(97): n is a, c, g, or t
  modified_base (190)..(190): a, c, t, g, unknown or other
  misc_feature (190)..(190): n is a, c, g, or t
  modified_base (351)..(351): a, c, t, g, unknown or other
  misc_feature (351)..(351): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagtacagatcgtcacgaccggtgctcgatttagatcacgtgcgtcgcggggagtcagacccagtcaggacacagcatggacatgagggtccccgntcagctcctgggctcctgctgctctggctcccaggtgccaagtgtgacatcgaaatgacccagtctccttccacctgtctgcatctgtggganacagcgtcatcatcacttgcctggccagtcagacgtattagtgacttggttgccttggtatcagcaagaaaccaggaaccaaaaacccgtaatcctagtactttagaacggccttagtaagtttacaaaggttcgggtacccagtacgaaggttcggacgnaggtggatcgtagggaacagtatttacgactctcaactatcagccaaccgtgaccagcctaggacgtctttcgactaaacttnttacgngaccaaactgttaactaagtcttaaccctcgttaaacgtttcgggacgaggtacctaaaggtacgaacgaacctaaacgacgttcgaggtacgtcgacgtaacccgtagtttccgttagttaccttactaaccgtccgttaccccgacttaacg

SEQ ID NO: 119662 - DNA, 695 bp, Homo sapiens
  misc_feature: GYAE6OF02H8I6A.35.83.H06.1.454.CMB.1.raw
  modified_base (193)..(193): a, c, t, g, unknown or other
  misc_feature (193)..(193): n is a, c, g, or t
  modified_base (298)..(298): a, c, t, g, unknown or other
  misc_feature (298)..(298): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgacgtggttggctggtatcagcaagaaaccaggaaccaaaaaccctaactcctagtactttaanaacggtccttacgtaagtttaacgaaaggttcggggtaccccaaggtacgaaacgggttccggacgaacgtaaggttggaacttcgtacggggaactaggtaacttttccgaacttaccgtaccaaccctaattacccgaacggtacctaaacccgttcgacctaacggtcccgttaggaacggttacctttacggacttaaacttttaactaccgtacgaccaaacgttagtaaacttaaacgttacgtttaaccccttacgttaaaccgtttcgggaacgggtaacggtaaacctaaagggtacgaaacgaacccgtaaacgtacgttcggtacggtctacggacctaaccgtacttccgttcgttacttacctacgttaccttcccgactaacg

SEQ ID NO: 119663 - DNA, 672 bp, Homo sapiens
  misc_feature: GYAE6OF02H1NBZ.35.83.H06.1.454.CMB.1.raw
  modified_base (196)..(196): a, c, t, g, unknown or other
  misc_feature (196)..(196): n is a, c, g, or t
  modified_base (242)..(242): a, c, t, g, unknown or other
  misc_feature (242)..(242): n is a, c, g, or t
  modified_base (311)..(311): a, c, t, g, unknown or other
  misc_feature (311)..(311): n is a, c, g, or t
  modified_base (456)..(456): a, c, t, g, unknown or other
  misc_feature (456)..(456): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtcctccttccaccctgtcctgcatctggtggganacagcgtcatcactcattcgcctggcctagtcagaccgtattagtnacgtggttgccttggtatcagacaacgaaccaggaaaccaaaaaacccgtactaccgtataactttaanaacggtccttacgttaagtttaactaaaagggttccggggtacccaaggtaccgtaaagggttccggacggacgtacggttggtaactcggtagggactaagtacgtttccaacgtctaccactatccgaagtacaactcgaccncgtacctggaaacgtcgtttacgacttaacttattaccgtacgactaaacgttagtaattaaacgtacgtttaaacccctgttaaccgtttccgggaacggaacggttaaccaaacgggtacaaagtaccctaaaaggtaaccgttggtacgcttaccgaccgtaacgttaccacgtttccgtacttaccgtacgttcccttccccgacgttaacg

SEQ ID NO: 119664 - DNA, 588 bp, Homo sapiens
  misc_feature: GYAE6OF02I8TD9.35.83.H06.1.454.CMB.1.raw
  modified_base (531)..(531): a, c, t, g, unknown or other
  misc_feature (531)..(531): n is a, c, g, or t
  modified_base (544)..(544): a, c, t, g, unknown or other
  misc_feature (544)..(544): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccacctgtctgcatctgtaggagaaagcgtcaccatcacttcgccggaccagtcagagtattagtattggtgctggtatcagcagaaaccagggaaacgacccctaaactcctagacttacgtttaacgggcgttactaacgttttaggagtaggtcgggtccatcgaagttcagcgcagtggactcgtagggacacgtcgttacacgtcctcacctataccgaccgaagtccctaggccacgtccgtgaatcggtaatttcgactaaccgtctactcgaccaactgtaacttggtacgttacgttccgtaccgtcgtttaccgtccggtacggaacctaagtcgaacgtagtacgaaccgngtacggtggtacncgtaacgctagtcttacgttcctgtaccctttcccgtcctaccg

SEQ ID NO: 119665 - DNA, 740 bp, Homo sapiens
  misc_feature: GYAE6OF02HMPQV.35.83.H06.1.454.CMB.1.raw
  modified_base (98)..(98): a, c, t, g, unknown or other
  misc_feature (98)..(98): n is a, c, g, or t
  modified_base (138)..(138): a, c, t, g, unknown or other
  misc_feature (138)..(138): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (712)..(712): a, c, t, g, unknown or other
  misc_feature (712)..(712): n is a, c, g, or t
  modified_base (735)..(735): a, c, t, g, unknown or other
  misc_feature (735)..(735): n is a, c, g, or t
tcagtacagatcgtcacgaccggtgctcgatttagatcacgtgcgtcgcgggggagtcagacccagtcaggacacagcatggacatgagggtccccgntcagctccgtgggctcctgctgctcgtggctcccaggtcnccaagtgtgacatcgaaatcgacccagtcctcctccaccctgtctgcatcgtggtaggganacngtctnatcatcactgacctcggctaggtcaagacggtattagtgacgtgggtcggcctggtaactcgagacaacgaaaccgaacggaacctaaaaaacccgtaactccttaagtaactttaacgaaacggtccttacgttaacgtttaacggtaaacggttcggggtaacccaaggaccgttaaagggttccgggacggactagggttaggacttcggtaggggaacctagttacgttttaccgaccttacctaccgtaactaatccgaacggtacaaaccgtgaccgttaacggaccgttaggtaacgttacgttacaaccttaactttaaattccgtaacgtactaaaacgtagtaaatttaaacgttaaccgtttacccttaacgtttaaccgttcggggaacggtaaacggggaacccttaaagggtaacgaaaccgaaaccgtaaaacggtaccttagggcggtacgtaccctaacgtaaccttacggtcttaggttcccttaanacccgttttacccgtaccccgtntaacg

SEQ ID NO: 119666 - DNA, 620 bp, Homo sapiens
  misc_feature: GYAE6OF02GES12.35.83.H06.1.454.CMB.1.raw
  modified_base (193)..(193): a, c, t, g, unknown or other
  misc_feature (193)..(193): n is a, c, g, or t
  modified_base (296)..(296): a, c, t, g, unknown or other
  misc_feature (296)..(296): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttgcctggtatcagcaagaaaccaggaccaaaaaccctaactcctagtaatttaanaacggccttacttaagtttaacaaaggttcggggtaccccagcgaagggttcggcggcagtggatcgtagggactagtatttacactctacacctatcaacgccaacctgcagcctaggacggtactttgaccttaaactttattaccgtcgaccctaaatagttaactaaattacgtttaacccctacgttaaccgtttcggggacgggtaacgggtaaccgtaaaggtacgaacgaacccgaaacgtacgttggtacggctacgaccaacctagttaccgttcgttaccttaccaaccgtttcccgttaccccgacctaacg

SEQ ID NO: 119667 - DNA, 644 bp, Homo sapiens
  misc_feature: GYAE6OF02H84W2.35.83.H06.1.454.CMB.1.raw
  modified_base (195)..(195): a, c, t, g, unknown or other
  misc_feature (195)..(195): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtcctccttccaccctgtctgcatcgtgtgggancagcgtcatcatcacttgcctggccagtcagacgtattagtgacgttggtcggtcctggtatcagtacaagaaccaggaaccaaaaacctactcctagtattagagtccttactagttacaagtgtacgtaccagtcgtaaggttcggacgacgtagtgatcgtaggactagtcttcactctacgactactacaacgacctaaccgtgactacgccgttagaacggttacttagacttaaccgttaatttaccgagtaccctaaagtacgtaaattaacgttaaccgtttaacccttctttaaaccggtttcgggaaccgggtaaacggtaaccgtaaagggtaacgtaaccgaaccgtaaaacggtacgttacggtacggtactacggaacctaaccgtacgttccgttacgttcccgttaacgtcctttacccccgttcgtaacccg

SEQ ID NO: 119668 - DNA, 633 bp, Homo sapiens
  misc_feature: GYAE6OF02JEIE3.35.83.H06.1.454.CMB.1.raw
  modified_base (191)..(191): a, c, t, g, unknown or other
  misc_feature (191)..(191): n is a, c, g, or t
  modified_base (298)..(298): a, c, t, g, unknown or other
  misc_feature (298)..(298): n is a, c, g, or t
tcagtacagatcgtcacgaccggtgctcgatttagatcacgtgcgtcgcgggggagtcagacccagtcaggacacagcatggacatgagggtcccgctcagctcctggggctcctgctgctctggctcccaggtgccaagtgtgacatcgaaatgacccagtctccttccacctgtctgcatctgtggganacagcgtcatcatcacttgcctggccagtcaggacgtattacgtgacgttggttggcctggtatcgagcaagaaaccaggacaaaaaccctaactcctagtatttanaaggcctactagtttacaaaggtcgggtacccagtcgtaaggttcggcggcaggtggatcgtgggacagtactttcgacttcgcaccatcgacgcaaccctgccacgtccgtagtacggtactttgacctaaacctttgttaaccgtcgtacccaaacgtggttaacgtcgggttaacgtacctttccgttacgtaccgttttcccgggacccgttaggggaaaccctaaagggttcgtaacttacgtaccgaaaccgtaacgttcggtaccggccttacggaccttaccgtacgtttccgtacggttaccttacgtaccgtttcccgtaccccg

SEQ ID NO: 119669 - DNA, 607 bp, Homo sapiens
  misc_feature: GYAE6OF02IJLMO.35.83.H06.1.454.CMB.1.raw
  modified_base (194)..(194): a, c, t, g, unknown or other
  misc_feature (194)..(194): n is a, c, g, or t
  modified_base (424)..(424): a, c, t, g, unknown or other
  misc_feature (424)..(424): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctcccttccaccctgtctgcatctgtggganacagcgtcatcatcacttcgctcggccagtcagacgattagtgacgttgggttcggccgttggtatcgacgacaacgaaaccgacggaacctaaaaaaccctaactcctagtatttaacgacgtcctacttaagtttaacgaacggttcgggtacccagacgtaacgggttcgggacggcgtaaggtcggtactcggtagggaactaggtactttcactctcaccatcancacctgacagactgtacggtcttagacttaagttattactacgactaacgagtaactaatacgtttaacctagttaccgttcgggaggtacggactaaggtacgaacgaaccgaacgtacgtaggtaccggctaccgacctagtacctgttccttcgtaccttacccgtaccgcctagtaccg

SEQ ID NO: 119670 - DNA, 685 bp, Homo sapiens
  misc_feature: GYAE6OF02JV784.35.83.H06.1.454.CMB.1.raw
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgaccagtctccttccaccctgtctgcatctgtgganacngcgtnatcatcgacttgcctggccagtcagacgattagcgacgttggtcggctggtactcgagcgaagaaccaggtaaccaaaaaccctactacctagtattaagtaacgccttacgtagttaacaaaggtcgggaccctagacgtacggtcgcggcacggtgtatcgtacgggacaagtcgtttcgacttctaccgacctacgtacacgtacctaaccgtcgaccacggtcctaggtcgtaacgttgttaaccctactttaacgtaccttaccgaccgtaaacttaacgttaactaaacgtttaaccgttaaccccttaaccgttaaccggttttacggggaacgggttaccggtaaaaccgggttaacgtaacggtaaacccgaccgttaaaacggtacggttaacgtcgggaccgttaagaccgtaacctacggttccttaacggttacctcggttaacccttcccctttacccggactttaacccgg

SEQ ID NO: 119671 - DNA, 715 bp, Homo sapiens
  misc_feature: GYAE6OF02HX5GR.35.83.H06.1.454.CMB.1.raw
  modified_base (194)..(194): a, c, t, g, unknown or other
  misc_feature (194)..(194): n is a, c, g, or t
  modified_base (235)..(235): a, c, t, g, unknown or other
  misc_feature (235)..(235): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctggtggganacagcgtcatcatcacttgcctgccagtcagacgtattagngactggttcggctggtatcgagacaagaaaccaggtaaccaaaaaacccttaactcctagtaactttaagtaacggtccttacgttaacgtttaacgtaaacgggttcgggggttacccaaggtacgtaagggttccgggacggacgagggttacggagttcgtacggggactaaggtactttaccgacttccacgaccctagtaccacgtacctaaccgtgaccgaacgtcgtagggtaacggttactttacgaccttaaacgtttattaaccgtacgaaccctaaaataagttaacttaaacttaccggtttaaaccccttacgtttaaacccggtttcggggaccggtaaacgggaaccctaagggtaacgaaccggtaaacccgaaacgtaccgttggtacggtaccgttacgaaccctaacgacctttcgtacggtttacccttaccgtaacccgtccttacccccgactttacg

SEQ ID NO: 119672 - DNA, 773 bp, Homo sapiens
  misc_feature: GYAE6OF02IT3ZW.35.83.H06.1.454.CMB.1.raw
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctggtgggagacagcgtcatcatcacttgctggccagtcagacgtattagtgacgtggttcggccttggtatcgagactaacgaaaccacggaacctaaaaaaccctaactccttagtaatttaacgaacggtccttagttaacgtttaacgaaaacggttcggggtacccaaggtaccgtaaaggggttccggaggccgtaaggtggaacttcggtagggaactaagtactttacgacttactaccactactacaacggtactaacccgtggtaccacgggtaccctaggtaaccggttaacgtttaccggaactttaaaacctttacgttaacccgtacggttaaaccccaaacgttaacggtttaaacttaaaaccggttttaccgtttaaaccccgttaccgtttaaacccggttttaccgggggaaccgggtaaccgggtaaaccgaaacggggttacgaaacccgtaaaccggaaaaccggttacgttacgggtccggtaacctaccggtaaccaaacccgttacgttaccgttaccgttacctttaaccgtaccctttccccggttaccccgacttaaccgg

SEQ ID NO: 119673 - DNA, 771 bp, Homo sapiens
  misc_feature: GYAE6OF02JXVKZ.35.83.H06.1.454.CMB.1.raw
tcagtacagatcgtcacgaccggtgctcgatttagatcacgtgcgtcgcgggggagtcagacccagtcaggacacagcatggacatgagggtccccgctcagctccgtgggctcctgctgctctggctccaggtgccaagtgtgacatcgaatgacccagtctccttccacctgtctgcatcgtgtgggacacagcgtacatcatcacttgcctggccagtcagtacgtattagtgtactgggtcgccgtggtatctagacaagaaccgaacggaaccaaaaaccctaactcctagtattacgtaacgtaccttactaagtttaacgaaaggtcggggtaccacggtaacggtaacgggttcgggacggacgtaacggtgggtaagtccggtaggggactagtaacttctaacctcctacctaaccgacttccgaacgtacccgtaaccttaggacccgtacgtcccgttacgggtaaacgttacttttaaccggaccctttaaacttttaccgttaaaccctttaaccgtaaacccgttaagttaaacttaacggttaaacccgttttaacccgtttaaccgtttaaccggtttaccgggtaaccgggggtaacgggtaacccgttaaagggttaacggaaaccggtaaacccgtaaaacgttaaccggttacggtacgggtaccgtccgtaacccgaaccgttaacgtttacccgtacggtttaccctacgttaaccttaccccgttacccggtaacctccgttaaccg

SEQ ID NO: 119674 - DNA, 808 bp, Homo sapiens
  misc_feature: GYAE6OF02FLQPI.35.83.H06.1.454.CMB.1.raw
  modified_base (194)..(194): a, c, t, g, unknown or other
  misc_feature (194)..(194): n is a, c, g, or t
tcagtacagatcgtcacgaccggtgctcgatttagatcacgtgcgtcgcgggggagtcagacccagtcaggacacagcagtggacatgacgggtcccgctcagctcctgggctcctgctgctctcggctcccaggtgaccaagtgtgaacatcgaaatgacccagtctccttccacctgtctgcatctgtgganacagctcatcatcacttcgcctggcctagtcagtacgattagtcgacgtggttgccgttaggtactcgagtacaaggtaaaaccgacggaaccaaaaaacccgttaactcctagtaactttaacgtaacggccttacgtaacgtttaaacaaacggttcggggtaccccaaggtaccgtaaacgggttcgggccggtacgtagggttacggtacgttaccggtacggggaaactaacggtaacttttaccaaccgttaccttacccgaaacctaacgtaccgtaacggtaccctaaacccgttcgacccgtaagaccccgtttaagggaacggttaccgtttacgaaccgttaaaccgtttaacgttaaccgtacgttaacccaaaaacgttacgtttaaacttaaaaccgttaaccgtttttaccccgtaacgtttaaaccccggttttacggggaacccggggttaacggtaaacccgtaaagggttaaccgaacgtaaacccggtaaaccgtacgttacgggtacggtccgtaacacccggtaaccctaacgttacccgttcgtttaaccctttccgtacgtttacccccggttacccgaccgttaaaccg

SEQ ID NO: 119675 - DNA, 743 bp, Homo sapiens
  misc_feature: GYAE6OF02G6TAM.35.83.H06.1.454.CMB.1.raw
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctggtgggagacagcgtcatcatcactgcctggccagtcagacgtattagtgactggttgtctggtatcagcaagaaccaggaaccaaaaaccctaactcctagtactttaagaacggccttactaaggtttaacaaaggttcgggggtaccccaggtaccgtaacgggttcggccggactaggtgggaacttcggtacgggactagtactttcactcctaccaccgatacgacgacctaacgtgacacgtcgtaggtaacggttaccgtttgaaccttaacttactttaacccgtactacccgtaaacgttaagtaacttaaaccgtttaaccgtttaacccccgttaacgtttaaccggtttacccggggaccggggttaaccggggtaacccgttaaaagggggttaaccaaaccgggtaaaccccgtaaaaccgggtacgtttacgggtccggtaaccgttaacccggaaccggtaaccctaacggtttacccgttacgtttacccgtttaccctaaccgttttacccccggttacccccggtaccctttaacgg

SEQ ID NO: 119676 - DNA, 716 bp, Homo sapiens
  misc_feature: GYAE6OF02HUFYV.35.83.H06.1.454.CMB.1.raw
  modified_base (99)..(99): a, c, t, g, unknown or other
  misc_feature (99)..(99): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
tcagtacagatcgtcacgaccggtgctcgatttagatcacgtgcgtcgcgggggagtcgagacccagtcaggacacagcatggacatgagggtccccgntcagctcctgggctcctgctgcctgtggctcccaggtgccaagtgtgacatcggaaatgacccagtcctcccttccacccgtgtctgcctattcgtggtgggacacgaggtctcaatcattccagttcgcctggcctagtccaggaccgtagtttgacgcgttggttcggccttggtaactcgaaggcaacgaaaccgaggaacctaaaaaaccccttanccgttaagtacgtttaanaacggtcccttagtaagtttaaccgaaaggtcgggtaccagaccgtagggtcggcgactaggtacgtcgtgtaggactaagttacttcgtaactcgtaaccgactntacncgaaccaccgtgacgacgtccgtagaaccgttcgttacacttaaagtttacacgtcgtaaccaaagtagtttaaacacggtttaacccgtaacccgtttacctaacgggttttaccggggcggaaacggggttaacccttaaaggggtacaaaccgttaaaccgaaacgtaccggttttcggagtccggttacaccgggttaaacccaagtttcccgggttattccctttaacgaacccccggtttttcgaacccccttagtaacccgg

SEQ ID NO: 119677 - DNA, 780 bp, Homo sapiens
  misc_feature: GYAE6OF02JGY81.35.83.H06.1.454.CMB.1.raw
  modified_base (227)..(227): a, c, t, g, unknown or other
  misc_feature (227)..(227): n is a, c, g, or t
tcagtacagatcgtcacgaccggtgctcgatttagatcacgtgcgtcgcgggggagtcagacccagtcaggacacagcatggacatgagggtcccgctcagctcctgggctcctgctgctctggctccaggtgcaagtgtgacatcgaatgacccagtctccttccaccctgtctgcatctggtggagacagcgtcatcatcactgcctggccagtcagacattagngacttggttggctggtatcagcagaaccaggaacctaaaaaccctaactcctagtaattagtaacggtaccttacgttaacgttttaacgaaacggttcgggggtacccaggtacggtaacgggttacgggccggagtacggtagggtactcggtagggactaggttactttcaacgttaccctactaacgtactaacgacggtacctaaccgtcgtacgtacggtacccgttaggtaacggttacgtttacggaacttaaaccgtttaacgttaccgttacgtaacccgttaaaccgtaaagtttaacttaaacgtttaaccggttttaaccccgtttaacccgtttaaaccgggttttacccggggtaaaccggggttaaccgggggtaaccgttaaaacggggttaaaccgtaaaccgggtaaaacccgtaaaccgtaaccgttacgggtacgggttaaccgtaccgggtaacctaacccggtaacgttacccgttacggttttacctacccgttaaccgtttaccccgttaccccggtaccttaaccgg

SEQ ID NO: 119678 - DNA, 710 bp, Homo sapiens
  misc_feature: GYAE6OF02F89US.35.83.H06.1.454.CMB.1.raw
  modified_base (193)..(193): a, c, t, g, unknown or other
  misc_feature (193)..(193): n is a, c, g, or t
  modified_base (292)..(292): a, c, t, g, unknown or other
  misc_feature (292)..(292): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagtgactggttggcctggtatcagcagaaaccaggaccaaaaaccctaatcctagatttanaaggcctatagttacaagtcgggtaccagctaaggtcgcgcagtgatcgtagggacagtactttacacttcgtaccaaccgtatcgacgtacctaaaccgtggacctaaggtcccttaagggacggttacctttacggaccttaaacgttttacgtttaaccgcggtaaacccctaaaagtaaggtttaaacttaaaacgtttaccgtttaaaccccgttacgttttaaaacccggttttccgggggaaaccgggtaacggggtaaacccctaaaaggggtttacgaaaaccgggaaaccctaaaaacgggtaccgtttagggtacgggtacccttacgggaacccgtaaccttacgttaacccgtttcggttaccctttaccaaccgttttccccgtttacccccggatttaaccgg

SEQ ID NO: 119679 - DNA, 700 bp, Homo sapiens
  misc_feature: GYAE6OF02IL9PR.35.83.H06.1.454.CMB.1.raw
  modified_base (405)..(405): a, c, t, g, unknown or other
  misc_feature (405)..(405): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccagggtgccaaatgtgacatccagatcgacccagtcctccctcccacctgtctgactatcgtgtaggacgacagagtactacttattacgttggtccgggacctagtggtagtagtaagttaaggtggttgggtacgtcctaggtactcagacgaacgaaacggagggaaccgtacccgtaagacctaccgtagtactagtacgtacgggcttcgtcgttaccgtaacgtaaacggtcgggtaccacgtaacggtcgaacgcggacgtagtaggngtacgaggacaagtattacacgtacacgtacactcgagttaccgctacgacacggtactaggtactaggttacttaacgacccttaaacctgttaccgtaactcccaaattctacgtacgtaccttaactttcctttacgttacgggtttaccggagggttaacccggtaagaaacggggttacgtaaccgtacgtaaccggtaggtaaacccggttaacggttcgggtaccggttcgtaacccggtactaaccgttaaccgttttcgaccggttttactacccgggtttaaccc

SEQ ID NO: 119680 - DNA, 774 bp, Homo sapiens
  misc_feature: GYAE6OF02JJQMI.35.83.H06.1.454.CMB.1.raw
  modified_base (308)..(308): a, c, t, g, unknown or other
  misc_feature (308)..(308): n is a, c, g, or t
  modified_base (746)..(746): a, c, t, g, unknown or other
  misc_feature (746)..(746): n is a, c, g, or t
tcagtacagatcgtcacgaccggtgctcgatttagatcacgtgcgtcgcgggggagtcgagacccagtcaggacacagcatggacatgagggtccccgctcagctcctgggctcctgctgctctggctcccaggtgccaagtgtgacatcgaatgacccagtctccttccacccttgtcctgctactcgtggtcgggagaccgagccgtcatcaattccacttcggaccttggaccctagtccagacgtattagtagactggttcggccttggtatcagcaacgaaacaggaaccaaaaaccctaacnccgtagtaatttaacaacggccttacgtaacgtttaacaaaacggtccggggtacctaacgcgtaaacggttccggacggtactaaagggtcgtaacgtacggtaagggtacaaggttactttaccgacgttaccctaccgtaacctagtacgaccgtacgtaaacccttcggaccgtacgggtccctaagggttaacgggttaccgtttaggaacccctttaaaacgtttacctttaacctaccgggtaaacccctaaaggtagttttaaaccaacgttttaaccggtttaaaccccttttacgttaaaccgggttttccggggaaacgggttaaccggggtaaaccgttaaaggttaaccggaaacggttaaaccccaaaccgggtatgggtaccgggtattacggaaccctaaccgttactttacgttaccgttnaccgttacgttcccgttacccgactacg

SEQ ID NO: 119681 - DNA, 706 bp, Homo sapiens
  misc_feature: GYAE6OF02FS0OO.35.83.H06.1.454.CMB.1.raw
  modified_base (194)..(194): a, c, t, g, unknown or other
  misc_feature (194)..(194): n is a, c, g, or t
  modified_base (306)..(306): a, c, t, g, unknown or other
  misc_feature (306)..(306): n is a, c, g, or t
  modified_base (662)..(662): a, c, t, g, unknown or other
  misc_feature (662)..(662): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctggtggganacagcgtcatcatcacttgcctggccagtcagacgtattagtgactggttggccttggtactcgagcaagaaaccaggaacctaaaaaacccctaactccgtagaattttanaacggtccttacttaaggttttaacgaaaacggttcgggggttaaccccaggtaccgtaaagggttccgggaccgggtactagggttcgggaacgttccggtacggggaacgtaggtaactttcgaacccgttcgtaccacccgtacttccgacgtacctaaaccgtcgacgacgtcctaggaacggttactttggaccttaaactttcgttaacctcgaccctaaacgagttaactttaacgttaaccttaaccccttacgtttaaacgtttccggggaaccggtaacgggaaacctaagggtaacgaacggtaaccctaaacggtacgtggttacggctaccgtacctaacctntttaccgtgttccttaccgtacttcccttacccggacccttacg

SEQ ID NO: 119682 - DNA, 694 bp, Homo sapiens
  misc_feature: GYAE6OF02G8NYY.35.83.H06.1.454.CMB.1.raw
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttcaccctgtctgcatctgtgggagacagcgtcatcatcacttgcctggccagtcagacgtattagtgactgggttcggcctggtattcagcaaagaaaccaggaccaaaaaaccctaactccgtagtaatttacgtaacggccttacgttaagttttaacgaaaacggtcgggggttaccccaagtccgtaaaggggtttccggacggacgtaaggttcggtaattccggtaggggaacctaaggtacttttccgaactttcccgtaccgaacccattcgaacgaccctaaaccgtgaccagtcccgtagtacgggtactttggacctaaacttttcttacgtcgacaaactagttaataacgttaccgtttaaccctcttaaacgtttccggggacggtaaccgggtaacaaagggtaccgaaacggaaccctaaaacggtacgtaggttcggtacctaggaaccctaacctacgttcgttaccgtttaccttccgtaaccgtcccgttttaccccgcgttaacc

SEQ ID NO: 119683 - DNA, 703 bp, Homo sapiens
  misc_feature: GYAE6OF02FXGRH.35.83.H06.1.454.CMB.1.raw
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatacgaaatgacccagtcctccttccaccctgtctgcatctggtgggagacagcgtcatcatcacttgcctggccagtcagactattagtgtactggttggccttggtactcagcaagaaccaggaaccaaaaaccctaactcctagtactttaactaacggtccttacttaagtttaacgaaaggttcggggtaccccaggtacgtaagggttccggacggtctaaggtggtactcggtagggactacgtaactttccacttcctaccacctacgtcgaacgtaccctaaaccgtgaccgacgtccgtaggacgttacttacgacttaactttattaaccgtctaaccaacgtacgttaaacttaacgttaaccgtttacccttaacggtttaccgtttaccggggaacggggtaaccggtaaccgtaaacggggtaaacaaaccggtaaacccgtaaacggttacgttaggtaccggtaccgttacgaacccgtaacttacgtttccttacgtttccttaccgttacgtttccccgttacccgacccttaacgg

SEQ ID NO: 119684 - DNA, 743 bp, Homo sapiens
  misc_feature: GYAE6OF02J1S6W.35.83.H06.1.454.CMB.1.raw
  modified_base (98)..(98): a, c, t, g, unknown or other
  misc_feature (98)..(98): n is a, c, g, or t
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (310)..(310): a, c, t, g, unknown or other
  misc_feature (310)..(310): n is a, c, g, or t
tcagtacagatcgtcacgaccggtgctcgatttagatcacgtgcgtcgcgggggagtcagacccagtcaggacacagcatggacatgagggtccccgntcagctcctggggctcctgctgctctggctcccaggtgccaagtgtgacatcgaaatcgacccagtctccttccaccctgtctgcatcgtagcggganacagtcgtcatcatcnccttgccctaggcctaggtcaggactattagngtactggtgccgtggtactcagnaacgaaaccgacggaaccaaaaacctactcctagaactttaanaacggccttagtaacgttaacgaaagtcggggtaccaaggcctaaagggttccggacggctaggttcggaacttcgacgggaactaggtactttacgaacttctaccgacccaagttccaacggtccaaaccgttcggaacgtaaccgtctacggtaagtactttaacggacttaaacgttacttactcggtaaaccataacggttaactaacggtttaaccctaccgtttaacccgttaacgtttttacccgggggaaaccggttacgggtaaaacccgttaaggggttaaacccggaaacgtaaaacccgggttaaaacggttaccgttaacggtaccgggttaacgtaccgtaaccgtaaccgttaacgttcccggttagtttaaccccggttttaaaccccgttcccgttacccggttaccttaaccgg

SEQ ID NO: 119685 - DNA, 603 bp, Homo sapiens
  misc_feature: GYAE6OF02GJF9T.35.83.H06.1.454.CMB.1.raw
  modified_base (98)..(98): a, c, t, g, unknown or other
  misc_feature (98)..(98): n is a, c, g, or t
  modified_base (196)..(196): a, c, t, g, unknown or other
  misc_feature (196)..(196): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (555)..(555): a, c, t, g, unknown or other
  misc_feature (555)..(555): n is a, c, g, or t
tcagtacagatcgtcacgaccggtgctcgatttagatcacgtgcgtcgcgggggagtcagacccagtcaggacacagcatggacatgagggtccccgntcagctcctgggctcctgctgctctggctcccgaggtgccaagtgtgaccatacgaaatgacccagtctccttccaccctgtctgcatcgtgtggganacagcgtcatcatcacttgcctggccagtcagacattagtgacgtggttggcctggtatcagcaagaaccaggaaccaaaaaccctaactcctagtaatttaagaacggtccttgttaagtttaacaaggtcggggtacccaaggcgtaaggttcgggcggntaggtggatcgngggactagtactttcactctaccaccgtatacgacgtaccaaccgtgactaacggtcctaggtacggtaccttgactaacctttattaccgcgaccaatagtaacttaaagtacccgttacctacgttaacgttcgggacggtacggaacctaagggtacaacgtaaccaacgacgtggtacgcncgacctaacgtctacttgttccttaccacctttcccgtcccactaccg

SEQ ID NO: 119686 - DNA, 730 bp, Homo sapiens
  misc_feature: GYAE6OF02H2C0A.35.83.H06.1.454.CMB.1.raw
  modified_base (199)..(199): a, c, t, g, unknown or other
  misc_feature (199)..(199): n is a, c, g, or t
tcagtacagatcgtcacgaccggtgctcgatttagatcacgtgcgtcgcgggggagtcagacccagtcaggacacagcatggacatgagggtccccgctcagctccgtggggctcctgctgctctggctcccaggtcgccaagtgtgacatacgaaatcgacccagtcctcctccacctgtctgctatcgtggtggganacagcgtcatcatcacttgccgtcggcagtcagactattagtgtacgttggttacggccttggtaactcgagtacaaacggaaaccaggaaaccctaaaaaaccctaaccttcgtaacgtaattttaacgaacggtccttaacgttaacgtttaacgaacggttaccggggtaccaagggtacgtaaacggggtttccggacggtacgtaggtcggtaacggttcggagggtaacgtagttaaccgtttcaaccgtttcctaacctacccgtaagttacccgaacgtacccgtaaaccttcggaacctaacggtaccgttacggtaacggttactttaccggaactttaacgtttacttacgtacaaccttaactaagttattaaaccggttacttaaccccgttatttaaccggttcggaacggtaacggaacgtaaggtaacgaaccgtaaaccaacgtcgttacgtcggtactacgtacctacgtaacgttcgttacgttaccacttacccgttcctcccgattacgg

SEQ ID NO: 119687 - DNA, 581 bp, Homo sapiens
  misc_feature: GYAE6OF02IMGU2.35.83.H06.1.454.CMB.1.raw
  modified_base (193)..(193): a, c, t, g, unknown or other
  misc_feature (193)..(193): n is a, c, g, or t
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (513)..(513): a, c, t, g, unknown or other
  misc_feature (513)..(513): n is a, c, g, or t
tcagtacagatcgtcacgaccggtgctcgatttagatcacgtgcgtcgcgggggagtcagacccaggtcaggacacagcatggacatgagggtccccgctcagctcctggggctcctgctgctctggctcccaggtgccaagtgtgacatcgaaatgacccagtcctccttccacctgtctgcatctgtggancagcgtcatcatcacttgcctaggccagtcagacgtattagtgactggttgtactggtatcagcaagaaaccnggaaccaaaaaccctaactcctanatttanaacggcctntagttaacaagtgggtacccagcgaaggttcgacggcagtgatcgtgggacagtatttcacgttctacgacctaagtcacgtccaaacgtcgaccgtagtccctaggtacggtactttcgaaccttaacttacgttactcgaaccctaaagtagtactaacttacgtttacccattaaccgttcgggacgtaacggtacctaaggtanaacgtaacctaagacctggtagctacgacctacacgtctcgttacttcaaccttcttaccccgatacg

SEQ ID NO: 119688 - DNA, 820 bp, Homo sapiens
  misc_feature: GYAE6OF02IEL5D.35.83.H06.1.454.CMB.1.raw
  modified_base (194)..(194): a, c, t, g, unknown or other
  misc_feature (194)..(194): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctcccttccaccctgtctgcatctgtggganacagcgtcatcatcacttgcctggccagcagacgtattagtgacgtggttggcctggtactcagcaagaaaaccacggaaccaaaaaaccctaactacctagtacttaagaacggtcctactagtttacaaaggttcgggtaccaggtacgtaacgggttcggcggtacgtaggtacgaagttcgtaggggaactaggtacttttaccgaccttacctaccgaaccctaacgtaccgaacgtaacctaacccgtacggacccgtaacgtaccccgttagggttaaaccgggtaacctttttacggaaacccgttttaaaacgttttaacctttaaccgttaaccggtaaacccgttaaaacgttaaacggtttaaactttaaaaaccgtttacccgtttaaaaccccgttttaactttaaacccgggttttcccggggaaaccgggtaaacggggtaaacccgtaaaaggggtaaccgttaaacggaaaacccgtaaccggtaaaccgttacgggtacggtaccgttaaccgggaccttaaaacccgtacgttttacccggttaccggtttaacccttttaccgtaaccccggttttccccctttacccccgtacccgttaacccg

SEQ ID NO: 119689 - DNA, 589 bp, Homo sapiens
  misc_feature: GYAE6OF02HYJU2.35.83.H06.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctggtggganacagcgtcatcatcattgcctggccagtcagacgattagtgactggttcgctggtancagcaagaaccaggaaccaaaacctactctagtattanacgtctntagttaacaaggtcggtccagcaggtcgcgtnagtgatcgtggactgattcactcncacntcagcaactgcacgtctagagtacttcgactaacttacttactcgaaccaaacgtaataactaaacgttaccgtttaaccctacgttaaaccggtttcgggaaccgggtaacggtaaccgtaaagggtaacgaaaccgtaaccgtaaacgttacgtcggtaacggacctccggaactaaccgtacttcggttcgttacctttaccaaccgtttccctaccccgtattaacccg

SEQ ID NO: 119690 - DNA, 686 bp, Homo sapiens
  misc_feature: GYAE6OF02HN0HZ.35.83.H06.1.454.CMB.1.raw
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
  modified_base (393)..(393): a, c, t, g, unknown or other
  misc_feature (393)..(393): n is a, c, g, or t
tcagtacagatcgtcacgaccggtgctcgatttagatcacgtgcgtcgcgggggagtcagacccagtcaggacacagcatggacatgagggtccccgctcagctccgtgggctcctgctgctctggctcccaggtgccaagtgtgacatcgaaatcgacccagtctccttccacctgtctgcatctggtggganacngcgtcatcatcacttgctggccagtcagacgtattagngtacgtggttcggcctggtatcagcaagaaaccaggtaaccaaaaaaccctactccttagtaactttaagaacggtccttactaagtttaacaaaggtcgggtacccagacgtaacggttcgcggactaggtgatcgtagggactagtacttcactcncaccatcgaacgcctaaaccgtgaccgacgtcgtaggtacggtacctttacgacttaaacgttacttacctacgaaccctaaacgtagtttaaacttaacgtttaaccgtttaacccgttacgtttaaacccggtttcggggaaccgtaaccggggtaaaccgtaacgggttaacggaaacgtaaacccgtaaacgaaccggtttaggtaccgggtaccgtacgtaccgtaaaccgtactaccgttacgtttccgttactaccggtttacccgttaccccggtacttaaccgg

SEQ ID NO: 119691 - DNA, 713 bp, Homo sapiens
  misc_feature: GYAE6OF02GWVQY.35.83.H06.1.454.CMB.1.raw
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatcgaaatgacccagtctccttccaccctgtctgcatctgtggagacagcgtcaccatcacttggccgggacaacgtcgagagcagttggactagtttactttaaattggtactacgaaaccggaaaccgaacgggaaacgtacccctaaactcctagactctatcgctcgacacttcctattttgacgtaaacggttcggggacccggtgtaacggttcgaggtcggcgtaggtgggtacgtacggtagggaactaagtaacgttcctaaccgttccgtacccaaccgtactaccgaacgtccgtacgttcctacggaccctaaaccgtaggtaacggtttactttaacggacccttaaaccgttaccttaaggtttacgtaaccaaacgttacggtaaccgttaacgtaccggtacccgacccgtacgtaactcgaaccgttccggtacccggacgtaaccgggacgtaccggtacgtaacgggtaacgtaaaaggttaaccggtaacttacgggtacggtaccgttaagcccgttaacctacgttacccggtacgtttacccg

SEQ ID NO: 119692 - DNA, 780 bp, Homo sapiens
  misc_feature: GYAE6OF02HOA42.35.83.H06.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
tcagtacagatcgtcacgaccggtgctcgatttagatcacgtgcgtcgcgggggagtcagacccagtcaggacacagcatggacatgagggtccccgctcagctccgtggggctcctgctgctctggctcccaggtgccaagtgtagacatacgaaatgaccctagtcctccttccaccctgtctgctatctggtaggganacaggctnattcatcacttgctggccagtcagacgtattagtacgagtggttagcgttaggtatcagacaacgaaaccaacggaaacctaaaaaccctaacttacctagtaacgtttaagaacggtaccttaataagtttaacgaaacggttcggggtacccaagtacgtaagggttcggacggtacgaggtacggtatacggtagggaactagtacgtttaccgtaactaccgtaccctaaccgtactacgtaacgtaaccaaccgtagaaccgtacgtacccgttaagggtacggttaacttttaccggaaccttaaacgttttaaccgttaacctaaccggtaaacctaaacgtaagttaaacttaaaccgtttaacgtttaaccccttaacgtttaaaccgggtttacccggggaaaccgggtaaccgggtaaaccgtaaaggggtaaacgtaaccggtaaaaccgttaaaacggacgtttacgggtacggtaccgtaacgtacccgtaaccgttacttaccgtttacggtaccctttaccgtttaccgttaccccttccccggaacttaacccg

SEQ ID NO: 119693 - DNA, 680 bp, Homo sapiens
  misc_feature: GYAE6OF02HQMZN.35.83.H06.1.454.CMB.1.raw
  modified_base (136)..(136): a, c, t, g, unknown or other
  misc_feature (136)..(136): n is a, c, g, or t
  modified_base (197)..(197): a, c, t, g, unknown or other
  misc_feature (197)..(197): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtnccaaggtgtgacatcgaaatcgacccagtcctccttccaccctgtctgcatctggtggganacgagcgtcatcatctacttcgcctggccagtcagacgtagttagtgacgttggttggtctggtactcgagcaacggaaacctacggaacccaaaaaacccttaacgtcctagtaactttaacggtaacggtccttacttaacggtttaacgtaaacggttcggggtaccccaaggtacgtaacggggttcggcggtacgaggtacggactcggtcgggaatagtactttcacttcgtaccaacctactacacgactaacccgtgactacgccgtagtacgtattcgactaactttatacacgaactaacgtaattaataactacgtttaaccctacgttaaccgttacggggaccggaacggtaaccgtaggtaaacaacggaaaccctaaggtacgtacggtacggtcgtaacgaccctagttaacccgttcttaccgttaccgttccttaacccggtttccccgttacccggtactaacg

SEQ ID NO: 119694 - DNA, 646 bp, Homo sapiens
  misc_feature: GYAE6OF02F8M46.35.83.H06.1.454.CMB.1.raw
  modified_base (247)..(247): a, c, t, g, unknown or other
  misc_feature (247)..(247): n is a, c, g, or t
  modified_base (335)..(335): a, c, t, g, unknown or other
  misc_feature (335)..(335): n is a, c, g, or t
  modified_base (405)..(405): a, c, t, g, unknown or other
  misc_feature (405)..(405): n is a, c, g, or t
tcagtacagatcgtcacgaccggtgctcgatttagatcacgtgcgtcgcgggggagtcagacccagtcaggacacagcatggacatgagggtccccgctcagctcctggggctcctgctgctctggctcccaggtgccaagtgtgacatacgaaatgacccagtcctcccttccacctgtctgctatcgtggtgggacgacaggtcgtcatcatccacttcgcctggaccagtcagacgtattaggngagttgggttggaccttggtaatcgagacaacgaaaccgagaacctaaaaccctaactctagtatttagaagtcctagttaacgttanaagggttcgggtccaagtcgtaaggtcggcgagagtggactcgaaggactaggtctttacattccctaancctaagtccaacgtccctaacgtcgaccgacgtacgttacggtacggtttaccgttacgtaaccgttaaactttacgttaccacggtaccctaaagttacgttaaacttaacgttacgttttaaccctagttaaccggttccggggacggtaaggtaccgaaaggtacgaccgtaactaaccggtagtcggtacgctacactaccgtagttcctgttccctctaccgtccttccgtatacg

SEQ ID NO: 119695 - DNA, 701 bp, Homo sapiens
  misc_feature: GYAE6OF02JRAZX.35.83.H06.1.454.CMB.1.raw
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (215)..(215): a, c, t, g, unknown or other
  misc_feature (215)..(215): n is a, c, g, or t
  modified_base (283)..(283): a, c, t, g, unknown or other
  misc_feature (283)..(283): n is a, c, g, or t
tcagtacagatcgtcacgaccggtgctcgatttagatcacgtgcgtcgcgggggagtcagacccagtcaggacacagcatggacatgagggtccccgctccagctccgtgggctccctgctgctctcggctcccgaggtgaccaaggtgtagactatacgaaatcgacccagtcctccttccaccctgtctnctagtctggnggganagcgcgtnatcactcacttcgcccgtggacctagtccaagaacgtagttagtcgtacgttggtacggtcaggttancgtagcaacgaacgcgaaaaccctaaaaccctacgtctagttaataagaacgtcctatttaacggttaaccgaaaggttccggggtccaaggacgtacgggttccggacggtacgtagtaccgttacgtacggttacgggactacttacgtttaccacgttaccgacctaaccgtatcccgaagtaccgaaccgttcgacgttaccacggttaccgaggttacctagtaccgttaatttactactcaccaagtaataacgtaccttaaccgttacctacttacgttaccgggaacgtacgggtaaacctagggttaacaaccggtaaaccgtaacgaggttaacgaccgtacggtactaacgtacccgtagttaccgttctacgttccctaaccgtttccctacccggttactaaccg

SEQ ID NO: 119696 - DNA, 783 bp, Homo sapiens
  misc_feature: GYAE6OF02I7YH9.35.83.H06.1.454.CMB.1.raw
  modified_base (206)..(206): a, c, t, g, unknown or other
  misc_feature (206)..(206): n is a, c, g, or t
  modified_base (575)..(575): a, c, t, g, unknown or other
  misc_feature (575)..(575): n is a, c, g, or t
tcagtacagatcgtcacgaccggtgctcgatttagatcacgtgcgtcgcgggggagtcagacccagtcaggacacagcatggacatgacgggtccccgctcagcctccggtggggccttccgtgctcgctcgtcggtccttacccgaggtcgacctaaggtgtgaacacgtacggtaataccgaccgtacgtccttacccttaccnccgttgtcttcgacttgtccgttagggtgggacgacgtacggtcgtcctaaatcctaactcgtaacgttccgaccggtcgtacctagtacggacgacgttatttacggggtacgtacgttcggggttacgtcgttagcgttacgacgacgtaaacgaaccggtaacaaaccctaaaacctcgttaacgtaagtaacttaacgaacggttccttaacttaacggttaacgtaagggtcggacccgttaaagtcggggttaaggtcgggacgtacgtaacgggtcggtaaacgttcggttaaggggtaaccctaaggttttaacctcggtaccctttccgaagttaaaccttcgaacacgtaccgttaacncggttacacggtacgtacggtctttaactccggtaatttaacgttaactcggttacgtaccttaacgattaacgttaacccgtttctaaccgttacgttaccggtacggtaccgacgtacgaacgtaacgaaccgttaacgaacgttaccgtgacgttacacgaccgtatcgttcgtaacttctaccgttcaccgtttacgaccttcg

SEQ ID NO: 119697 - DNA, 787 bp, Homo sapiens
  misc_feature: GYAE6OF02GDVSM.35.83.H06.1.454.CMB.1.raw
  modified_base (433)..(433): a, c, t, g, unknown or other
  misc_feature (433)..(433): n is a, c, g, or t
tcagtacagatcgtcacgaccggtgctcgatttagatcacgtgcgtcggcgggggagtcagacccagtcaggacacagcatggacatgagggtccccgctcagctcctggggctcctgctgctctgctccgagtgccaagtgtgacatacgaaatcgaaccctagtctccttccacctgtctgcatcgtggtggaacagcgtcatcacttcacgttcgccgtagccagtcaaggtactagtagtggacgttcgggtcgtccgtaggtaatccgaagacgaaacgaaaaccgaaccggtaaaaccaaaaaacccttaacgttacctaaggtaactttaacgtaaccggtaccttaacgtttaacgtttaacgaaagggttccgggtacccaaggtacggtaacgggttccggacggtacgtaaggtcggttaancgggttagggaactacggttactttacctacgttaccgtactaacctaccgtaacgaccgaacctaaccggtacgtacgtaaccggtacgttaacggtaaacgtttaaaccttaaccgttaatttaaaccgtactaaccgaacttaaacttaagttaacttaaaccgttacccgtttaacccgttaagtttacccgggtttacgggaaccgggttaaaccgggtaaacgttaaacgggaacgttaaccggaaaaaccgttaacgtaccggtgtaaccgacggttactaaccgtaacctagtttacctcttttacgacccttacttaccccggtacccttacggtaccttaccgg

SEQ ID NO: 119698 - DNA, 657 bp, Homo sapiens
  misc_feature: GYAE6OF02IU76K.35.83.H06.1.454.CMB.1.raw
  modified_base (137)..(137): a, c, t, g, unknown or other
  misc_feature (137)..(137): n is a, c, g, or t
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (271)..(271): a, c, t, g, unknown or other
  misc_feature (271)..(271): n is a, c, g, or t
  modified_base (410)..(410): a, c, t, g, unknown or other
  misc_feature (410)..(410): n is a, c, g, or t
tcagtacagatcgtcacgaccggtgctcgatttagatcacgtgcgtcgcgggggagtcagacccagtcaggacacagcatggacatgagggtccccgctcagctccgtggggctcctgctgctctggctcccaggtnaccaaggtgtgacatacgaaatcgacccagttcctcccttccaccctgtcctgccatcgtaggtggganacagcctnatacatcgacttgccgtggccagtcagacgtattagtgtacgtggtcgcgtaggtancgagacaaagaaccgagaaaccaaaaacccttactcgtagtaatttaacgaacggtccttagttaacgttaacaacgggttcgggtaccagtaacggtaacgggtcggccggagtggtacgacgtcggtaggactagtntttacacttcacaacagtagacgaccaactcgcgacgtaccgagtacgtacgttgaacttattacgtactacgactaaagtaattaactaacttacctttacccgtaactttacggttaccgggaggtaacccggtaaagtaagggtaaacaaaccggaactaaaccggtacgttcgggatccggttaccaacccggtactactttaggtacctttccacttaccggttacccttccggaacttacg

SEQ ID NO: 119699 - DNA, 776 bp, Homo sapiens
  misc_feature: GYAE6OF02HPM4K.35.83.H06.1.454.CMB.1.raw
  modified_base (760)..(760): a, c, t, g, unknown or other
  misc_feature (760)..(760): n is a, c, g, or t
tcagtacagatcgtcacgaccggtgctcgatttagatcacgtgcggtcggcgggggagtcagacccagtcaggacacagcatggacatgagggtccccgctcagctccgtgggctcctgctgctctggctcccgaggtcgccaaggtgtagacctagtccgaaaatcgaacccagtcctcccttccaccctgtcctgcctagtcgtggtagggacaccagcgtacatctaatcctacttcgcctaggccagtacgagtacgtagtagcgtaccgtggttacggtaccgtggtactccgaacgaccgtaaacgaaaacccggaaacggtaaaccctaaaaaaaccccttaacgttaccgttaacggtttaaacgtttaacgtaaccggtaccttacgtttaaacggttaaacggtaaacgggtccggggtaccctagggtaaccgttaacgggttccggacggacgtggttacgacgttcgtagggaactaggtacttcaccgtactaccatacgtcgaacgtcgtaaccgtcgtacgtaaccctaacggttgtaaacgtttacttaccggaaccttaaaccttaagttaccgttaggtaacctacgtaagttaaccgtttaaaccgaccgttaccgacccggtacgtaacgtccggaacggttcgtaaccgggaccgtaaaggccctaacggtacgtacggaaagtaaacgttaacgtacggtacggtactccgtaacggtacccacgttaacccggttnttaccggtactaccgg

SEQ ID NO: 119700 - DNA, 511 bp, Homo sapiens
  misc_feature: GYAE6OF01D9B8N.25.48.E04.1.454.CMB.1.raw
  modified_base (500)..(500): a, c, t, g, unknown or other
  misc_feature (500)..(500): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccaatatgcttattggtaccagcagaagtcaggtcaggcccctgtgattgttgatataataaagacagtgaagacggccctcgagggactcccgtgagcgtattctctggctccagctcgagggacaatacgtcaccttcgaccatcgagtggagtccgaggcaggaggacgaggctgacttatttctgtacatcagcgacacactcgtacatagtgttcggtttcggaggacggaccgaagcgtcgaccgtccgtcggtcncgcccgaacgg

SEQ ID NO: 119701 - DNA, 494 bp, Homo sapiens
  misc_feature: GYAE6OF01EUR2O.25.48.E04.1.454.CMB.1.raw
  modified_base (316)..(316): a, c, t, g, unknown or other
  misc_feature (316)..(316): n is a, c, g, or t
  modified_base (452)..(452): a, c, t, g, unknown or other
  misc_feature (452)..(452): n is a, c, g, or t
tcagactgtacagtcacgaccggtgctcgatttagagagcgtcacagagagaaggggagaagtagagggatccagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgccaaaaccaatatgcttattggtaccagcagaagtcaggtcaggcccctgtgatgttgatatataaagacagtgagaggccctnaggatccctgagcgattctctggctccagctcagggacaatagtcacctttgaccatcagtggagtccaggcagaggacgaggctgactatttctgtacaatcagcggacacactcgacattatgttggtttcggnggacgggcaagctagacctccgtacggtcacgcccgtaacgg

SEQ ID NO: 119702 - DNA, 594 bp, Homo sapiens
  misc_feature: GYAE6OF01BBSQH.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattcgaccaaaacaatatcgctttattcggtaccagcaagggggaatcgacggtcacggccctgtgattgttagatataataaagactagtagagacgcctcgagggactccgtgacgcgtattctcgtggcctcacgcgtacgaagggaactaagttacgtactaaccgttgaacctagtcgaaggtggaacgtccgaggacgaaggacgggacgacggtctaggtacttagttttctgtactaacgtcgtaacggcgaacaaccctacgttaacgactacttagttacggtttcgggtttcgggacgggacgggtaaccacggtcaccggtaccgtccggtacggcaccggcccgtaacggg

SEQ ID NO: 119703 - DNA, 509 bp, Homo sapiens
  misc_feature: GYAE6OF01DN0NU.25.48.E04.1.454.CMB.1.raw
  modified_base (465)..(465): a, c, t, g, unknown or other
  misc_feature (465)..(465): n is a, c, g, or t
  modified_base (497)..(497): a, c, t, g, unknown or other
  misc_feature (497)..(497): n is a, c, g, or t
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgaccaaaaccttaatatgcttattggtaccagcagaagtcaggtcaggcccctgtgatgttgatatataaagacagtgagaggccctgagggatccctgagcgattctctggctccagctcgagggacaagtagtacaccttgaccatcagtggagtccgaggcaggaggacggaggcgtgacttatttctgtcaatcagcggacaccactcgtacatatgttggttttcggnggtacgggacaagctcgaccgtcgtccggtcncgcccgtaacgg

SEQ ID NO: 119704 - DNA, 560 bp, Homo sapiens
  misc_feature: GYAE6OF01CR5QA.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattgccaaaccaatatgcttattggtaccagcagaagtcaggtcacggccctgtgatgttgatatataaagacagtgagaggccctacgaggactcctgacgcgtacttctcgtcggcctccgagtctacgacggaacaatacgtacctacttacgacctatcgaggtcggacgtaccgaggcaggaggacgaggctagacttattctgtactaatacgagcggacaccgtactacgtactagttagtggttcgggttttcgggacgggtacgggtaccgaacggtccgtacggtacccgtccgtacggtccgaccggcccgtaacccgg

SEQ ID NO: 119705 - DNA, 684 bp, Homo sapiens
  misc_feature: GYAE6OF01C8SH6.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacacgcccaccctcggtgtcagtcgtccccaggacagacggcaggatcactgctctggagatgcattcgaccaaaaccaatatgtacttagttcggtaaccagcaagaagtcgaggtcacggtcccctgtgattgttgatataataaagacagtagagacgacctcgagggactcccgtggacgtcgtattcgtcgtcgggcttccgaacgtcttacggaacgggaactaaagtacgtacctaaccgttacgaacctactacgagttggaacgtcgaggacgaaggagggtaacggagtcgtagtaacttagtttcgtacggttactaacgtaccgtaacggaccgggtaaacctaacccgtaaccgttaccggtaaacttaacgttacgtttacgggttttacggggttttaccggggaaccgggggtaacgggtaaacccgtaaacggtcccggttaccggtaccccggttacccggttaccgggttaccgaacccggacccggtaaaccccgggg

SEQ ID NO: 119706 - DNA, 549 bp, Homo sapiens
  misc_feature: GYAE6OF01C5HRI.25.48.E04.1.454.CMB.1.raw
  modified_base (344)..(344): a, c, t, g, unknown or other
  misc_feature (344)..(344): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaaaccaatatgcttatggtaccagcagaatcagtcacggccctgtgatgttgatataataaagacagtgagaggccctgagggatccctgagcgattctctggctccngtctcgaaggacaagtcgtactaccttgaaccatacgagtggagtaccgaggcgaggaggaacgaggtctagtacttactttcgtagtactaagtacagcggaaccaccgtactcgtaactagtacgttgttcgggttttcgggacgggtacgggaccaacggtctacggtaccccgttacgtccggtacgacgtcccgaacggg

SEQ ID NO: 119707 - DNA, 731 bp, Homo sapiens
  misc_feature: GYAE6OF01C8LFS.25.48.E04.1.454.CMB.1.raw
  modified_base (234)..(234): a, c, t, g, unknown or other
  misc_feature (234)..(234): n is a, c, g, or t
tcagactgtacagtcacgaccggtgctcgatttagagagcgtcacagagagaagggggagaagtagagggatccagaactctgggtgtctcaccatggcctggatccctctacttctcccccctcctcactctctgcacaggctctgaggccctcctatgagctgacacagcccaccctcggtgtcagtcgtcccccaggacaggaccggccaggactccacctgctcgtgganatgcattcgacccaaaaccaattatgtactttaagttcggtaacccagaccaagtaagtcgaaggtccgaccgtccgtgtagtagttgtataataataagtaagagtagtaggacggtaccgtccgtaggacggtacctccgaggacgtacgttacgttcgtcggtccgtaccgtaccgacggttccgaacggtaacggtaactaacgttccgtaccctaacccgtaccgaacctacgtacgggtaggttaccggaaccgtaccgggacggtaaccgggaaggggaaccgggtacgtcgggtaccgttaacgtttacgtttaccgtttacgtacgtactaaccggtacgaccggacctaaacccgtacctcggttaaccgtagttagttaggtttccggggtttacgggttaccggggaaccgggttacgacccgtacgggtccgttaacccggtccccggttacgtaccggtacccggaccgtaccggtacccggg

SEQ ID NO: 119708 - DNA, 793 bp, Homo sapiens
  misc_feature: GYAE6OF01EPUSL.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgacccaaaaccaatatgtcttattcggtaccagacagaagtcgacggtcacggccctgtgattgttagattataataaagactagtgaagacggccctagagggacctcccgtagacgtacgtacgttcctcgtcggtccctccgacggtcctacggaacgggtaaactaacgttacgttacccgtaaccctttacgaacccctagttacccggtaaggttacggggaaccggttacccggaaacgggtaccggtaaacggggtaacggggtaaccgggaacgggttaccgtttaacggttaacccgttttaagtttttacccgttacggtttaaccctaaacgtacccggtaacgggtaacccgggttaacccctaaccccgtaaacccgtttacccggtaaaccttaaacggtttacggtttacgggtttttacggggggttttacccgggaacgggggttaaccgggtaaacccgtaaaccgggtccgttaacccgggtaccccggtttacccggtacccgggttacccgtaacccgggaccccggttaaccccgggg

SEQ ID NO: 119709 - DNA, 580 bp, Homo sapiens
  misc_feature: GYAE6OF01AU5FG.25.48.E04.1.454.CMB.1.raw
  modified_base (224)..(224): a, c, t, g, unknown or other
  misc_feature (224)..(224): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaaccaatatgcttattggtaccagcagaagtcaggtcacggccctgtgatgtgatatataaagacagtgagagccctagaggactccctagacgcgtattctcgtggctccagctacgaggacaatagtcctaccttcgacctatacgtagtggacgtccgaggacgtaggacggacggagaccgtagtacttattttcgtacgttactaacgtccgtaggcccggaacaacccgtactaccgtactagttagtggtttacgggttttcgggacgggtaacgggtacccgaaggtccgttacggtacccgttcccgtacggtaccaccggtcccgtaaccggg

SEQ ID NO: 119710 - DNA, 854 bp, Homo sapiens
  misc_feature: GYAE6OF01CZC6S.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagcccaccctcggtgtcagtcgtccccaggacagacggccaggactccacctgcctcgtggagatgactagttcgaaccaaaaccaattagtcgtactttaagtacggtaaccagacaaggtaacgtcgtaacggtaccgacccggtcccttggtagtagttgttagaaactaaattaaagtaaaacgtacgtaaggttacggaaacgggtacccggtacccctacgggaacgggtacccttacccggtaggtaacggtccgttaacgttttcccgtacggttccgggtacccttacccgacggttacccgtaacggtaaacggggtaaacttaaacggttaccggtaaccctttaacccgtttaccgaaacccgttacgtaacggtaacgggttacgggtaacccggttaacccggaacgggtaaccggtaaacggggaaaccggggtaaaccgggtaacggtaacccgtttaacggttaaacctttttaacgttttaccgttaacgtaaccgttaaacgttaccgaaccgggtaccggtaaaccctaacccggtacgttaaccgtaaccgttaagttacggtttcgggtttacggggtttacccgggacggggtaacggtaaccgacggttaccgtaccggtacccgttaccgtaccggtaacccgaccgtacccggtaacccgg

SEQ ID NO: 119711 - DNA, 566 bp, Homo sapiens
  misc_feature: GYAE6OF01DLNMF.25.48.E04.1.454.CMB.1.raw
  modified_base (383)..(383): a, c, t, g, unknown or other
  misc_feature (383)..(383): n is a, c, g, or t
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattcgaccaaaccaatatgctttatggtaccagcaagaagtcaggtcacggccctgtgatgtagataatataaagcagtgaagacgcctcgagggactcccgtgagtcattctcgtggcttccagctcgaagggacaagtacgtctaaccttnaacatcagtggaagtcgaggacaggaggacgagcgtagtacttagtttctgtacaacgtacgacgaccggaacacctactacgtactaagtacgttaggttgggttttacgggacgggtaacgggtaaccgaaggtccgtacggtacccgtacccggtacggtaccgaccgcccgtaaccggg

SEQ ID NO: 119712 - DNA, 908 bp, Homo sapiens
  misc_feature: GYAE6OF01BVNP0.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtcgtcccccaggacagacggccaggatcacctgctcgtggagatgcattcgaccaaaaccatatgcttattcggtaccagcagaagtcgaggtcacggcccctggtgattgttgatataataaagacagtgagacggccctacgacgggtactcccgtagacgtacgtactttccgtacgtcggtaccttaccgacgtccgttaccggaagggtaacctaaacgttacggttacccgtaacccgtttaccggaaccccgtaacgtttaccggtaacggttacggggtaccggttacccgggaacggggtacccgaaacggggttaaacggggaacccggtaacggggttaccttacggggttaaacccgtttttaacggtttttaccggttaccggtttaaacctaaacggttacccggtaaaaccggggtaccccggggttaaaccccctaaccccggttaacccccggttttaaccggttaaaaccccggttaaacgttttaaccgggggtttttaaccggggttttttaccccggggggggtttttttaaaccggggggaacccccggggggggtttaaaacggggggtaaaccccccgtttaaacggggtaaccccgggtttacccgggttaaccccccgggtttaacccccgggtttacccccgggggttaacccgttaaccccgggggttaaaccccccggttaaacccccgggggg

SEQ ID NO: 119713 - DNA, 687 bp, Homo sapiens
  misc_feature: GYAE6OF01BCZUU.25.48.E04.1.454.CMB.1.raw
  modified_base (318)..(318): a, c, t, g, unknown or other
  misc_feature (318)..(318): n is a, c, g, or t
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgagcctcctatgagctgacacagccaccctcggtgtcagtcgtccccaggacagacggccaggactcaccgtgctctggagatgcattcgaccaaaaccaatactgtactttattacggtaccagccaagtaagtcaggtccacggccctgtgatgtgaatataacaaaganagtagaggagtcccctagagggaccttccgagagcgtattcgcgtgcctacaggtctacggaacggtactaagtacgtaccgtaccttcgactaactcgtaggttagggtacgtaccgaggtcgaacggaacgggtacggacggtcgtaacgtacgttattttccgagttacgaacgttacgaccggaccggtaccctaaccctaccgtttaacccggactacgtttaaacgttcggggttttaccgggttttaaccgggggacccgggtaaaccggggtacccggttaaaccggtccggttacccgggtaacccccgtttccggtaccgggtacccggtaaacccggtaaccccgggtaaacccgggg

SEQ ID NO: 119714 - DNA, 722 bp, Homo sapiens
  misc_feature: GYAE6OF01CEYTF.25.48.E04.1.454.CMB.1.raw
  modified_base (137)..(137): a, c, t, g, unknown or other
  misc_feature (137)..(137): n is a, c, g, or t
tcagactgtacagtcacgaccggtgctcgatttagagagcgtcacagagagaagggggagaagtagagggatccagaactctgggtgtctcaccatgcctggatccctctacttctccccctctcactctctgcacnggctctgagcctctatgagctgacacacgcccacctggtgtcagtcgtcccaggcagcggccaggatcacctgctcgtggatatgactagttacgacccaaaaactattatgtacttagttcggtaaccagaccaagaagtaccgacggtcaacggtccccgtgtacgtagttggtttagaacttaataagttaaagactagtaggaagtaccggtccctagacgggtacctccgtagacggtcgtacgttcctcgtcggaccttccgacgtccgtaacgacgggtaactaacgttacgtaccgtaacctttacggaacctaagtacccgtaagggttacggtaacgtaccggacggtaacgaacgggtaacgggaccggtaggtccgtacggttaactttacgtttcgtacggttaacctaacgtaccgtacggaccggttacccaacccgtaccttaaccgtaacgtacgttaacggttgggtttaccggggttacgggtaccgggtaacgggtaaccaaacgggttcccgttaccggtacccgttacccggtccggtaaccgaccggtaccccgtaaccggg

SEQ ID NO: 119715 - DNA, 612 bp, Homo sapiens
  misc_feature: GYAE6OF01CFRLI.25.48.E04.1.454.CMB.1.raw
  modified_base (226)..(226): a, c, t, g, unknown or other
  misc_feature (226)..(226): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagcccaccctggtgtcagtcgtccccaggacagacggccaggatcacctgctcgtgganatgctattcgaccaaaaccaatatgtacttatcgtacagacaagaagtcgagtcgacgccctgtgatgtgatataataaagactagtgagacggcctagagggtactccgtagacgcgtattccgtcgtacgtcctacgacgtacctacggaacggtaactaagttacgtactaccttagacctagtcgtagtacgacgtacgaggtacaggacggacgaggtctagtacttatttctacgtactaacgtacgtacggaccgtaccaaccgtcgttaccgttaacagtttacgtaggtttacggggtttaccggggaaggtaccgggtaaactacggtcgtacccggtacccggttccgtaccggaccacggaccccgtaaccggg

SEQ ID NO: 119716 - DNA, 628 bp, Homo sapiens
  misc_feature: GYAE6OF01AZXU5.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcccatgagctgacacagccaccctcggtgtcagtgtcccccaggacagacggccaggatcacctgctctggagatgcattgaccaaaaccatatgcttattggtaccagcagaagtcaggtcaggcccctgtcgatgttgatatataaagacagtgagaggccctacgagggactcccgtgagcgtattcctcgtggcctccgacgctcgaacgggacaattacgtacctaccttagacctataccgtaggtcggacgtaccagggaccaggaggacgaggctgtacttactttcgtgtacgtaagtcgacggaccggtaccaaccccgtacgttacccgtaacgtacttaacgtttacgggtttacgggtttttccgggggacgggtaacgggggtaaccctaacgggtccgttaaccgggtacccggtttacccggtaccgggttacccgaccgggtaccccggtaaacccggg

SEQ ID NO: 119717 - DNA, 660 bp, Homo sapiens
  misc_feature: GYAE6OF01BUGBH.25.48.E04.1.454.CMB.1.raw
  modified_base (232)..(232): a, c, t, g, unknown or other
  misc_feature (232)..(232): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagcccaccctcggtgtcagtcgtcccccagggaccagaccggccaggatccacctgctcgtgganatgctattcgaccaaaaccaatatgtactttagttacggtaccagtacaagtaagtacgacggtaccgacggcccccttggtagtacgttggttagtaattaataagttaaaagacgtaagtaggaacggtacggtccccgtacggaacgggtaccttcccgtaggtaacggtcggtaactttcctaccgtcggtaccgttccgacgtccgtacggaacgggaactaacgttacgtaccgtaacccgttacgaacctacgtacgtaaggtcgggaacgttccgaagggaccaaggggaacggaacgacgggtcgtagttaccttagtttctacgtacaacgtcgagaccgacacccacgtacgactattagtggttacggttcggacggacggtacagcgtacgtaccgtcgtagctcgcccgtacgg

SEQ ID NO: 119718 - DNA, 700 bp, Homo sapiens
  misc_feature: GYAE6OF01ENF1N.25.48.E04.1.454.CMB.1.raw
  modified_base (446)..(446): a, c, t, g, unknown or other
  misc_feature (446)..(446): n is a, c, g, or t
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggccctcctatgagctgacacacgcccacccgtcggtgtcagtcgtccccgaggacaggccggccaggatcacctgctcgtggagatgcctagttacgaacccaaaactaatatcgtacttagttacggtaccagacgaagaacgtcgaggtcgacggtccccgtgtacgtagttgttagaattaagtaaactaaagaatagtagagaccgtccgtacgaaggtcctccgagacgtacgtatcgtcgtcgctacgtacgctacgaaggaactaactacgtacctacctacgacctacncggtacggtcgggtactagggacggacggaacgtagtagggacgttacgtacgtaacgttaccgttaacgtacggttaacccggtaccccgggaaccttacccggtaaggttaccgtaaccctttaacggttaggttttaccggggtacggttccggggaacgggtaaccgggtaaccgtagtaccggtaacccgtaaccgttaaccgaaccgttcgaaacccgaccggtaccgtcccgtccccggtacccccg

SEQ ID NO: 119719 - DNA, 760 bp, Homo sapiens
  misc_feature: GYAE6OF01BA2W1.25.48.E04.1.454.CMB.1.raw
  modified_base (293)..(293): a, c, t, g, unknown or other
  misc_feature (293)..(293): n is a, c, g, or t
tcagactgtacagtcacgaccggtgctcgatttagagagcgtcacagagagaagggggagaagtagagggatccagaactctgggtgtctcaccatggcctggatccctctacttctcccctcctcactctctgcacaggctctgaggcctcctatgagctgacacagccaccccgtcggtgtcagtgtccccaggacagacggccaggatcacctgctctggagatgctattcgaccaaaaccaatatgtctttagttcggtaccagtcaagaagtcaggtcagccctgtgntgtgatataataagacagtgagacgcctacgaggactcccgtgacgcgtacttctcgtcggcttaccgacgtcaccggtaagggactaacgtacgtcctaaccgttcgaacctagtaccagggtacggtacggtacccgtaagggaccgaacgggaacgggaacggaacgggtaccgttacggtaaccgttttaacgttttacgttacggtttaaccgtaaacgtaccgttaaacgggaccccggttaaaccgtaaccccccgtaaacgtttacccggttaaaacccttaagtttaaccgtttaacgggggttttacccggggttttttacccggggggaaccgggggggttaaaccgggggttaaaccccggtaaacggggtaccggtttaccccgggttaaaccgggtttcccccggttaccggggttaccccgttaaccgggacccccggggtaaaccccgggg

SEQ ID NO: 119720 - DNA, 761 bp, Homo sapiens
  misc_feature: GYAE6OF01EKBEZ.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagccaccccgtgtctagagtcccgtaccgagacgacggaccgacgagtactaccacgtcgtcctcggtaggactagtcgacttagtaccgaaaccaaaactaattgtccgttatttacggttacgaaccgtacgacgtaaagtaacggtacggtacggtaccggtacccccggtccgttggtacgttagtttaggttagtaaattaagttaaaacgtaaacgtaagtaggtagggaacggtacccggtacccgtaagggaacgtacccgtacggtaagaccgtaacgtttctacgttcggtaccgtcctaacgacgtcgtaacggaacggtaaactaacgtcgtaaccttccgtaactactacgtacggtaggtaggtaccgtacggacggacgaagggacggaacggtacgtagtacgtttacgtttacgtttacgtacgttaactaccgtacggtaccggaccgaccgtaccgtaacgtacttaacgtgtttacggttcgggtttttcggggtaccgggacggggtaaccggacgtaacggtccgtacccggtaccgttccggtaacggtaccgaccggtacggtacccgg

SEQ ID NO: 119721 - DNA, 735 bp, Homo sapiens
  misc_feature: GYAE6OF01CITZW.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagcccaccctcggtgtcagtcgtcccccaaggacagacggccaggatcacctgctctggagatgcattcgaccaaacaatatgtcttaagttggtaaccagacagaagtcaggtcgacggcccctgtcgatgttagataagtaataaagacaggtagaaggacggccctaggacgggactcccgtggagacgtattcctcgtggtcctccgacgtctcgagggaactaagttacgtactacccgttcgaacctacttacgaacggttacggtaacggtaccgaacgggtaccgaagggtaacggggaaccggacgggtaaccttacggtaaccttttaagttttacccgttaacggtaactaaaccgttaccgaacggtacccgggtaacccaaccccgtacccgttaacgttaaccgtacgtttaacggtttacgggtttacggggtttttccggggaccggggttaaaccgggggaacccgttaaaccgggtaccgttaaccgggttacccccggtacccggtttcccgggtaacccgtaaccccgggtccccggtaaacccggg

SEQ ID NO: 119722 - DNA, 623 bp, Homo sapiens
  misc_feature: GYAE6OF01DHLTZ.25.48.E04.1.454.CMB.1.raw
  modified_base (372)..(372): a, c, t, g, unknown or other
  misc_feature (372)..(372): n is a, c, g, or t
tcagactgtacagtcacgaccggtgctcgatttagagagcgtcacagagagaagggggagaagtagagggatccagaactctgggtgtctcaccatggcctggatccctctacttctccccctctcactctctgcacaggctctgaggcctcctatgagctgacacacgcccaccctcggtgtcagtcgtccccaggacacgacggccaggatcacctgctcgtggagatcgctattacgaccaaaaccaatatgtacttagtcggtaccagcaagaagtcaggtacgacggtccccgtgtagtatgttagataataataaagacagtgagcgcctgaggtactccgtgacgacgtattctcgtacgctccngtctacgaaggactaagtacgtacctacctacgaacctataccgaggtcggtaacgtaccgaggacgaaggacgggacgacgtcgttacgtactttgtttcgtacgtaactaacgttacgacggtacccgacctaacccgtcttaacggtaactacgtagttgggttcgggtttccgggacgggtaacggtaccgtaacggccgttaccgtacccggttaccgtcggtaccgtaccgtcccggtaacccgg

SEQ ID NO: 119723 - DNA, 718 bp, Homo sapiens
  misc_feature: GYAE6OF01ERFXP.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgacggcctcctatgagctgacacacgcccacccgtcggtgtcaggtcgtccccgaggaccgaggaccggccaggatccaccgtgcctcgtaggacgatgctagttcgaacccaaaactatatgtactttagttcggtacccagccgaagtaacggtacgaggtccgaaccggtccccgttaggtcggtaatttggttaaggtaattaacgtaaagtaaacgacgtaggtagaacggtacggtccccgtacggacgggtaccttcccgtaggtacggacgttacttcctccgttacgggtccctccgacgtccgtacggaaccgggaataacgttacggtaccctaccgttacgacctagtacgtagggtacggtaacgtacccggaggacgagggaacgaacggtggtacgtagtacctttagtcgtatactaagtaccgacgaccgaactaccctacgtaccgtacttaagttcggtttagggtttacgggtttccgggacggggaacggtaccgaaccgtcggtaaccgtcccgggttacccgttaggacccgaccgacccgtacccggg

SEQ ID NO: 119724 - DNA, 699 bp, Homo sapiens
  misc_feature: GYAE6OF01ELJIG.25.48.E04.1.454.CMB.1.raw
  modified_base (182)..(182): a, c, t, g, unknown or other
  misc_feature (182)..(182): n is a, c, g, or t
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagcccaccctggtntcagtcgtccccaggacagaccggccaggactccacctgctcgtgganatgcattcgacccaaaactatatgctttatcggtaccagcaagaagtcaggtcacggtccctgtcgtagttgttanattataaagtaaacgacgtaggtaggaaggacggtacccctaggaacgggtacctcccgtaggaaccgtcgtaactttccgtcggtcggtccctacgacgtccgtacggaacgggtaactaagttacgtaccctaccgttacgaacctagtcgtaggtacggtacgtaccgaacggtacgaacgggacgtaccggacggtacgttacgtacgtttacgtttacgttacgtaactaaaccgttcgaacggttacccggaacctaacccgttacccgtacgtaaccgttagttaacggttggggtttacggtttacccggggacgggtaacggtaacccgtagtacccgtacggtacccgttcggttacccggacgtacccggacccgtacccgg

SEQ ID NO: 119725 - DNA, 806 bp, Homo sapiens
  misc_feature: GYAE6OF01CN7Z2.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttcctcccccctcctcactctctgcacaggctctgaggcctcctatgagctgacacacgcccaccctcggtgtcagtcgtcccccaggacagacggccaggatccacctgctctggagatgctattcgaccaaaaccaattatacgtactttagttcggtaccagacagtaacgtcgaggtccgaacggtcccctgtacgattgttagaattaataagtaaaacgacgagttaggaacggaccggtcccgtacggaacgggtacctcccgtaggacggtacggttacttcgtaccggttcggtacccttaccgacgtctacggtaacggaaacctaacgttacgtaccctaaccgttcgaaccctagtaccgtaaggtagggtaccggtaccgaacggtacgaagggtaccgggaacggtacggtaaccgtttacggtaaccttttaacgttttcgtaacgtttaaccgtaacgtaccgtaaccggaccggtaaacccgtacccgtaaccgttaccggtaacccttagtttaccgtttaggggtttacggggtttttccgggaccgggggttaaacccgggtaaaccggtaaaccgggttccccgggttaacccgggttaacccccgggttacccccgggttaccggggttaaccccgtacccggggtaacccccccgggttaaacccggggg

SEQ ID NO: 119726 - DNA, 723 bp, Homo sapiens
  misc_feature: GYAE6OF01AJQ52.25.48.E04.1.454.CMB.1.raw
  modified_base (592)..(592): a, c, t, g, unknown or other
  misc_feature (592)..(592): n is a, c, g, or t
tcagactgtacagtcacgaccggtgctcgatttagagagcgtcacagagagaagggggagaagtagagggatccagaactctgggtgtctcaccatggcctggactccctctacttcctccccctcctcactctctgcacaggcttcgtgacggccctcctatgagctacgacacacgcccacccgttggtcgtcaggtccgtccccgaggaccgaggaccggaccgaaggactccaccgttgccgtcgtggacgtatacgctacgtaccgaacctaaaaccgtaattagttcgtacttttacgttacggtaaccaggacctaagtaacggtacgtacggtcgacccggtcccgttggtacggtagttgttagtaattattaaagtaaacgacgtacggtagaccgggtacgtccccgtaggacggtacctacccgtggaaccgtcgttacttcgtacgtcgactccggagtccgtaccggaaggtaaccgtaagttaccggtactaaccgttacgaaccgtacgtacggtaagggtaccggtaccgtcggaacgtacgtaacggacgggaccggtacgtcgtacgtacttntttacggacttacacgtcgaccgaccgacctacctacgtacgatgttacggttcggttaccgggtacgggacgggtacggacgtacccgtcgtaccggtcgtcccggttacgcgtaccggcccggtaccgg

SEQ ID NO: 119727 - DNA, 498 bp, Homo sapiens
  misc_feature: GYAE6OF02H2LX2.25.48.E04.1.454.CMB.1.raw
  modified_base (413)..(413): a, c, t, g, unknown or other
  misc_feature (413)..(413): n is a, c, g, or t
tcagactgtacagtcacgaccggtgctcgatttagagagcgtcacagagagaaggggagaagtagagggatccagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaacaatatgcttattggaccagcagaagtcaggtcaggccctgtgatgttgatataataaagacagtgagaggcccctagagggactcccgtgagcgattctctggctcagctcaggacaatagtcaaccttgaccatcagtgagtccaggcaggaggacgtaggctgactattcngtacaatcagcgacaccatcgtacatactggtagtttcggacggagggaccaagcgtcggaccgtccgtcgggtcacgccaacgg

SEQ ID NO: 119728 - DNA, 490 bp, Homo sapiens
  misc_feature: GYAE6OF02FRJCU.25.48.E04.1.454.CMB.1.raw
  modified_base (316)..(316): a, c, t, g, unknown or other
  misc_feature (316)..(316): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccaatatgcttattggtaccagcagaagtcaggtcaggcccctgtgatgttgatatataaaagacagtgagaggccctnagggatccctgagcgattctctggctccagctcagggacaatagtcaccttgaccatcagtggagtccaggcagaggacgaggctgactattctgtcaatcagcgacaccactcgtacatatgtggttttcggcggaggaccaagctggaccgtccgtcggtcacgcccaacgg

SEQ ID NO: 119729 - DNA, 497 bp, Homo sapiens
  misc_feature: GYAE6OF02IA53A.25.48.E04.1.454.CMB.1.raw
  modified_base (372)..(372): a, c, t, g, unknown or other
  misc_feature (372)..(372): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccaatatgcttaattggtaccagcagaagtcaggtcaggccctgtgatgttgatatataaagacagtgagaggccctgagggatccctgagcgattctctggctccagctcagggacaatagtcacttgaccancagtgagttcaggcagaggacgaggctgactaatttctgtacaatcagcggacaccactcgtacatatgttggttttcggacggtagggaccaagcgtagaccgtcctcggtcacgccctaacgg

SEQ ID NO: 119730 - DNA, 640 bp, Homo sapiens
  misc_feature: GYAE6OF02GZWEE.25.48.E04.1.454.CMB.1.raw
tcagactgtacagtcacgaccggtgctcgatttagagagcgtcacagagagaaggggagaagtagagggatccagaactctgggtgtctcaccatggcctggatccctctacttctcccctcctcactctctgcacaggctctgaggcctcctatgagctgacacagccaccctcggtgtcagtcgtccccaggacagacggccaggactcacctgctctggagatgctattcgaccaaaaccaatatgacttattggtaccagacgagaagtctaacggtcaacggcccctggtacgattggttagaatagtaactaaagacagtgagacggccctagaggactccgtgacgcgtattcgtctggtcctcgaagcctacggagggtaactaagttacgtctaacccttgacctaagtcgagtcgacgtccaggtacaaggacggacgaggcttagactttactttcgtacgtactaacgtccgaacggtcggaacctaacccgtaacgttaccgtaacgtacgttacgttggtttaccgggttttagggacccgggtaaacggggtaacccgaacggttccgtaaccggttacccggttcccggttacgggtacccaccggggtaacccctaaccgggg

SEQ ID NO: 119731 - DNA, 509 bp, Homo sapiens
  misc_feature: GYAE6OF02HQQKX.25.48.E04.1.454.CMB.1.raw
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgccaaaaccaataatgcttattggtaccagcagaagtcaggtcaggcccctgtgatgttgatatataaagacagtgagaggccctnagggatcccgtgancgattctctggcctcngtctcagggaacaatagtcaaccttgaacctattagtggtacgtccgaggcaggaggacgaggctgactagtttctgtcaatcagcgacaaccactcgacatatgttcggttttcggcggaggccaagcgtgaccgtccgtcggtcacgcccgaaggtccg

SEQ ID NO: 119732 - DNA, 535 bp, Homo sapiens
  misc_feature: GYAE6OF02G7Q8O.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccaatatgcttattggtaccagcagaagtcaggtcacggcccctgtgatgttgatataataaagacagtgagacggccctacgagggactcccgtagagcgtattctctggcctccgagctcgaagggacaatacgtacaccttgacctatacagtaggacgtccaggcgagaggacgaggcgtgtacttatttctaggtactaagtcacgcgacacacgtacgtacatatgtacgggtttcggacggtaggaccgagtcgtacggtaccgtccgtacggtcgtaccgccgtaacgg

SEQ ID NO: 119733 - DNA, 616 bp, Homo sapiens
  misc_feature: GYAE6OF02HMFTL.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccaatatgcttattggtaccagcaagaagtcaggtcacggccctgtgatgttgatataataaagacagtgagaggccctgagggactcccgtggacgcgtatttctcgtggctccgagcctacgagggacaagtacgtacctaccgttacgacctatacgaggtgggaacgtccgaaggcgaacggaagggacgacggctagtactttatttcgtgtactacgtacgaggaccggtaaccaacctaaccgtacgtaacctagttacgtttggtttacggggttttcgggaccggggtaacgggtaacccgtaacggtccgttaccgggtaccccggttcccgttaccgggtacccgtaccggtaccccggtaaccggg

SEQ ID NO: 119734 - DNA, 656 bp, Homo sapiens
  misc_feature: GYAE6OF02IQXMP.25.48.E04.1.454.CMB.1.raw
  modified_base (301)..(301): a, c, t, g, unknown or other
  misc_feature (301)..(301): n is a, c, g, or t
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagccaccctcggtgtcagtcgtccccaggacagacggccaggactcacctgctcgtggagatgcagttcgaccaaaacaatatgtcttattggtaaccagacaagtaagtcagggtcacggtcccctgtacgntgtgatataataaagacagtagagacgccctagacgggactaccgtgacgcgtattctcgtcggtctccgagtctacgacgggaactaagtacgtacctacctttacgacctactccgtaaggtcggtacgttaccgaagggtaccgaaggtaagggaccggacggtccgtacgtacttacgtttccgtagttaaccacgttacgacgtaccggaaccctaacctaccgtaaccgtaactaacgttagttacggttttcgggttacccgggtagggtacgggtaaacccgaaggtaccggttacggaccccgttcccgggtaccggtacccggtaccggtcccgtaaacccgggg

SEQ ID NO: 119735 - DNA, 641 bp, Homo sapiens
  misc_feature: GYAE6OF02HPNFO.25.48.E04.1.454.CMB.1.raw
  modified_base (227)..(227): a, c, t, g, unknown or other
  misc_feature (227)..(227): n is a, c, g, or t
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagccaccctcggtgtcagtcgtccccaggaccagacggccaggatcacctgctctgganatgcattgaccaaaaccaataatgcttattggtaccagcagaagtcaggtcaggcccctgtgatgtgatatataaagacagtgagacggccctgagggatcccgtgaggcgtagttctctggactccagctcgaggacaatacgtctacccttagacccatacgagtgggtacgtaccgaggacgaaggacgggaacggacgggtccgtagtaaccgtttaagttttccgttcggttaactaactttccggaacggacccggtaaccgaaccccgtaccgttaacccgtaactaagttagtttcggtttacggggtttttccggggcggggtaacggggaacccgtaaacggtccgttaccggtaccccggttcccgttacccgggttccgacccggtacccccgtaaccgggg

SEQ ID NO: 119736 - DNA, 703 bp, Homo sapiens
  misc_feature: GYAE6OF02HXL0M.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcactgctctggagatgcattgccaaaacatatgcttatggtaccagcagaagtcaggtcacggccctgtcgattgttgattataataaagactagtagagacggccctagagggtactcccgtggacgcggtatttccgtcgtggtccttccgaagtcctacggaacggggtaactaaacgttacggttacctaacccgttttacgaaacccctaagtacccgtagggttacgggtaaccggttaccgacgggaccgaagggaacgggacggaacgggtccttagggtaacctttcgtttaacgttcgttaacgtaacttaccgacggaccggtaaccacccgtaactacccggttaactacgttacggtttcggttttaccggggttttccgggaccgggtaacgggtaaacccggtaaggtcccggttacggtaccccggttacccggttacccggggtaccctaacccgggaccccggtaaaccccgggg

SEQ ID NO: 119737 - DNA, 514 bp, Homo sapiens
  misc_feature: GYAE6OF02FG81F.25.48.E04.1.454.CMB.1.raw
  modified_base (432)..(432): a, c, t, g, unknown or other
  misc_feature (432)..(432): n is a, c, g, or t
  modified_base (466)..(466): a, c, t, g, unknown or other
  misc_feature (466)..(466): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatccacctgctcgtggagatgcattcgccaaaaccaatatgcttattggtaccagcagaagtcaggtcaggcccctgtcgatgttgatataataaagacagtgagaggtcccctgagggtatcccctgacgcgattctctggctccagctcgagggaccaatacgtccacttcgacctatcagtggagtccaggcaggagacgagctgacttattctgtacatnagtcgacaccatcgtacatatagtggttttcggnggacggaccgtaagccgtaggacccgtccgtcgcctacgccctaacgg

SEQ ID NO: 119738 - DNA, 645 bp, Homo sapiens
  misc_feature: GYAE6OF02JVMGJ.25.48.E04.1.454.CMB.1.raw
  modified_base (179)..(179): a, c, t, g, unknown or other
  misc_feature (179)..(179): n is a, c, g, or t
tcagactgtacagtcacgaccggtgctcgatttagagagcgtcacagagagaaggggagaagtagagggatccagaactctgggtgtctcaccatggcctggatccctctacttctcccctcctcactctctgcacaggctctgaggcctcctatgagctgacacagccaccctcggtntcagtgtccccaggacagacggccaggactccacctgctcgtggagatgctattcgaccaaaccaatactgtacttattacggtaccagccagaagtcaggtacaggacccctggtagagttcgttgatataataaacgactagtagaggacggaccctcgagggtactcccgtagacgacgtacttactcgtacggtcctccacggtcctacggacgggtaacaacgtacgtaccaaccgttacgaaccctataccgtaggtacggtacgtccgtacggtacgaaggacggaccggaggtctaggtacttacgtttcgtagtactaacgtcgacgtaccggtaactacccgacttacgacgtacttactcggtttacgggtttacggacgggttaacggtaacccggtacgtaccgtacggtacccggttacccgtacggttaccgaccggtcccgtaacccggg

SEQ ID NO: 119739 - DNA, 641 bp, Homo sapiens
  misc_feature: GYAE6OF02H91VX.25.48.E04.1.454.CMB.1.raw
  modified_base (223)..(223): a, c, t, g, unknown or other
  misc_feature (223)..(223): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagcccaccctcggtgtcagtcgtccccaggacagacggccaggactcacctgcctntggagatgctattgaccaaaaccaatactgtctttattggtaaccagcaagaagtcgaggtcaacggccctgtgatgttgatataataaagacagtgaggacgcctacgacgggtactcccgtagagtcgtattcgtcgtacggcctccgagtcctacggacggtaactaagtacgtacctaacccgtttaggaaccctaattaccgtaggtagggtaccgtacggacgggacagggaaacggtacggagggtacgtagtactttaacgtttcttgtaactaacgtacacggaccgtaacccgactaccgttacgtactagttacgttgggtttacggtttcgggaaccgggtaaggaacccgtacgtcgtaccggtacccggttccgtaccgggaccttacccggaccgtaacccgg

SEQ ID NO: 119740 - DNA, 503 bp, Homo sapiens
  misc_feature: GYAE6OF02FR4UT.25.48.E04.1.454.CMB.1.raw
  modified_base (316)..(316): a, c, t, g, unknown or other
  misc_feature (316)..(316): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccaatatgcttattggtaccagcagaagtcaggtcaggcccctgtgatgttgatatataaagacagtgagaggccctnagggactccctgagcgattctctggctccagctcgagggacaatagtcaccttgaccatcagtggagtccaggcaggaggacgaggctgacttatttctgtacaatcagcgacaccactcgtacatatgtagggtttcggacggtagggaccaagctacgtaccgtccgtcggtcgacgccctaacg

SEQ ID NO: 119741 - DNA, 778 bp, Homo sapiens
  misc_feature: GYAE6OF02HE6MQ.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtcgtccccaggacagacggccaggactcacctgctctggagatgcattcgccaaaaccaatatgactttattggtaccagacagaagtcgaggtcacggtcccctgtgatgttgaatataataaagacagtgaagcggccctgacgggtactcccgtagacgtcgtatttccgtacgtcggtcctccgaaggtcccttcggaaaggggaacctaaagttacgttaccgtacccgtttacgaacccgtaatccgtaagggttacgggacgttaccccgagggtaccgaagggtaacgggacgggtaacggccgttacggtaacctttacgttttaccgtacggtttaaccgtaaacgttaccggaaaccggtcccgggtaaaccgtaaacccccggtaccgttaacccggtttaaaccgtaaacgtttacggtttacgggggttttttaccggggttttttacccgggggaccggggggttaaaccggggtaacccggttaaaccgggtaccggtttaacccgggttaccccgggtttacccgggttacccccgggtttaccggaacccgggttaccccccggtaaacccgggg

SEQ ID NO: 119742 - DNA, 622 bp, Homo sapiens
  misc_feature: GYAE6OF02INMWU.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggccttcctatgagctgacacagccaccctcggtgtcagtcgtccccaggaccagacggccaggatcacctgctctggagatgcattgaccaaacaatatgcttattgtaccagcaagagtcaggtcacggccctgtgattgttagattataataaagactagtagagacggccctgagggactcccgtagacgtcgtacttcgtcgtgtcctaccagcttacgagggtaacctaaagttacggtacctaccgttacgaacctaatcgtaaggtggacggtccgaggcgaaggtaacgggacgaacggcgttagtaccttagtttcagttaccaagttacaacggtccgaaccaccgtacgtaccgtaactaagttacgtacgggtttggtttcgggacgggtaacggtacccggtaaggtcccgttaccggacccggtttcccgtccggtaccgtacggaccccgttaaccgg

SEQ ID NO: 119743 - DNA, 722 bp, Homo sapiens
  misc_feature: GYAE6OF02H23BJ.25.48.E04.1.454.CMB.1.raw
  modified_base (298)..(298): a, c, t, g, unknown or other
  misc_feature (298)..(298): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccatatgcttattggtaccagcaagaagtcaggtcacggccctgtgatgttgatataanaaagacagtagagacgccctagagggactcccgtggacgtcgtattctcgtcggcctccgagtcctaccgaagggaacctaaacgttacgtacctaacccgtttacgaaccctaagttaccgtaagggttcgggtaaccgttacccggaacgggacgtaaacgggaacgggtaaccggacgggtaccgttaacgtaaccgtttaacgttttcgtacggttaacctaaacgttccgaaccgggtaccgggtaaccctaacccgtaaaccgttaacccgttaacttaacgtttacggtttcgggttttaccggggtttttaccggggaaccgggggtaaccgggtaacccgtaaacgggtcccgttaccgggtaaccccggttcccggttaccgggttacccgaccggtaccccggtaaacccggg

SEQ ID NO: 119744 - DNA, 622 bp, Homo sapiens
  misc_feature: GYAE6OF02IDL9Z.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgaccaaaaccaatatgtcttagttggtaaccagcagaagtcgaggtcacggccctgtgattgttgaatataataaagactagtgagaggcctgaggactccgtgagcgtattctacgtggcttccgagctacgagggaactaagtacgtctacgttacgaaccagtacaggttaggacgtaccgaggtacgaaggacggaacgaggtactagtacttatttacgtacgtactaacgtaccgaacggccgggaacacccttacgtaccgtaactagttacgttgggttttcgggttttaccggggaccggggtaacgggtaaccccgtaaagggtcccgtacggtacccggttacccggttcggtaacccgaccggtaccccgtaaccggg

SEQ ID NO: 119745 - DNA, 585 bp, Homo sapiens
  misc_feature: GYAE6OF02JXB42.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgtacaaaaccaatatgcttattggtacagcagaagtcaggtcagccctgcgatgtgatatataaagacagtgagaggccctagagggactcccagacgcgtattctcgtggctcagtctacgaggacatacgtacaccttgaccatcaggtgacgtcgaggcaggaagacggacggtctaggtacttaacgtttcgagttaacagtacgacggtaccggaacctacccacgttaccgtaactagttacgttacggtttacgggtttaccgggacggtagggaacccgtaaacggtccggttaaccggtacccggttaccgttaccgggtaccttaccgggcccgttaacccggg

SEQ ID NO: 119746 - DNA, 703 bp, Homo sapiens
  misc_feature: GYAE6OF02FR5MT.25.48.E04.1.454.CMB.1.raw
  modified_base (224)..(224): a, c, t, g, unknown or other
  misc_feature (224)..(224): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctggtgtcagtgtccccaggacaggacggccaggatcacctgctctgganatgcattgaccaaaaccaatatgcttatggtaccagcagaagtcaggtcgacgcccctgtcgatgttagatatataaagacagtgagacggccctagagggtacctcccgtagagcgtaatttcctcgtcggtcctaccgacgtcctacgaacggggtacaaacgttacgtaccctaacccgtttcgaacccgtaactccgtaaacgggttgggtaaccggttacccgaagggccgtaaacgggaacgggtaaccggacgggtaccgttacgtacgtttaagttttccgttaagtaccgtaaacgttaccgaaccggtaccggttaacccaaccctaaccgttaccgtaaacctaagtttacttagggtttacggggtttttaaccgggacggggtaaacgggtaacccgtaacggtcccggtaccggttacccggttacccggttaccgggtacccgtaccggtaccccgtaaccggg

SEQ ID NO: 119747 - DNA, 691 bp, Homo sapiens
  misc_feature: GYAE6OF02GGZOH.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaccaatatgcttattggtaccagcagaagtcaggtcaggccctgtgatgttgataatataaagacagtagagacgccctcgagggtactcccgtgacgcgtatttccgtcgtcggtccttaccgagtcctacgaagggaacaaagttacgtacctaaccgtttacgaacccattacgtaaggtcgggaacggttacccggaacgggaccggaacgggaacgggtaaccgggtacgggtccttaacggtaccgttttaacgttttaccgtgttaccgtaaacgttccgaaacggacccggtaaaccctaaccccgaccgttacgttaactaagtttacgttcggtttacggggtttttaaccggggccgggttaaacgggaaccgttaacggaccgttacgggtaccccggtttacccggtaccgggtttaccgaccggtaccccgtaaccggg

SEQ ID NO: 119748 - DNA, 636 bp, Homo sapiens
  misc_feature: GYAE6OF02GEPID.25.48.E04.1.454.CMB.1.raw
tcagactgtacagtcacgaccggtgctcgatttagagagcgtcacagagagaaggggagaagtagagggatccagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgaccaaaccaatatgcttattggtaccagcagaagtcaggtcaggccctgtcgatgttagattatataaagacagtgagacgccctgagggactcccgtagacgcgtattcgtctacggcctccgagtctacgaacggggtaacaagtacgtaccacctttagaacctatcgtaagtggtacgtcccgaggccgaaggaacggacggaggacgtacgtacctttatttcgtacgtacaacttcgaacgtaccggaacccaaccctacgtaccgttaacaagtttacgttcggtttacggggttttaaccgggacggggttaaccggggaacccgtaaaggtccggttaacccggtaacccggtttcccgttaccggggtaacccgttacggaccccggtaacccggg

SEQ ID NO: 119749 - DNA, 519 bp, Homo sapiens
  misc_feature: GYAE6OF02GL3F8.25.48.E04.1.454.CMB.1.raw
  modified_base (414)..(414): a, c, t, g, unknown or other
  misc_feature (414)..(414): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccaatatgcttattggtaccagcagaagtcaggtcaggcccctgtgatgttgatatataaagacagtgagaggccctcgagggactcccgtgagcgattctctggctccagctcgagggacaatacgtcaccttcgaccatcaggtgagtccaggcaggaggacgaggctgacttntttctgtacatcgagcgacaccactcgtacatagtggttcggttttcgggacgggtacgggaaccgtagcgtacgtccgtccgtcggtacgacgacccgtaacgg

SEQ ID NO: 119750 - DNA, 705 bp, Homo sapiens
  misc_feature: GYAE6OF02GU926.25.48.E04.1.454.CMB.1.raw
tcagactgtacagtcacgaccggtgctcgatttagagagcgtcacagagagaagggggagaagtagagggatccagaactctgggtgtctcaccatggcctggatccctctacttctcccccctcctcactctctgcacaggctctggacggcctcctatgagctgacacgagcccacccgtcggtgtcagtcgtccccaggacaggaccggccaggatcacctgcctgtggagatgactattcgaacccaaaacctaattatacggtactttaagttcggtaacccgtagaccgaaggtaacgtacgaaggttccgacgggtacccctggtgtacgttgttagaattaataaagttaaacgacgtaaggtacggtaggaccgtacccgtacggaacgggtaccttacccgtaggaacgtccgttaacgttccgttacggtccggtacccttcgacgtccgtaaccggaaacggtaactaaacgttacgtacctaacccgtttaggaaccctacgttacggacggtaacggtaccgtaccggacggacgaacgggtacgggaacggtggtaccgtagttactttacgtcttaacgtataacgtcgacggacctacacctactactatagttcgttaggttcgggttaccgggaggtacggaacgtagtccgtcgtccggtcgttaccgacgtacccgagtacccg

SEQ ID NO: 119751 - DNA, 610 bp, Homo sapiens
  misc_feature: GYAE6OF02HNR9H.25.48.E04.1.454.CMB.1.raw
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (313)..(313): a, c, t, g, unknown or other
  misc_feature (313)..(313): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccaatangtctttagtcgtacancaagaacgngtagtacacggccctgtcgtagttgtgtaatataaagtaagntagtagaaggaccgccctaggaacgggtcctccgtaggacgtacgtacttcgtacgtcggtcctccgagtcctaacggacggaactaatacgtacctacgttacgaacctatacgtaggtaggtacgtcgaagaccgaaggaacggacggacgcgtacgtaacttacgtttagtcggttaacaacgtcgacggtacgaaccaccgtactacgtaactagttacgttggtttcggttacgggacgggtacggaacgtagccgtacggtccgtccgtccggtacgaccggacgtaccgg

SEQ ID NO: 119752 - DNA, 730 bp, Homo sapiens
  misc_feature: GYAE6OF02I0CSF.25.48.E04.1.454.CMB.1.raw
  modified_base (183)..(183): a, c, t, g, unknown or other
  misc_feature (183)..(183): n is a, c, g, or t
tcagactgtacagtcacgaccggtgctcgatttagagagcgtcacagagagaagggggagaagtagagggatccagaactctgggtgtctcaccatggcctggatccctctacttcctcccctcctcactctctgcacaggctctgaggcctcctatgagctgacacacgccaccccgtggtntcagtcgtaccccaggacagacggccaggatcacctgctctggagatgacagttcgacccaaaacaatatacgtacttattggtaccagcaagaacgtacgacggtaccacggtcccctggtacgtattggttagaattaagttaaacgaaaagtacgtaaggtaaggaaggtaaccggtacccctacggaacgggtacctcccggttaggacgtaccggtaacttccgtcgtacgggtccgtacctacggtcccgtacggaacgggtaactaaacgttaacgtaccctaaccgtttacgaacctacgtaccgtaggtagggtacgttaccgaaggaccgaagggaacggtacggaacggtcgttaacgaactttacgtttacgaccggtttaacaaacggttcgaacggtacccggaactaacccgtaacgtaccgtaataggttacttgggtttacgggtttaccgggaccggggtaaacgaaccggtaagtccgttacggtacccggttacccggtacgtaaccggtaccggacccgtaaccgg

SEQ ID NO: 119753 - DNA, 641 bp, Homo sapiens
  misc_feature: GYAE6OF02F39IG.25.48.E04.1.454.CMB.1.raw
  modified_base (288)..(288): a, c, t, g, unknown or other
  misc_feature (288)..(288): n is a, c, g, or t
tcagactgtacagtcacgaccggtgctcgatttagagagcgtcacagagagaagggggagaagtagagggatccagaactctgggtgtctcaccatggcctggatccctctacttctccccctcctcactctctgcacaggctctgaggcctcctatgagctgacacagccaccctcggtgtcagtcgtccccaggacagacggccaggatccacctgctcgtggagatgctattgaccaaaaccatatgcttattggtaccagcagagtcaggtcacggccctgtgntgtgatatataaagacagtagagacggcctcgaggactcctagacgcgtacttcgtacgtgctccgagtctacgacgggtactaactcgtacctacgttacgaacctagtcgtaggtagggacgttaccgaacggtacgaaggagggaacggtacggtacgtacgtacgtttaactttcgtacggtactaacgtacgaacggtaccggaaccaaccgttaccgtacgttaaccgaacgttagttaggtttcgggttttccggggtacgggtaaccggggtaaccgtacggtacccgttaccggttaacccggtttcccggtaccgggtacccgtaccggacccgtaacccggg

SEQ ID NO: 119754 - DNA, 619 bp, Homo sapiens
  misc_feature: GYAE6OF02IAA9K.25.48.E04.1.454.CMB.1.raw
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (395)..(395): a, c, t, g, unknown or other
  misc_feature (395)..(395): n is a, c, g, or t
tcagactgtacagtcacgaccggtgctcgatttagagagcgtcacagagagaagggggagaagtagagggatccagaactctgggtgtctcaccatggcctggatccctctacttcctccccctcctcactctctgcacaggctctgaggcctcctatgagctgacacagccaccctcggtgtcagtcgtccccaggacaggacggccaggactcacctgctcgtggagatgcatcgaccaaaactatatgtcttatggacagcaagatcagtcacgcctgtnatgtanattatataaagcgagtagagacgtccctgacggtctccaggatcgtacttctcgtgcctccgagtcctacggaaggactaagttacgtacctaccgttacgaaccntacggttacggtaggtaccgtacgacggacgaagggtaccggaggacgtacgtacgtaacgtttactttcgtacgttaactacgtacgtacgaccggtaacctaaccgtaccgtaacgtaacctattacggttcggttacgggtttcgggaccgggtaacggtaacgtaacgtcggttaacggtacccggttccggtcggtaccggaccgtacccggtaaccgg

SEQ ID NO: 119755 - DNA, 774 bp, Homo sapiens
  misc_feature: GYAE6OF02IFCS7.25.48.E04.1.454.CMB.1.raw
  modified_base (241)..(241): a, c, t, g, unknown or other
  misc_feature (241)..(241): n is a, c, g, or t
tcagactgtacagtcacgaccggtgctcgatttagagagcgtcacagagagaagggggagaagtagagggatccagaactctgggtgtctcaccatggcctggactccctctacttcctcccccctctcactctcgtgcacgaggctctagacggcctcctatgagctagacacacgccctaccgtcggtgtcaggttcgtccccgaggacaggaccggccaggactcgacctggccttgnggacgtatgactattcgacccaaaactatactgtactttagttacggtacagacagtaagtcgaaggtcacggtcccgtgtagtgttcgttagaacttagtaaacgtaaggtaacgtagttacgggacggtaccggtaccccgtaggaacggggtaccttacccggtaggtacggacccgttagtttccccgtacggttacggaccctcgtaacgtacccgtaggaacccgggtaaatacgttacgtacccgttacctaaccggaaccttaggtacgtaagggttacggaccgtaccgggaacggtgtaaaccgggaacggaccggagggaaccgtttagtaacctttagtttccgtaacgttataaccgtacgaaccggtcggtaaaccctaccggtaaacttccggtaaatacgtttacggtttcgggttttcgggttaacggggaccgggtaacgggtaaaccctacgtaccggttacccggaccggtttacccggtaccggttaccggcccggtaacccgtacccgggg

SEQ ID NO: 119756 - DNA, 715 bp, Homo sapiens
  misc_feature: GYAE6OF02IPM2S.25.48.E04.1.454.CMB.1.raw
  modified_base (378)..(378): a, c, t, g, unknown or other
  misc_feature (378)..(378): n is a, c, g, or t
  modified_base (518)..(518): a, c, t, g, unknown or other
  misc_feature (518)..(518): n is a, c, g, or t
  modified_base (529)..(529): a, c, t, g, unknown or other
  misc_feature (529)..(529): n is a, c, g, or t
  modified_base (662)..(662): a, c, t, g, unknown or other
  misc_feature (662)..(662): n is a, c, g, or t
tcagactgtacagtcacgaccggtgctcgatttagagagcgtcacagagagaaggggggagaagtagagggatccagaactctgggtgtctcaccatggcctggatccctctacttcctcccccctcctcactctctgcacaggtctcgtgacggccttcctatgagctagacacacgccctacccgtcggttgtcacggtcgtccccgagaccgacgaccggacgtaggactaccaacctcggtacctcgtagggaactagtacgtactattaccgaacccaaaacctaattagttacgtactttagttacgggtaaccaggtcaagtaaggtacgacgggtacctaccgggtcccttaggtagtcgtttaggttanaacgtttaaactaaagttaaacgacgtaggtacgacgggaccgtacccgtaggaccggtatcccgtagtacggtcttcgttactcggtacggtcctcagtaccgtaacggacgggtaataacgtcctaccgtacttaacnccgattacggnggtacggaccgtcgaaggacgaacggaggtacggagttcgtattacgtacgtttatacgttacgtacgacgtaaccgtaccgtaacctcggactttaacgtatacggttagttcgggtttgggtaacccgggnggtaaccggtcaacggttccgaccgttccggtgaaccggtcaccgacgtacgg

SEQ ID NO: 119757 - DNA, 709 bp, Homo sapiens
  misc_feature: GYAE6OF02JZ53K.25.48.E04.1.454.CMB.1.raw
  modified_base (138)..(138): a, c, t, g, unknown or other
  misc_feature (138)..(138): n is a, c, g, or t
  modified_base (158)..(158): a, c, t, g, unknown or other
  misc_feature (158)..(158): n is a, c, g, or t
  modified_base (203)..(203): a, c, t, g, unknown or other
  misc_feature (203)..(203): n is a, c, g, or t
tcagactgtacagtcacgaccggtgctcgatttagagagcgtcacagagagaaggggagaagtagagggatccagaactctgggtgtctcaccatggcctggatccctctacttctcccctcctcactctctgcacgngctctgaggcctcgtatganctgacacagtccacctggtgtcagtcgtcccaggacagcgccagntcactgctctggacatgactagttacgacccaaaacgtattacgtcgtaacgtttacgttacggttaccgaagacaaggtaacgttacgacgggttaccaaccggtccctttaggacggaagtttggttagtaaccgttaacgttaaagtaaaacggacgtaccggttaaggacggtaccggtaccgtaacggaagggtaccttacccggaagggaccgttcggtaacttaccgttcggtacgttccaacgtaacgttcaacgggtaacggtaacaacgttacggtacctacggttaaccacgtatacgacggttagtacgtacgagacttagggaacgacgaagccgtaacgattactttacgacgttaacgtacgtacggaacgttacgaaccgtaaccctaccggtaataaccgtaacgtgtttacgggtttacggttcggaaacggtttcggaactcggtaaccgtcggaaccctcttacgggaccgtaccctaccgggacc

SEQ ID NO: 119758 - DNA, 814 bp, Homo sapiens
  misc_feature: GYAE6OF02JO7CN.25.48.E04.1.454.CMB.1.raw
  modified_base (227)..(227): a, c, t, g, unknown or other
  misc_feature (227)..(227): n is a, c, g, or t
tcagactgtacagtcacgaccggtgctcgatttagagagcgtcacagagagaagggggagaagtagagggatccagaactctgggtgtctcaccatggcctggatccctctacttcctccccctcctcactctctgcacagctctgaggcctcctatgagctgacacacgccacccgtcggtgtcagtcgtccccaggacagacggccaggatcacctgctctgganatcgactattcgaccaaaaccatatcgtacttagttacggtaaccagcaagtaacgtcgaggtaccgacggaccccgttggacgtaacgttggttacgaagttagtaaacgtaaacggtactaaggttaggaacggtacggtaccccgtacggaaggggtaccttcccgtaggacgtacggtactttaccttcgtcgggtacctaccctaacgtcccgttacggaacgggtaacctaacgttacggtaccccttaaccgttaccgaacccgttaacgtaccgtaacgggtacgggttaacgggtaccgtaaaccgggacggtaacgggaacgggtaaccggtaacgggtccgttaaggtaacccgtttagttccgttaacggttacctaaggtaccgtaacgggtacccggaaccttaacccgtacggtaaccgttagttaaccgtttaggttcgggtttacccgggttttaaccgggggtacgggtaacggggtaaccccgttaacgggtaaccggtaacccggttcccgggtttaaccccggttccggggttaacccgtacccggttaacccccgggtaaccggg

SEQ ID NO: 119759 - DNA, 906 bp, Homo sapiens
  misc_feature: GYAE6OF02HV6S3.25.48.E04.1.454.CMB.1.raw
  modified_base (138)..(138): a, c, t, g, unknown or other
  misc_feature (138)..(138): n is a, c, g, or t
  modified_base (234)..(234): a, c, t, g, unknown or other
  misc_feature (234)..(234): n is a, c, g, or t
  modified_base (390)..(390): a, c, t, g, unknown or other
  misc_feature (390)..(390): n is a, c, g, or t
tcagactgtacagtcacgaccggtgctcgatttagagagcgtcacagagagaagggggagaagtagagggatccagaactctgggtgtctcaccatggcctggatccctctacttcctccccctcctcactctctgcncaggctctgaggcctctatgagctagacacacgcccaccgtcggtgtcaggtcgtccccaggacgaggaccggccaggtactaccacctcgctcgnggagagtcgactagttcgaacccaaaaccgtaattacttcggtactttaaggttacggtaacccgtacggtaccgtaagtaaacggttccgtaacgggttacgacccggtccccttaggtacgtaacggtttgttacgtaacgttaagtttaaaanaaaacgggtaacgtaaggttacggaacggtaaccgggtccccgttacggaacggggtaccttcccggtaggacgtacggttactttaccgtccggttcgggtaccctcggtaaccgttccgtaaccggggaaacgggtaaaaccgtttaaacgtttacggttacccgttaaacccggtttaaccggtacccttaaccgttacggtaacgggttacgggtaaaccgggtacccgggaacgggtacggaaacgggtaacggggtaacgggtaaccgggttcgtaaccggtttaactttacggttttacccgtttaaccggttactaaacgtacccggtaaacgggtaacccgggaaccgtaacccgtaaacgtaccgttaaccgttaagtttacggttacgggtttttacggggtttaccgggtaaccgggtacgggtaaccggttaaaccggtcgttacccgggtcccggtacccggtaacccgggtcccgttacccggtaccccggtaacccgggg

SEQ ID NO: 119760 - DNA, 779 bp, Homo sapiens
  misc_feature: GYAE6OF02JE54U.25.48.E04.1.454.CMB.1.raw
  modified_base (234)..(234): a, c, t, g, unknown or other
  misc_feature (234)..(234): n is a, c, g, or t
tcagactgtacagtcacgaccggtgctcgatttagagagcgtcacagagagaagggggagaagtagagggatccagaactctgggtgtctcaccatggcctggatccctctacttcctccccctctcactctctgcacaggctctgaggcctcctatgagctgacacacgccaccctcggtgtcaggtcgtccccaaggacagaccggccaggatccacctgccttcgtcgganatgactagttcgacccaaaactaatacgtgtactttacgttacggtacctagacgtaagtaagtacggtacggtaccgaacggtccccgttaggtacgtacgttaggttacgtaagttaaacgttaaagttaaaaacggccgttaaggtacggtaaacgggtaaccgggttacccgtaacggtaaaccggggtaccgttaccccggttaagacgggttaacgttaaccgtttcgttccggtaccggtccgtacccgtaacgaccgtacggtaacggtaactaacggttaccgtaacctaacccgtaccgtaaccgtaacttacggtaacggtcggtacgtaccggaacggtacgaacgggaacgggaacgtacggtaccgtaacgtacgtttcgttacgtacgtaacggtaactaccggaacgtacccgaacctacccgtaaccgttaaccggacttacgttagttacggttcgggtttacggcggtaaacgggtacaacggtccgtacgtcccgtaccgttacggaccgtacgtaacccgtcgg

SEQ ID NO: 119761 - DNA, 831 bp, Homo sapiens
  misc_feature: GYAE6OF02HQOBK.25.48.E04.1.454.CMB.1.raw
  modified_base (228)..(228): a, c, t, g, unknown or other
  misc_feature (228)..(228): n is a, c, g, or t
  modified_base (732)..(732): a, c, t, g, unknown or other
  misc_feature (732)..(732): n is a, c, g, or t
tcagactgtacagtcacgaccggtgctcgatttagagagcgtcacagagagaagggggagaagtagagggatccagaactctgggtgtctcaccatggcctggatccctctacttctcccctcctcactctctgcacaggctctgaggcctcctatgagctgacacagccaccctggtgtcagtcgtccccaggacagacggccaggactcacctgcctacgtggganctggactactttcggacccaaaaccgtaattactacggtacttttaagtttacgggtaaccgaggtaccggtaaggtaaacggttaccgtaacggggtaccgtaaccgggtaaccccccgttggttacggaaaccgtttcgggttttaggtaaacggttaaactttaaaagttaaaaaacggtaaccggtaaacgggtttaaggggaaaaccgggtaccggggtaccccccttaagggtaaacgggggtaccttaccccggtaagggtaaccggtaaccggttacgtttaacccggttacgtacggggttccctacccgtaacggttaccgttaaccgggaaacggaaaaaccgtaccgtaacggtttacccgtttaccggtttaaccggaacctttaaccgccgttaaacgggtcggggtccttaacgggaggggtacgaaaggttacgtcggaacggtcgtacgtacttaacgttcgtaacgtaccgtaccgggactaacgngtacgtacgtactacgtttggtacgtcggacgggtacggaacgacgtacgtcgaccggttacttacggcgtaccgaccgtaacgccgtaccctccccgg

SEQ ID NO: 119762 - DNA, 697 bp, Homo sapiens
  misc_feature: GYAE6OF02IRMJY.25.48.E04.1.454.CMB.1.raw
  modified_base (135)..(135): a, c, t, g, unknown or other
  misc_feature (135)..(135): n is a, c, g, or t
  modified_base (140)..(140): a, c, t, g, unknown or other
  misc_feature (140)..(140): n is a, c, g, or t
  modified_base (160)..(160): a, c, t, g, unknown or other
  misc_feature (160)..(160): n is a, c, g, or t
  modified_base (249)..(249): a, c, t, g, unknown or other
  misc_feature (249)..(249): n is a, c, g, or t
  modified_base (548)..(548): a, c, t, g, unknown or other
  misc_feature (548)..(548): n is a, c, g, or t
tcagactgtacagtcacgaccggtgctcgatttagagagcgtcacagagagaagggggagaagtagagggatccagaactctgggtgtctcaccatggcctggactccctctacttcctccccctctcactctcngcagngctcgtgacgcctctatcgngctagacacacgcctacccgtgtcgtacgagtcgaccccgaggacaggaccgaccgtaggacttccgacgtgtccgtacgtaggaagtntcgtacgtacttaccgaaaccaaaaacttaatacgttacgtaccgttttaacgttacgggtaaaccacgaaccgtaaggtaacggttaacgcggttaacgacccggtccccgttaggtagacgtttagtacgtaataagtaaacgttaagacgtaagtcgaacggtacgtccgtaagaccggtacgtccgaggacgtacgtacgtcgttcgacgtcctacgctacgcgaacggactagtacgactacgtacgacgtatccgtaaggtcgtacgacgacgacgaggacgtaacgcgtacncggtacttgtacgtattacgtacgtcgaccgtacgacgtacgtacgtaactagtacttacgtcggttacggttaacggaccggaacggtaaccgtcggtaacggccggttaccggccgttaaccggtcgtaaccggtccggtacccggg

SEQ ID NO: 119763 - DNA, 766 bp, Homo sapiens
  misc_feature: GYAE6OF02IK6CF.25.48.E04.1.454.CMB.1.raw
  modified_base (541)..(541): a, c, t, g, unknown or other
  misc_feature (541)..(541): n is a, c, g, or t
tcagactgtacagtcacgaccggtgctcgatttagagagcgtcacagagagaagggggagaagtagagggatccagaactctgggtgtctcaccatggcctggatccctctacctttcctccccctcctcactctctgcacaggctcgtggacggtccttctatgacgctagacacgacgccctacccgttcgggtcgttacacggttcgtacccccgaggaacacggacgggaccctagggactccaccgtcgtccgttacggtaggacgtattcggacttacggttcaaacccaaaaccgtaattagtcgtactttagttacggtaaccagtacaagacgttcgaacggtccaccggtcccgtgttacgagttgttagattaagtaaagtaaacgacgtagtaggacggtacgacccgtaggacggtacctccgttaggaccgtagtacctttcgtacgtcggtaacctcgagtaccgttacgacggtaaatacgtacgtctacctacgactctacgtcggtagtaccgtagaaccggngtaaagggaccggtacggacggtacgtttaacgttccgtttactttaccgttgtaaccgttaacgtcgtaaccggacggaacccttacccgtacgttacctaagttacgtttaggttacgggtttacgggtttaccgggaccgggtaccggaacccggtacgtacccgtttaccgggaaccccgggtttccggtaccggaccgtacccgggtacgtaaccccggg

SEQ ID NO: 119764 - DNA, 647 bp, Homo sapiens
  misc_feature: GYAE6OF02GBL4M.25.48.E04.1.454.CMB.1.raw
  modified_base (181)..(181): a, c, t, g, unknown or other
  misc_feature (181)..(181): n is a, c, g, or t
tcagactgtacagtcacgaccggtgctcgatttagagagcgtcacagagagaagggggagaagtagagggatccagaactctgggtgtctcaccatggcctggatccctctacttctccccctctcactctctgcacaggctctgaggcctcctatgagactgacacagcccacccttggntcagtcgtccccaggacagaccggccaaggatccacgtgctcgtggagatcgctattcgacccaaacctaatatgtacttagttacgacgacgagaagtacgtacgtacggtcgaccggtcccgttgtagtagttgtagtataagtaagtaagagagtagacgtacgtccgtacgacgtcgtacgagagtacgtactcgtcgtcgtctacgacgtcgtacggacgtacgtaagtcgtaccgtacgtacgtacgtagtacgtagtacgacgtaccgaggtacgacggtacgacggacgtacgtacgttacgtttacgttcgtactacgtacgacgaccgtaccgtacctaccgtactacgtaacttacgttcggtttacggttccgggttacggaccggtacggtaaccgtcggtaccgtaccggtacccggtccggtacccgtaccgtacccggtacccgtaccgg

SEQ ID NO: 119765 - DNA, 550 bp, Homo sapiens
  misc_feature: GYAE6OF01BR0ZX.16.2.A02.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
  modified_base (361)..(361): a, c, t, g, unknown or other
  misc_feature (361)..(361): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaagngccaccctctcctgcagggccagtcagagtgttagcagcttcttagcctggtaccagcagagacctggccaggctccagactcctcatctatgatgcatccaacgnggccacgtggcactccagccaggttcagtggcagtgggtctgggacagacttcactcncaccatcagcacgcctagacgcctagaacgtacttctagacttaatttattactgtacagtacagtaagtaacgaacgtcgaccctaccgtcctactacgttcgggacgggaacgggtacgaagggttcggaacgtacgtacggaacggtacgtggtcggtacgtcgtaccacgtatcttgtccttacg

SEQ ID NO: 119766 - DNA, 506 bp, Homo sapiens
  misc_feature: GYAE6OF01AIU9V.16.2.A02.1.454.CMB.1.raw
  modified_base (196)..(196): a, c, t, g, unknown or other
  misc_feature (196)..(196): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaangccaccctctcctgcagggccagtcagagtgttagcagcttcttagcctggtaccagcagagacctggccaggctcccagacctcctcatctatgatgcatccaacagggccactggcatcccagccaggttcagtggcaggtgggtctgggacagacttcactctcaccatcagcagcctagacgcctgaagtattctgactaatttacttactgtcagcagacgtaacactggcctcgctctacgttcggacggaggaccgaggtgagacgtcggaacgacgtgtcggctgcaccatctgttcttacg

SEQ ID NO: 119767 - DNA, 611 bp, Homo sapiens
  misc_feature: GYAE6OF01C2K63.16.2.A02.1.454.CMB.1.raw
tcagtgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctgggggtccctgagactctcctgtgcagcctctgaattcatcttcagtatctataacatgaactggtccgccagactccgaagggagggcgtggaggtgggtcgcgatccattagtggtagtaataattacatatacacgagactcaatgaaggccgcttcaccatctaccagacgaacaacgaccgaaaactcatagtatctgacagatagaacagaccgtgaacgacgaaccggaaagaccgaacgggtcttacggtagttaacgttaccgtaggtacggaccgtaaggtacggtttaccttttaacgttaaggtttaacgggtttacgggggtaaagttttaaacgttaaacgttaaaccgggtaacgtttaagttttcggtaaacg

SEQ ID NO: 119768 - DNA, 863 bp, Homo sapiens
  misc_feature: GYAE6OF01E0IZU.16.2.A02.1.454.CMB.1.raw
  modified_base (207)..(207): a, c, t, g, unknown or other
  misc_feature (207)..(207): n is a, c, g, or t
tcagtgtactactccacgaccggtgctcgatttagactcatctacagggggaggaacgtgctcagttaggacccagagggaaccagtggaagccccagctcagcttctcttcctcctgctactctggcctcccagataccgaccggagaaattggtgttgacacagttcctccagccaccctgttctttgtccgtacccggggaaancgccaccctcgtccgtgcgaggggccagtcaggtagttgttagctacgtctttactacgccttcggtaccagccagacgtaccgtcggaccctacggtcccttacccgaaggtacccttcctacacttacctaagttcggacttcggacctaccgtacccgaaaccggcggggacccctaggtaccggacctaccgtccccggaagggtacccgtagggttacgaagggttcggaccgttaggggttcgggtacggttagggaactacggttacccttacaccgtttaccacctaaccgtacttaccgaaccggtaccgtaacggtacccgttaaggaccgtaccgttaagtaaccgtttaacgttaccgtaacgttaacctttaaacgtttttaacgtaaccgttacggtaaccgtacggtaacgtaacggttaaccgttaaacccggtaccggttaacccggtaccccgtttacccgggtacctttacccgggtttaccgggtttaacccgggggaaccggggttaaaccgggtaaccgggtaacgggggtacgggaaacgttaccgggtaaaccggttaaacgttacgggtttacggacggtaccgtacggtaacccgtacgttaacggttcgtttccgttcccgtttacccg

SEQ ID NO: 119769 - DNA, 763 bp, Homo sapiens
  misc_feature: GYAE6OF01B4A72.16.2.A02.1.454.CMB.1.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgcgtcccggggaaancgcccaccctctcctgcagggccagtcaggagtgttagcagtcttctagcctggaccagcagacgacctggccaggctccagacctccncatctatgattgacacgtacccaaacgacgggccctaacgtcgggactaaccgtacccccgaggtaccctagggtttccgaagggttcggggacctagggtcgggggttcctaggggaacctacggtaaccttcctaacctcctaccgaaccctaagttcccgaaggccgtaacgtaccgttaacggacgtacccgttaggtaaacgttactttacggtaacggtaacctttaaagtttttaaccgtttacttacggttaccgaacgtaaccgtaaggaaaccgttaaaccgaaccgttaaccgggttcccctacccggtaccttaccggttaaccggttttcccggggaaccgggtaacggggtaaacccgtaaaggggtcgggtaaacgtaaccggtaaccgggtaaaaccggtacgttcgggtaccggtaccgttaccggtaccaaccgttattcccggttagttccctttaacg

SEQ ID NO: 119770 - DNA, 565 bp, Homo sapiens
  misc_feature: GYAE6OF01A11LP.16.2.A02.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaatttgtgttgacacagtctccagccaccctgtctttgctcccgggggaaangccaccctctcctgcagggccagtcagagtgttacgcagcttcttagcctggtaccaggcagagacctggccaggctcccagacctcctnatctatgatgcatccaangggccactggcatcccagccaggttcagtgctagtgggtctgggacacgacttcactctacgaccatcagcagtccctagacgcctagaacgtattcgtgactaattttactactgtacagtcctaaggaacgtaacaacctcggacccttaccgcttcctaacgtttcgggacggtacgggaccctaagggtcggaagtacgtaccggaacgtaacgttggtcgggacttcggaccacgtattacctggttccttaccg

SEQ ID NO: 119771 - DNA, 532 bp, Homo sapiens
  misc_feature: GYAE6OF01B8VCW.16.2.A02.1.454.CMB.1.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccacggagaaattgtgttgacacagtctccagccaccctgtctttgtctacccggggaaangcccaccctctcctgcagggccagtcagagtgttagcagtcttcttagcctggtaccagcagagacctggccaggcctccagacctcctcatctatgatgcatccaacnggccagtggcatcccagccaggttcagtggcaggtggtctgggacagtacttcactctaccacatcaagcacgcctagacgccgtagaagtacttctagtacttaattttacttactgtacagacaagaataacacgtcgccctccgtctactacgttcggacggaggaccgaggtggagacgtacgaacgtacgtgtacggctcgaccactatcgtgttcttaccg

SEQ ID NO: 119772 - DNA, 771 bp, Homo sapiens
  misc_feature: GYAE6OF01B7KZD.16.2.A02.1.454.CMB.1.raw
  modified_base (195)..(195): a, c, t, g, unknown or other
  misc_feature (195)..(195): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccacggagaaattgtgttgacacagtctccagccacctgtctttgtctacccggggaaanagcccaccctctcctgcaggccagtcagagtgttagcagcttctagcctggtaccagcagacgactggccaggcctcccagacctcctcatctatgatgacactaccaaacgacgggtcccaacgtcggacaacgtccccgaaggtcccgtaagggtttccagggttcggaccgtaaggggttcgggggtacctagggggtacctaacgggtaaccctttcgaaacctttccgtaacctaacccaacgttccgaacggtacccaaccggtaccctaacgggtaacgacccgttaagggaaacgtactttacgtacggtaactttaaacgttttaacgtttaacgttacggttaccaacgggtacgtaaacggtaaacgtaaactaaccggttaccgggtccccgttaacccgtccgttaacccgttaccggttttaccggggaccggggtaaacgggtaaccggtaacgggttaagggaaaccggtaacgtaacccgggtaaaggtaaacgttcgggtggtaacccgtcggtaaccctaacccggttaagttccgttaccgttcccgtttaacccg

SEQ ID NO: 119773 - DNA, 660 bp, Homo sapiens
  misc_feature: GYAE6OF01C4RGP.16.2.A02.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (299)..(299): a, c, t, g, unknown or other
  misc_feature (299)..(299): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccacctgtctttgtcctacccggggaaancgccacctctcctgcagggccagtcagngtgttagcagcttctagcctggtaccagcagacgacctggccaggcctcccagcctctcatctatgatgactancccaaagcgggccacgtggccactccccgagcccgtaggttcaggtcggctagggtcgggtacgaggggaccaggtaccttcaaccgtcctaccaaccgtactccgagccgacgtcccgtaagaccgtccgtaagaagtacttcacggttacttaaacgttttacttacgtgtaccgtaagtaccgaagtaacgttaacgtaaccgttccgggtacccttccggtacgttccgtaaccggtttccgggaccgggtaacgggtacgtaacggggtacggtaaacggtaacgttaaccgggaaactaacgggttgggtacggaccgttacgaccctaccgtactttccgttcgtcctttaccg

SEQ ID NO: 119774 - DNA, 840 bp, Homo sapiens
  misc_feature: GYAE6OF01CC67C.16.2.A02.1.454.CMB.1.raw
tcagtgtactactccacgaccggtgctcgatttagactcatctacagggggaggaactgctcagttaggacccagagggaaccatggaagccccagctcagcttctcttcctcctgctactctggctccagataccacggagaaattgtgttgacacagtctccagccaccctgtctttgtccgtacccggggaaagacgcccaccctctcctgcgacgggccagtcagtagtgttagcagtctttctagcctggtaccagcagacgacctggaccaggcctacccagtacctcctcattctaatgatgctaactacccgaacgacgggtcccaacgtcggacctaacgttccccgaaggtcccgtagggttcaagggtcggtaccgtagggttcggggtcgtaggggaacctaaggttaccttccacctttaccctaccgaaaccctagttacccgaacggtacccgaacggttacccgtaaggtacccggtacccgttaacggtaaaccggtttacttaccgttaacggttaaaccttttaacgtttttaacgtttaccgttacgtaacgtaacggtacgtaaacggtaaaccgttaaaccgtaccggttacccggttaccccgttacccggtacgtttaaccccgggttaccgggttttacccgggggaaccggggtaaaccggggttaaacccgggtaagggggttacccgggtaaaacggttaacggttaaccccggggtaaaacggttaccggttccggggtaacggttacccggttaaccggtaacccgttaaccccgttaggtttacccgtttacgtttcccgtttaacccg

SEQ ID NO: 119775 - DNA, 557 bp, Homo sapiens
  misc_feature: GYAE6OF01DWI60.16.2.A02.1.454.CMB.1.raw
tcagtgtactactccacgaccggtgctcgatttagactcatctacaggggggaggaactgctcagttaggacccagagggaaccatggaagccccagctcagcttctcttcctcctgctactctggctcccagataccaccggagaaattgtgttgacacagtctccagccaccctgttctttgtctcccgggggaaagagcccaccctctcctgcagggccagtcagagtgttagcagtcttctagcctggtaccagcagagacctggccaggcctcccagacctcctcatctatgatgcatccaagagggccacgtgacactcccagcctaggttcagtggctaggtgggtcgtgggacagtactcactctcactatcagcacgacctagacgcctagaagtattctagtacttaatttattacgtgtacagacagacgtaacaacgtcggcctccgtctacgtacgttcgggacggtacgggaccgtaaggtcggagtacgtacggaaacgtacggtggtacggcgtcgacctacgtattcgtcgtcgttaccg

SEQ ID NO: 119776 - DNA, 662 bp, Homo sapiens
  misc_feature: GYAE6OF01BEKSR.16.2.A02.1.454.CMB.1.raw
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagcccaccctgtctttgtcctcccggggaaagagcccaccctctcctgcgagggccagtcagagtgttagcagtcttcttagcctggtaccagcagacgacctggccaggcctcccagtacctcctcattccgtatcgatcgccatacccaaacgtacgggcccacgtacggacctaactccccgaagtcccgtacgggtttcacggtggcgtagggttcggggtctaggggactaggtacctttccgacttcctacaaccctagtcacggaccacgtacctaaggacgtaccgtagtaaacgtacgtttctacgtaacttaagttttacgttacgtcgtacacgacgagaacgtaacgtaacgtaccggtcctccgtactccgttacgtttcgggaccgggtacggaacggtaacgggtacggagtaacggtaccgtaaacggaacggttggtaccggtcgacgtacccaacctacgttactcgttccgttaccg

SEQ ID NO: 119777 - DNA, 521 bp, Homo sapiens
  misc_feature: GYAE6OF01D0HCL.16.2.A02.1.454.CMB.1.raw
  modified_base (196)..(196): a, c, t, g, unknown or other
  misc_feature (196)..(196): n is a, c, g, or t
  modified_base (505)..(505): a, c, t, g, unknown or other
  misc_feature (505)..(505): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaanacgccaccctctcctgcagggccagtcagagtgttagcagcttcttagcctggtaccagcagagacctggccaggctcccagacctcctcatctatgatgcatccaaacacgggccacgtggcacgtccccacgccaggtttcaggtggctaggtcgggtctgggacagacttcacgtctcaccatcagtcagcctagacgcctagaagtattctgactaatttactactgtacagcagacgtaacacgtgccctcgctctacgttcggcggaacggcgtaaggtcgagagtacgaagacgtggtacgncgcacatctgtctacg

SEQ ID NO: 119778 - DNA, 738 bp, Homo sapiens
  misc_feature: GYAE6OF01DKXQN.16.2.A02.1.454.CMB.1.raw
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
tcagtgtactactccacgaccggtgctcgatttagactcatctacagggggagaactgctcagttaggacccagagggaaccatggaagcccagctcagcttctcttcctcctgctactctggctcccagataccaccggagaattgtgttgacacagtctccagcctacctgtctttgcgtccggggaaagacgcctacctcttctgcgagggccagtcagagtgttagctagtcttctagcctggtacagcagacgacctggaccaggactcccagacctcctnactactatgatgctaacnccgaaacgcgggaccacgttcggacctacgtccccaaggtcccgacggtttcgaaggtcggacgtagggttcggggtacggtacggggtactaaccggttaccttacgtaacccttcccgtaccctaaacccgtaacgtaccgaacggtaccgtaacgtaccccgtaaggtaacccgtaccgtaaagggtaactttagttaccgttacgtaacctttaattttaacgtttacgtaccgtacgtaacggacgtaagtaaacggtaaaccgtaacgtccggtacccttcccgtcgttaccggttaacgtttccgggggacggtaaccggggaaaccgttaggggtgggaaacgtaaccgggttaacggaaacccgggtacggttcggaccgggttcctaacgggtcccaaccgttacttccgttcgttccttaccg

SEQ ID NO: 119779 - DNA, 573 bp, Homo sapiens
  misc_feature: GYAE6OF01BSOUC.16.2.A02.1.454.CMB.1.raw
  modified_base (197)..(197): a, c, t, g, unknown or other
  misc_feature (197)..(197): n is a, c, g, or t
  modified_base (308)..(308): a, c, t, g, unknown or other
  misc_feature (308)..(308): n is a, c, g, or t
  modified_base (547)..(547): a, c, t, g, unknown or other
  misc_feature (547)..(547): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaatttgtgttgacacagtctccagccaccctgtctttgtctcccggggaaancgccaccctctcctgcagggccagtcagagtgttagcagtcttctagcctggtaccagcagacgacctggccaggcctcccagacctcctcatctatgatgcatccaacgngggccactggcactcccagcctaggttcagtggctaggtgggtctgggacagtacttcactctacaccatcacgcgacgtacctagacgtccgtagaagtattctagtaccttaatttattaccgttgtacagctaacggagtaaacacgttcggcccgttccgtaccgttcttaccgtttcgggacgggaacgggtaccgtaagggtgggagacgtacggaacgacgtggtcggtacncggaccactacttctcgttcttaccg

SEQ ID NO: 119780 - DNA, 721 bp, Homo sapiens
  misc_feature: GYAE6OF01EBSUO.16.2.A02.1.454.CMB.1.raw
  modified_base (205)..(205): a, c, t, g, unknown or other
  misc_feature (205)..(205): n is a, c, g, or t
tcagtgtactactccacgaccggtgctcgatttagactcatctacaggggggaggaactgctcagttaggacccagagggaaccatggaagccccagctcagcttctcttcctcctgctactctggctcccagatacccaccggagaaatttgtgttgacacagtcctccagcccaccctgttctttgtccgtacccggggaaancgcccaccctctcctgcagggccagtcagagtgttagcagtcttcttacgcctggtaccagcagagacctggccaggcctcccagtacctcctcactctatgatgacactaccaaccggagggcccacgtcggccacgtccccagcccgtaggttcaggtcggctagggtgggtcgtacggggactaggtacctttccaacgttcctacccgaaccctagttacccgaggtaaccgaccgtaccgtaacggaccgttaccgtaggtaaacgttactttaccgttacgtaacctttaattttacgtttaacttcgtacgtagaaccgttaagtaaccgtaaacgtacggtaccggtcccgtacccgtaccttaccggttaccggtttacccggggacgggtaaccggggtaaccggaaggggtacggtaaacggtaacggtaccgggtaaaccggtaacggtcggtacgggtccgtaaccggtaccgtacctagtttccgttcgtttcccttaccgg

SEQ ID NO: 119781 - DNA, 734 bp, Homo sapiens
  misc_feature: GYAE6OF01DJFEL.16.2.A02.1.454.CMB.1.raw
  modified_base (201)..(201): a, c, t, g, unknown or other
  misc_feature (201)..(201): n is a, c, g, or t
  modified_base (692)..(692): a, c, t, g, unknown or other
  misc_feature (692)..(692): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccacggagaattgtgttgacacagtctccagccctaccctgttctttcgtccgtacccggggaaanacgcccaccgtctccgtgccgacgggccagtcgagagtgttagctagtctttactacgccgtggtaccagcgagacgtaccgtcggacctaacgggccctacccgacgtaccctcctacgtattaccgtatcggtactgacctaccgtaccgaaacggcgggaccctaggtcgctacctcccgagtccgtagttcgaacggtcggaccgtagggtcgggttcgtaggaaccgtacgttacctccgtaactcccgtaccgaacctacgtcggaacctcgaaccggtactacggaccgtacgtaaggtaacttcttcgacttaactttaatttcgtacgtcgtagacgtaagtaacgtaacgtaaacgtccgtaccgggtaccctccgtacgttaccggttacggtaccggggaccgggtaaccggtaacggtaacgggtacgggtaaactaccgggtaaaccggtaaccgggttacggttcgggaacccgtntacccggtacctacggtaccgtttctccgttccttaccccgg

SEQ ID NO: 119782 - DNA, 767 bp, Homo sapiens
  misc_feature: GYAE6OF01BKJW3.16.2.A02.1.454.CMB.1.raw
tcagtgtactactccacgaccggtgctcgatttagactcatctacgagggggaggaactgctcagttaggacccagagggaaccatggaagccccagctcagcttctcttcctctgctactctgctccagactaccacggagaattgtgttgacacagtcctaccgacgccctacccttgttctttcggtccgtacccggggaaagaccgccctaccctctcctgcgacggcagtcagtagttgtagctagtcttcgtacgccgttaggtaccagacgacggtacgacccgtcggaccgtacggccctacccgagtaccttcctacaacttccgtatgtacgtcactacgtaccgaacggccggaccacgtcggacctaccgtacccgacggtccgtaggttacgacgggtcggacggtagggtacgggtacggtacggaactacgtaccgtcaccgttccacctactacgtacgacgtccgtagtacccgtaagaccgtcgtaaggtaacgttacttacggtattaactttaacgttttacgtacgtaccgtaacggaacgtaacgtaaaggtaaccgttaaccgtaccggtcccgtaccccgttaccgtaccgttaaccgggttacggggttacccgggaagggtaaccgggtaaacggtacgggttacggaaaaccggtacggtaaacccgggtaagcgggttcggttaacccggccgttaacgtaccccggactttagggttcccttaagtttcccgttaccg

SEQ ID NO: 119783 - DNA, 762 bp, Homo sapiens
  misc_feature: GYAE6OF01D70TM.16.2.A02.1.454.CMB.1.raw
  modified_base (261)..(261): a, c, t, g, unknown or other
  misc_feature (261)..(261): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaattgtgttgacacagtctccagccaccctgtcctttgtccgtacccggggaaagcgccaccctcgtcctgcacgggccagtcagagtgttagctagtcttcttagccgtggtaccngcagacgacctcggccaggtcctacccgagtaccctcctctagtccttagtggactcggacctacgttacccgaaaccggacggggccctaacggtcggtaccaccgttccccaacggtcccggttacgggttacacgggtggtaccgtaggggttacggggttcgtacggggaacctaacggtaccctttccgaaccttcccgtaccgaaccctacgttaccgacggtcctaaccgaccgttaaggccgtaccgtaggtaaacttgtttacccgtagtaacctttaagtttttaaccgttctacggttacgacgtaccaaggttaaccgtaaacgtaacgtccgggtaccctccgtccttaccgttaccgggttacgggaccggggtaacggaaccgtaaggggtcgaacggtaccgttaaacggaacgggttaaccgttggacccgggtaccgttacggtacccaaccggttacgtttccgttacgttccccgtttacg

SEQ ID NO: 119784 - DNA, 810 bp, Homo sapiens
  misc_feature: GYAE6OF01CPQAD.16.2.A02.1.454.CMB.1.raw
  modified_base (638)..(638): a, c, t, g, unknown or other
  misc_feature (638)..(638): n is a, c, g, or t
tcagtgtactactccacgaccggtgctcgatttagactcatctacagggggagagaggagccttagccctggattccaaggcctatccacttggtgatcagcactggaccaccgaggattcaccagtggagcgtggggcctccgtcgttgggttttcctggttgcttagttttaggaaggttgtccgagagtgaggtgcgagtcgtggggtgggtagggtttcgggggaggtccgtggtacaacggtccgggtcggggggtccctggaacggtcccgttctaccgttgcggcacggtccctagtagtaacttcagtttactcgtagtactactaagtaactacgtacggtaacgtcgggtaccgaccgtacgaaccgtaccggaggggtaacgggtcgtagggtacggttagggccgtacgttaactacccgttaaggttacggttagggttaaaggttaaaaagttaacgttaaacctaaagttaaacgttaaaccggttaaacggaacgtaaacccgtaacggtaaacggtacgggtaaaccggggttcccttaccgttaaccctaacctaacgtacccgtaacccgaaggtaaaccggacctaaacccgaaccgtaaacgtccacgtagttaacnctagagtaacgatacgaactcggtagacgaacggaaccgacggtaacccgtacgacggtacgtagttacgtaccgttagtcggacgttagggacgtacggtacttaacgtagggtttcgggtaaacgggttaagtaaccgttaaggtaaaccgttactttaagtggttacgg

SEQ ID NO: 119785 - DNA, 877 bp, Homo sapiens
  misc_feature: GYAE6OF01A4FB2.16.2.A02.1.454.CMB.1.raw
tcagtgtactactccacgaccggtgctcgatttagactcatctacagggggagagaggagccttagccctggattccaaggcctatccacttggtgatcagcactgaccaccgaggattcaccatggagcgtggggctccgcttgggttttccttgttgtcttattttagaaggtgtccagagtggaggtgcagcgtgggtgggtagggtttggggggacggtccgtggtccgaacggtcccggttcgggggggtcccgtggacggtaccttccgttccgtggtcgccgacgtcccttacgtagtaacttcctaacttccttacgtaagttacttaccttaaataactagttacggtaaccgtccggggtaccccgacccgtaacgtaccccggttaaccggggaaggggggtaacgggggtccggtaggggtacgggttccggggtaccgtaccgtacgttaccgttaggtttagggtagggtttaagttaaacgttaaacttaacgtaattaacgttaacggtaaccggtaagtaccgttaacgtaacggttacgggaaccgggtaccccgttaccttacccgaacccgtactacccggtaccgaacggtaaaccgaaccccgtaaaccgtaaccccgtaaaacttcctaacgtttagtaaccttcgtaacggtactaagtaacgtaccgaaacggcgtaccgtaggaaccggtaccgaacggaaccgtaccgtacggtagtttacggttagtaacgttacgtggtacggtacggttaacggttaggttaccgtttaaggttaacgggttacggggttaacgggtttaaattaaacgttacggtaaaccggttacgtttacgttaacggtacggg

SEQ ID NO: 119786 - DNA, 741 bp, Homo sapiens
  misc_feature: GYAE6OF01EP7KE.16.2.A02.1.454.CMB.1.raw
  modified_base (197)..(197): a, c, t, g, unknown or other
  misc_feature (197)..(197): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtcctcccggggaaanacgccaccctctcctgcagggccagtcagagtgttagcagtcttcttacgccttggtaccagcagacgacctggccaggcctcccagacctcctcatctatgatgctactacccgaacgacgggcccacgtcggcctacgtccccgagccctagggttaccaggtcgggacgtagggttcgggtcgtaggggaactacggttaaccttcgaacttcccgtaccaaccgtacttaccgaacggtccaacggtaccctaaggaccgtacccgtaggtaaacgtgtttaccgtacgtaacctttaaacgtttttacgttaccgttcgtaacgtaacgtacgtaaggtaacgtaaccgtaaccgttaccgggtaccccttaccgtacctttaccggttaccggtttccggggaacccggggttaacgggtaaaccggtagggggtacggaaaccggttacggtaacccgggtaaacggttaacggtcgggtaccggtaccgtacgtacccgtaccgttacgtttcccggttaccgtttccgttacccg

SEQ ID NO: 119787 - DNA, 754 bp, Homo sapiens
  misc_feature: GYAE6OF01EAJ38.16.2.A02.1.454.CMB.1.raw
  modified_base (144)..(144): a, c, t, g, unknown or other
  misc_feature (144)..(144): n is a, c, g, or t
  modified_base (202)..(202): a, c, t, g, unknown or other
  misc_feature (202)..(202): n is a, c, g, or t
  modified_base (246)..(246): a, c, t, g, unknown or other
  misc_feature (246)..(246): n is a, c, g, or t
tcagtgtactactccacgaccggtgctcgattttagactcatctacaggggggaggaactgctcagttaggacccagagggaaccatggaagccccagctcagcttctcttcctcctgctactctggctccagataccacgganaattgtgttgacacagtcctaccagccctacctgttctttcgccgtacccggggaaancgccctaccctctaccgtgacgacggccagtacagtgttgttanctagtcttctacgtccgtagtaccagacagacgacctgggccctacggccctaccgaatccctaccgtactattcctaatcggaattcggacctaacctaaccggaaccggaccggggtaccctacggtaccggacctaccttacccgacggttacccggtaaggtttcgacggtcggggtacgtggggttccgggtacgtacggaactcggttaaccttaccgaacgttcccaacccgtactacgtacgaccgacgtaacgtacgacgtactcgtaataacgttctacgtagtactttaatttacgttactacgtagactaagtaacggttaactaaaccgtctacccggttacccctaccgttaccgtaccggtttacgtaccgggggtaccggaacggttaaaccggtgggaacggtaacggtaaccggtaccgggaacggttacggtaacgggtgaaccccacggttacctaccgttagttaacgttccgttaccgttaccccg

SEQ ID NO: 119788 - DNA, 642 bp, Homo sapiens
  misc_feature: GYAE6OF01APSJY.16.2.A02.1.454.CMB.1.raw
  modified_base (276)..(276): a, c, t, g, unknown or other
  misc_feature (276)..(276): n is a, c, g, or t
  modified_base (415)..(415): a, c, t, g, unknown or other
  misc_feature (415)..(415): n is a, c, g, or t
  modified_base (585)..(585): a, c, t, g, unknown or other
  misc_feature (585)..(585): n is a, c, g, or t
  modified_base (607)..(607): a, c, t, g, unknown or other
  misc_feature (607)..(607): n is a, c, g, or t
tcagtgtactactccacgaccggtgctcgatttagactcatctacaggggggaggaactgctcagttaggacccagagggaaccatggaagccccagctcagcttctcttcctcctgctactctggctcccagatacccaccggagaaattgtgttgacacagtctccagcccaccctgtccttttgtccgtacccggggaaagcgcccacccctctcctgcgagggccagtcagagtgttacgcagtcttatacgccgtggtaccagcaggtacncctggaccaggcctcccgagaccttcctctattctagtgagtcgacctacaccgaacgcgggacccacggtcggacctaccgtccgaacggtcccttaagggttcaaggttcggcgtagggtcgggtcgacgggtaacncggtaccttcgaacttccctacaacctgtaccacgtaccacgtacctacgacgtacgaggtaactcgtttacagtactttaatttcgtacgtagtacacgagtacggtaactaccggtaacgcgtccgtccgacttcgttaccggtggaccgaggtacagggtgtacgancgggtaacgcgtggtccgtaancccggtaactaccggttagtctcgttccgttaccg

SEQ ID NO: 119789 - DNA, 767 bp, Homo sapiens
  misc_feature: GYAE6OF01B9QPI.16.2.A02.1.454.CMB.1.raw
tcagtgtactactccacgaccggtgctcgatttagactcatctacagggggaggaactgctcagttaggacccagagggaaccatggaagccccagctcagcttctcttcctcctgctactctggctcccagataccaccggagaattgtgttgacacagtctccagcccacccttgtcctttgtccgtacccggggaaagcgcccaccctctcctgcgacgggccagtcagagtgttagcagtcttcgtacgccttggtaccagcaggacgaccgtggcccgacggcctaccccagaccttcctacacttcctaatgatcgactactacccgaacggacgggccctacgtcggacctaccgtccccgaagtcccgtacggtttcgaggtcgggcgtaggggttcgggtcgtagggaacctacggttacctttccgaccttcctaccctaaccgtactaccggaacgaccgaccggtaccgttaacggacgtaccgtaagtaaacgttacgtttacgttacgtaaactttaatttttaacgttaccgttagtacgtaacgtacgaaacggttaaaccgttaacgtaaccgttccgggtaccccttccggtaccttaccggttaccgggttttaccggggaccgggtaaccggggtaaccggtaggggtaccgggaacgttaccggtaaaccggtaaacggttacgtcgggtaccggtaccggtacgtacccgtaccgtacgtttcccgtttagttcccgtttacccg

SEQ ID NO: 119790 - DNA, 844 bp, Homo sapiens
  misc_feature: GYAE6OF01EIO8A.16.2.A02.1.454.CMB.1.raw
tcagtgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggaggtttgggggagcctggtcaagccgtggggggtccctggagactctccgtagtcgcaggccttctagaattcatcttcagtactactagtaacatacgaactgggtacccgtaccgagtaacccgtaccggaaggggaacgggggtacgtacgggtagggtacgggttaccgaccgtaacgttcccgtaagttttaacggtcggggttaagggtttaaaaactaaacgttttaaaccgaaagttaacgttaaaccgttaacgggtaagtaacccgttaccgaaaacgttaggggtaaaccgggcccggttacctttaccggtaaacccctaaagttccccgtttaaccaaccggttaaacggaacccgaaaaccggtaccccggttaaaaaacttaccgtaacccgtttaaggtaacttccgttaaggacccgttaggtaacttacgaaacgtacggacccgttaacgaggaaccggaaccgtaaagtaccgaccgggtaccttaacgggttacgtttaacgtacgttacggtaccggtagttaacgggtacggtttacgtttacgtaaacggtttagggttaacccggggttaaatttaaacgtaaacgttaaacggttaacggttaaacgttcgtttaaaccggg

SEQ ID NO: 119791 - DNA, 974 bp, Homo sapiens
  misc_feature: GYAE6OF01EZP7C.16.2.A02.1.454.CMB.1.raw
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
  modified_base (480)..(480): a, c, t, g, unknown or other
  misc_feature (480)..(480): n is a, c, g, or t
tcagtgtactactccacgaccggtgctcgatttagactcatctacagggggaggaactgctcagttaggacccagagggaaccatggaagccccagctcagcttctccttcctcctgcttactcgtcggcctcccagactacccgacggaagtaactttggtgttgaccacgtacgtcctccgacgccctacccttgttacttttcggccggtacccgggggaaanaccgtaccctacccccgttcttcccgtcggaccggacggggtacccaggttccgaagggtacggtttagggtttacnccgtaacggtttcccttttacggtttaccggtcccgtttacggggtaaacccagggtacccgtaacgggtaaccgggtaccccgttccggggaaccccgtacggggttaccccctaaccccgtaacggtacccctttccctacctaaccgtttaccgttacgacgttacggttaccncccgttaaaccctaaccggaaaccgggacccgggttacccgtaaccgggtaccggtaacccttaaccctaccccggacgggttaccggtaaccgggtttacgacgggtacgtaccggttaggggttaccgggttacgggaacggtacgggttaacttacccgtttccgacccttaccgtacccgtaactaacccttaggaccgtaccgtacgtaccgtaacggtaccttacggtaacgtaagttacttacgttactaacgttttaagttacctttacggtacttaaccgaggtaacccgaagttaacccggtaaccaccggttacccgtacccgttaccgttaccgtttaccggttcgggtaacccgggtacggggtaccggtaacggtacgggacggtacgaaccgggtttaaaccgacggtaccgggtttccaaccggggtccctaaccgttaccgttaacgttccgttaaccctttcgtaccgttaccccg

SEQ ID NO: 119792 - DNA, 825 bp, Homo sapiens
  misc_feature: GYAE6OF01CM1SD.16.2.A02.1.454.CMB.1.raw
tcagtgtactactccacgaccggtgctcgatttagactcatctacagggggaggaactgctcagttaggacccagagggaaccatggaagccccagctcagcttctcttcctctgctactctggctcccagataccacggagaattgtgttgacacagtcctccagcccacccttgttctttcggtccgtacccgggggaaagcgccctaccctctcctgccgacgggccagtcgaggtagttggttagcgtagtctttacgtacgtccgtaggtaccagcagtacgaccgtcggaccacgggtccctaccgataccctcctcgtaacttctaagtcgaagttcgaacctactaacccgaaacgggtaccgggtaccctacggtacggaccctaaccgtcccccggaacggtaccggtaacggtttcggaagggtcggggtacgtacggggttcggggtaccggtacgggaaccgtacggttaacccttccgtaaccgttccctaaccgtaacctaacgtccgaacgggtaccgtaccggtaacccgtaaggtacccggttaaccgttaaggtaaaacgtttcgtttaccgtaacggttaacttttaacgtttttaacgttaccggtaaggttaccaacggtacgtaaacggtaaaccttaacccggtaccgttacccggtaccccgttaccggtcctttaaccggttaccgggttacgggacccgggtaaacggtacggtacggggtaggaccggtaacggtaacgtaaccggttagtcgggtacggtcctacgtacctaacgtcttacgttcgttcgttaccg

SEQ ID NO: 119793 - DNA, 866 bp, Homo sapiens
  misc_feature: GYAE6OF01C3GY2.16.2.A02.1.454.CMB.1.raw
  modified_base (188)..(188): a, c, t, g, unknown or other
  misc_feature (188)..(188): n is a, c, g, or t
  modified_base (245)..(245): a, c, t, g, unknown or other
  misc_feature (245)..(245): n is a, c, g, or t
tcagtgtactactccacgaccggtgctcgatttagactcatctacgagggggagaactgctcagttaggacccagagggaaccatggaacgcccagctcagtcttctccttcctcctgctactcgtcggctacccagtataacccaccggaataaagttgttggttgaaccacgtagtcctaccgacnccctaccttgttcttttcggtccgtacccggggaaacgacgccctaccctcttccgngaccggagggccacgtctaagggtagttagttacggctaacgttcctttcgttacgtcccggttggtaacccaagtcgaacggtaccgacggttccggaccgtaccggtaccgtccaaccggtaccttcctactacttcgtactacgtacgtacgtacctaacgtacccgtaacggaccggtaccctacgtaacggtccctaaccgttcccgacggttcccgtacggttacggtaagtccggacggttagggtcgggttaacggcggtaacgtacgtaacccgttccgtactaccctaccgtcctaacgtgaaccgtcgacgtacgacgtaccgacgtaagtacgttcgtactacgtaactttacttaactttacgacgttacgacggtacgtaaacggtacgtaaccctaaggtaccccggttcccttacccgtaccgttacccgtttaccgggtttaccgggaccggggttaaaccggtaaccgggggttaaccggtaaagggtaacccggttaacgggtacccggtaaacggtttaacggaaccgggtttacgggtaccggtttcccgtaaacccgtttaacgaccgtttaaccgtcccgtttttaccggttaacccc

SEQ ID NO: 119794 - DNA, 494 bp, Homo sapiens
  misc_feature: GYAE6OF02G7EHW.16.2.A02.1.454.CMB.1.raw
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaagagccaccctctcctgcagggccagtcagagtgttagcagcttcttagcctggtaccagcagagacctggccaggctcccagactcctcatctatgatgcatccaacagggccactggcatcccagccaggttcagtggcagtgggtctgggacagacttcactctcaccatcagcagcctagagcctgaagattctgacaatttattactgtcagcagagtaacaactggcctcgctcactttcggcggagggaccaaggtggagagtcgaacgactgtggctgcaccatctgtcttc

SEQ ID NO: 119795 - DNA, 507 bp, Homo sapiens
  misc_feature: GYAE6OF02GOEYX.16.2.A02.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaanagccaccctctcctgcagggccagtcagagtgttagcagcttcttagcctggtaccagcagagacctggccaggctcccagactcctcatctatgatgcatccaacngggccactggcatcccagccaggttcagtggcagtggtctgggacagacttcactctcaccatcagcagcctagagcctagaagtattctgactaatttattactgtacagcagagtaacaactcggcctccgctctacgtttcggcggacgggaccgaaggtgagagtacggaacgaacgtgtacggcgtgcacatctgtctc

SEQ ID NO: 119796 - DNA, 615 bp, Homo sapiens
  misc_feature: GYAE6OF02G5VKG.16.2.A02.1.454.CMB.1.raw
  modified_base (306)..(306): a, c, t, g, unknown or other
  misc_feature (306)..(306): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagcccaccctgtctttgtctcccggggaaagagccaccctctcctgcagggccagtcagagtgttagcagcttctagcctggtaccagcagagacctggccaggcctcccagacctcctcatctatgatgcatccaacgngggccacgtggccactccccgagcctaggttcaggtggctagggtgggtctaggggacagtaccttcgacctctccaccatccaagcagacctagacgtccgtagaagtattcgtagtactaattttattacttcgttactagactaagtaacgtaacgtaacgtcggaccctccgtccttaccgtaccgtttccgggacggtaacgggaccgtaagggtacggtacggtaacggtaaccggtaaacggtaacggttacggtacggtacgtacggtaccgtaccgtacgtacgttacgttaccttaccg

SEQ ID NO: 119797 - DNA, 733 bp, Homo sapiens
  misc_feature: GYAE6OF02H30H3.16.2.A02.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
tcagtgtactactccacgaccggtgctcgatttagactcatctacagggggaggaacgtgctcagttaggacccagagggaaccatggaagcccagctcagcttctcttcctcctgctactctggctccagataccaccggagaaattgtgttgacacagtctccagccacctgtctttgctcccggggaaangccaccctntcctagcagggccagtcagagtgttagcagcttctagcctggtaccagcagagctggcaggctccagactcctcactctatgatgacatccaaanacgggcctaacgtggacactacccagacccgaagggtttccaaggttcggacctaagggttcggggtaccttgggggaacccaagggttaaccttcaaccttcttacccaaccattccgaacggcctaacggcccgtttaaacggacggtaccccgtaacggaaaggttaactttacgtacggttaccttaaaacttttaactttaaccttacgggttaccaaggttaaccgaaggtaaacggttaaaaccgtaaccgtttacgggacccgtttacccgaccgttaacccgttacggttttaccggggaccgggtaaaccggggtaccgtaaacggggttacgaaagggttaccgtaacggtaaaccggtaacgtaacggttacggccgtttacggacctaacccgtagttaccggtttacgtccgttttaaccgg

SEQ ID NO: 119798 - DNA, 575 bp, Homo sapiens
  misc_feature: GYAE6OF02GE9V0.16.2.A02.1.454.CMB.1.raw
  modified_base (196)..(196): a, c, t, g, unknown or other
  misc_feature (196)..(196): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaangccaccctctcctgcagggccagtcagagtgttagcagcttcttagcctggtaccagcagagacctggccaggcctcccagacctcctcatctatgatgcatccaacgagggcccaacgtggcactcccagccctaggttcaggtggcaggtgggtctggggacagtcttcacctctcaccatcagccagcctagacgtcctagaacgtattctgactaattttacttacgtgtacagtacagtaacgtaacaacgtcggtccctacccgtctaccgtacgtttccggacggaacggggtaccgaagggtaggagacgtaacggaacggtaaccgtgggtacgacgtacggacctaaccgtagtccgttcgttcttacc

SEQ ID NO: 119799 - DNA, 537 bp, Homo sapiens
  misc_feature: GYAE6OF02GMR9N.16.2.A02.1.454.CMB.1.raw
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
tcagtgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaagggctggagtgggtcgcatccattagtggtggtaataattacatatactacgganactcaatgaagggccncttcaccatctcagagacaacgccgaaaactcactgtactctagcagatagaacagcctagagagccgaagacacggctgtgtattactgtgcgaggtaggtactttactagttaggtttacggggaagttaacgtagttaacgtacgttattcgtag

SEQ ID NO: 119800 - DNA, 528 bp, Homo sapiens
  misc_feature: GYAE6OF02GGZLQ.16.2.A02.1.454.CMB.1.raw
  modified_base (380)..(380): a, c, t, g, unknown or other
  misc_feature (380)..(380): n is a, c, g, or t
  modified_base (460)..(460): a, c, t, g, unknown or other
  misc_feature (460)..(460): n is a, c, g, or t
tcagtgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagcctggggggtccctgagactctcctgtgcagcctctgaattcatcttcagtatctataacatgaactgggtccgccagactccagggaagggctggagtgggtcgcatccattagtggtggtaataattacatatactacggagactcaatgaagggccgnttcaccatctccagagacaacgccgaaaactcactgtatctgcagatgaacagcctgagagaccgaagacacggctggtntaattacgtgtagcgagagttcttactagtaggttcgggatttaagtaataacggacttagttgtacg

SEQ ID NO: 119801 - DNA, 623 bp, Homo sapiens
  misc_feature: GYAE6OF02JJ2S3.16.2.A02.1.454.CMB.1.raw
  modified_base (196)..(196): a, c, t, g, unknown or other
  misc_feature (196)..(196): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaangccacctctcctgcagggccagtcagagtgttagcagcttctagcctggtaccagcagagacctggccaggctcccagacctcctcatctatgatgcatccaacgcgggccacgtggcactcccgagcctaggttcaggtggctaggtgggtctggggactacggtacttcacgttcctacaccgatccgagccagacctaggacgtcctaggaacgtacttctacgtacctaaattttactaccgttgtacacgtacaaggtaacgtaaacaccgttcggtaccctccggtaccttccgttaccgtttacgggaccggtaacggggtaaccctaaggggtcggaacgtacggtaaccggtaacggtacgttagggtcggaccgtacgggtaccaaccgttacgtaccgttaggttacccgtttaac

SEQ ID NO: 119802 - DNA, 562 bp, Homo sapiens
  misc_feature: GYAE6OF02GHXTY.16.2.A02.1.454.CMB.1.raw
  modified_base (196)..(196): a, c, t, g, unknown or other
  misc_feature (196)..(196): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaangccaccctctcctgcaggccagtcagagtgttagcagcttcttagcctggtaccagcagagacctggccaggctcccagactcctcatctatgatgcatccaacagggccacgtggcactcccagccaggttcagtggcaggtgggtctgggacagacttcactctcaccatcagcagcctagacgcctagaagtattctagactaatttattaactgtacagtcagtaacgtaactaacgtcggtaccgtccgcttaccgtaccgtttccgggacggtaacgggaccgtaagggtcggaaggtacgtaaccggaacgtaacgtggtacggacgtacggacctaccgagttccttacgtcttaccg

SEQ ID NO: 119803 - DNA, 731 bp, Homo sapiens
  misc_feature: GYAE6OF02IETLW.16.2.A02.1.454.CMB.1.raw
  modified_base (195)..(195): a, c, t, g, unknown or other
  misc_feature (195)..(195): n is a, c, g, or t
  modified_base (393)..(393): a, c, t, g, unknown or other
  misc_feature (393)..(393): n is a, c, g, or t
tcagtgtactactccacgaccggtgctcgatttagactcatctacagggggaggaactgctcagttaggacccagagggaaccatggaagccccagctcagcttctcttcctcctgctactctggcctcccagataccaccggagaaattgtgttgacacagtctccagccacctgtctttgctcccggggaaangccaccctctcctgcagggccagtcagagtgttagcagcttctagcctggtaccagcagagacctggccaggcctcccagacctcctcatctatgatgcatccgaacgagggccacgtggaccactcccagccgtaggttcaggtcggctaggttcgggtctaggggaccagtacctttcacgttcctaccgaacctntaccgacgtaccaacggtccctaaggacgtacccgtaggtaaacgtacgtttcgtacggtaacctttaaactttttaacgtttaaccgttacgttaccgtaacggtaccgtaaaggtaaacgttaaacccgtaaaccggttccgggtaccccttacccggtaccttaaccgttaccggttttacccggggaaccgggtaacggggtaacccgtaaaggggttcgggaacgtaaccggttaacccgggaaaccggttaaccggttcgggtaaccggggttacccgtacggtaccccgtaacccggttaagttaccggttccggtttacccgtttacccg

SEQ ID NO: 119804 - DNA, 619 bp, Homo sapiens
  misc_feature: GYAE6OF02HZHIM.16.2.A02.1.454.CMB.1.raw
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (435)..(435): a, c, t, g, unknown or other
  misc_feature (435)..(435): n is a, c, g, or t
  modified_base (507)..(507): a, c, t, g, unknown or other
  misc_feature (507)..(507): n is a, c, g, or t
tcagtgtactactccacgaccggtgctcgatttagactcatctacagggggagagaggagccttagccctggattccaaggcctatccacttggtgatcagcactgaccaccgaggattcaccatggagctggggctccgctgggtttttccttgttgcttattttagaaggtgtccagagtgaggtgcagctggtggaggtttgggggaggcctggtcaaggccgtggggggtccctgagactctctgtgcagcctctgaattcattcttcagtatctaataacatgaactgggtccgccagacctccgaggggaaggggctgggagtgggtcgcatccattagtggtaggtaataattacatatactacgganactcaatgaacgggccncttcacatctaccagacgacaacgaccgaaaactcaactgtanctgacagactcgaaacacgccgtagacgacggaccgaaaggaccgtacggcttaggtacgttactttaacgnggttacgacggtaaggtacggtttacctttaacgttaaggtttaacggggttagggggttaaattttaaaagttacggttaaaacccggtacggttttactttacggtaacg

SEQ ID NO: 119805 - DNA, 693 bp, Homo sapiens
  misc_feature: GYAE6OF02JMJPK.16.2.A02.1.454.CMB.1.raw
  modified_base (195)..(195): a, c, t, g, unknown or other
  misc_feature (195)..(195): n is a, c, g, or t
tcagtgtactactccacgaccggtgctcgatttagactcatctacagggggaggaactgctcagttaggacccagagggaaccatggaagccccagctcagcttctcttcctcctgctactctggctccagataccaccggagaaattgtgttgacacagtctccagccacctgtcctttgtctcccggggaaanagccaccctctcctgcagggccagtcagagtgttagcagtcttcttagcctggtaccagcagagacctggccaggctcccagacctctcatctatgatgctatcccaacgacgggccacgtggcctacgtcccgagccgtaggttcaggtgcgtaggtcgggtctgggacagtaccttcgactctacaccatcgacgtcgacgaccgtacgacgtacgtacgtaacgtacgttacgtacgtacttaacgtttactttaacgttacgttacgacgtactaacggtaacgttaaaccgtaacgttacggtacccgtacccgttaccgttacccgttaaccggttttcccgggaaaccgggttaaccggggtaaccggtaacggggtaccgggtaacggtaacggttaacccgggtaaacggtaaccggttaagggtacgggttaccgtacccggtaaccgtacccggttaacgttaccggttacgttacccgtttacccg

SEQ ID NO: 119806 - DNA, 628 bp, Homo sapiens
  misc_feature: GYAE6OF02FZ73R.16.2.A02.1.454.CMB.1.raw
  modified_base (196)..(196): a, c, t, g, unknown or other
  misc_feature (196)..(196): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaanagcccaccctctcctgcagggccagtcagagtgttagcagcttcttagcctggtaccagcagagacctggccaggcctcccgagacctcctcatctatgatgcatccaacgagggccacgtggcactcccagccaggttcaggtggacgagggttcgggtcgtaggggactacggtactttcacttcctacaccatccagcacgtcctaggacgccgtagaagtacttctagtacttaatttacgttacgtgttacgagtactaaggtaacgtaaacgtaacgtcggtaccctacccgtccgttaccgttaccggtttaccgggacgggtaacgggtaaccgtaagggtacgggaacggtacgtaaccggaaacgtaacggttcgggtacggaccgttcggactaaccgtcgttacgttcgttaccttaccg

SEQ ID NO: 119807 - DNA, 596 bp, Homo sapiens
  misc_feature: GYAE6OF02HBL12.16.2.A02.1.454.CMB.1.raw
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
tcagtgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctggtggaggtttgggggaggcctggtcaagccgtgggggtccctgagactctcctgtgcagcctctgaattcatcttcagtatctaataacatgaactgggtccgccagactccgaggggaagggctgggagtgggtcgcactccattagtggtggtaaataattacatatactacganactcaatagaagggccncttnaccatcctccagacgaacaacgaccgaaaactcactagtactctgacagtatagaacacgacctgaacgaacggccgaaagaccgacggccttaggtacgttaattaccgttgtacggacggtaggaggttaccttaagttaggttaaggtttaccggggtaagtttaagtaacgttaaacggtaccggttttattaccgttacgg

SEQ ID NO: 119808 - DNA, 745 bp, Homo sapiens
  misc_feature: GYAE6OF02HMRBC.16.2.A02.1.454.CMB.1.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccacggagaaattgtgttgacacagtctccgagcccaccctgtctttgtcctcccggggaaanacgccaccctctcctgcagggccagtcagtagtgttagcagtcttctagcctggtaccngcagagacctggcaggctcccagactcctcatcatgatgcactccaacgagggccacgtggcatccccagccaggttcgagtcggctagggtcgggtctagggacaggtacttacgacttcctaccgaaccctataccgaacgtccgaacggtacccgttaaggaaccggtacccgttaggtaaaacggtatttaccgttaggtaacctttaaaacttttagtttaacctttaggtaaccgttaagaacgtaaacggaaacggttaaaacctaacggttaccgggtacccgtttacccggaccttttaccggttaacccgttttaccggggggaaccgggtaaacgggggtaaaccccggtaaaggggtttaccgggtaaaacggtaacggttaacccgggtaaaaccgggttaaacggttcgggttaacggggtacccttagggtaacccaaccgttaaccgttacgtttacggttccctttaacgg

SEQ ID NO: 119809 - DNA, 547 bp, Homo sapiens
  misc_feature: GYAE6OF02FSG7W.16.2.A02.1.454.CMB.1.raw
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaagagccaccctctcctgcagggccagtcagagtgttagcagcttctagcctggtaccagcagagacctggccaggctcccagactcctcatctatgatgcatccaacgacgggcccacgtggccatcccagccaggttcaggtggcaggtgggtctgggacagacttcactctcaccatcagcagcctagacgcctagaagtacttctgtactaattttacttactgtacagcagagtaacacgtcgcctccgacttctacgtttcggacggtacgggaccgtaagggtgaacgacgtacggaaaccgtacgtggtacggcttacggacctaccgtactcgttcgtcttaccg

SEQ ID NO: 119810 - DNA, 678 bp, Homo sapiens
  misc_feature: GYAE6OF02I2WR8.16.2.A02.1.454.CMB.1.raw
  modified_base (305)..(305): a, c, t, g, unknown or other
  misc_feature (305)..(305): n is a, c, g, or t
tcagtgtactactccacgaccggtgctcgatttagactcatctacagggggagagaggagccttagccctggattccaaggcctatccacttggtgatcagcactgaccacccgaggattcaccatggagctggggctccgctgggttttccttgttgctattttagaaggtgtccagagtgaggtgcagctggtggaggtttgggggaggcctggtcaagccgtggggggtccctgagactctcctgtgcagcctctgaattcattcttacagtatctaataacatacgaacgttcgggtcccnccagaccgtccggaaggggaaggggcgtagggaggtcggggtcgactacgtcctagtttacggtgggttaggttaaattaacttaacgtaattaactaaccggtaacggtacgtaactacgaaagtaggaacgggtcccgtacttaccgaccttactcctaccgaagaacgaaccaaaccgaccgtaaaactcctaactgtactctagacagtatacgaactagccgtagacgacgaccggaaagaccgtacggtacttaggtagttaacttacgttggtagacggtaggtaacggttaccttaacggttaacgttacggggttacgggttaatttaacggtaacgttaacggtacgttttagttcgtaacgg

SEQ ID NO: 119811 - DNA, 550 bp, Homo sapiens
  misc_feature: GYAE6OF02GXS8U.16.2.A02.1.454.CMB.1.raw
  modified_base (379)..(379): a, c, t, g, unknown or other
  misc_feature (379)..(379): n is a, c, g, or t
  modified_base (525)..(525): a, c, t, g, unknown or other
  misc_feature (525)..(525): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaagagcccaccctctcctgcagggccagtcagagtgttagcagcttcttagcctggtaccagcagagacctggccaggcctcccagactcctcatctatgatgcataccacgagggccagtcggcactcccagccgaggttcaggtggcaggtgggtctgggacagtactcactctcacatcagcncgcagcgcagagattcagtactaatttacttactgtacacgactaagtacgtaacacgtacgtaccgtccgtctcgttaccgtttccggacgggtaacggtaccgaagggtacggagtacgtaccggaacgtacggtgtcggtcgngaccgtactactcgttgtccttacg

SEQ ID NO: 119812 - DNA, 688 bp, Homo sapiens
  misc_feature: GYAE6OF02F5MOA.16.2.A02.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
tcagtgtactactccacgaccggtgctcgatttagactcatctacagggggaggaactgctcagttaggacccagagggaaccatggaagccccagctcagcttctcttcctcctgctactctggctcccagactaccacggagaaattgtgttgacacagttctccagcccaccctgtctttgtcctacccggggaaanagcccacctctcctgcagggccagtcagngtgtagcagtcttctagcctggtaccngcagacgacctggccaggcctacccgagacctcctcattctatggactcgcactaccaacgtcgggaccacggtgccacctcccgagcctaggttacacggtcggctagggtcgggtcgacgggactagtaccttcaccttcctaccgaactacgtccgacgtacccaacgtaccgtaacgaccggtccctaagggaaactttccgttacgttaacgtaactttaaacttttacgttaccgttagtaccgaaggtacaaacggttaaacgtaacccgtacggtacccggtacccgtaccgtacttaccggttaccgggtttaccgggacgggtaacggtaacggtaggggtacgaaggtaccgttaaccggtaacggtcgttacggtacgtacggacgtaccgtaccttagtaccgtttcgtcctttaaccg

SEQ ID NO: 119813 - DNA, 570 bp, Homo sapiens
  misc_feature: GYAE6OF02F5VES.16.2.A02.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
  modified_base (408)..(408): a, c, t, g, unknown or other
  misc_feature (408)..(408): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgtctcccggggaaanagccaccctctcctgcagggccagtcagagtgttagcagcttctagcctggtaccagcagagacctggccaggcctcccagactcctnatctatgatgcatccaacgagggccactggcactcccagccaggttcagtggcaggtgggtctgggacaggacttcactcncaccatcagcagcctagacgcctgaatnttctgactaattttntactgtacagcagaacgtaacacgtacggccctcgtcttaccgtacgtttccgggacggtacgggaaccgtaagggtcggaacgtacggtacggaaacggtaacgtcgggtacggtaccgttacggacctaaccgtacttaccgttacggttacctttaccg

SEQ ID NO: 119814 - DNA, 740 bp, Homo sapiens
  misc_feature: GYAE6OF02IUGW7.16.2.A02.1.454.CMB.1.raw
  modified_base (273)..(273): a, c, t, g, unknown or other
  misc_feature (273)..(273): n is a, c, g, or t
  modified_base (328)..(328): a, c, t, g, unknown or other
  misc_feature (328)..(328): n is a, c, g, or t
  modified_base (651)..(651): a, c, t, g, unknown or other
  misc_feature (651)..(651): n is a, c, g, or t
tcagtgtactactccacgaccggtgctcgatttagactcatctacagggggaggaactgctcagttaggacccagagggaaccatggaagcccctagctcagcttctcttcctcctgctactctggctcccagataccgaccggagtaaattgtagttgacgtacagtctccagccacccttgtcttttgcgtcccggggaaagtacgccacccgtctccgtgacacgggccagtcagcgtgttacgcgagtcttcgtaacgccttggtaccnggccagacgtaccctggccacggcctccgacgaactccctcgtaactccttaagngtagtcgaccacgtaccgaacgaccgggccctaacgtcggacctaccgtccaacggtcccgtaagttcgacgtggcgttacggtggggtcctagggactaggtactttacgacttcctaacgacctagtacgagtacccgtacgtaacgtaggaacctccgtaaaggtacgttaccttcgtaacgttaacttaaacgttttacgtttacgacgtttacggaacgttaccgaagttaaacccttaacgtaacgttacccggccgttcccgtacgttccgttaaccgggtttaccgggacgggtaaacgggtacccgtaaggggngttaacggtacggtaaccgtaacggttaacgtcgggttacgtacgtcgtaaacccggtctaaccgtttcggtaccgttcgttaaccccg

SEQ ID NO: 119815 - DNA, 654 bp, Homo sapiens
  misc_feature: GYAE6OF02F3FRY.16.2.A02.1.454.CMB.1.raw
  modified_base (195)..(195): a, c, t, g, unknown or other
  misc_feature (195)..(195): n is a, c, g, or t
  modified_base (405)..(405): a, c, t, g, unknown or other
  misc_feature (405)..(405): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccacctgtctttgtctcccggggaaanagccaccctctcctgcagggccagtcagagtgttagcagcttcttagccttggtaccagcagagacctggccaggctccagactcctcatctatgatgcatccaacgaggccacgtggcactcccagccgtaggttcacggtggtctagggtcgggtcgtcggggaacacggtactttcgactcctcacctatcagcacgacctaggacnccgtagaagtacgttctagtactaattttaacttactagtacgtagtacgtaacgtaagtaaacctaacgtacggtcccgttaccgaccgttaccgttaccggtttaccgggacggtaacggggtaacccgtaaggggtacgggtacggtaacggttaaccgggaaaccggtaacggttacggttacgggtaccgttacggacccgtaacccttagtttacccggtttaccgttacccgtttaaccccg

SEQ ID NO: 119816 - DNA, 620 bp, Homo sapiens
  misc_feature: GYAE6OF02HBSNK.16.2.A02.1.454.CMB.1.raw
  modified_base (200)..(200): a, c, t, g, unknown or other
  misc_feature (200)..(200): n is a, c, g, or t
tcagtgtactactccacgaccggtgctcgatttagactcatctacagggggaggaactgctcagttaggacccagagggaaccatggaagccccagctcagcttctcttcctcctgctactctggctcccagatacccaccggagaaattgtgttgacacagtctccagcccaccctgtctttgtccgtcccggggaaanacgccacccttctcctgcgagggccagtcagagttgttagcagtcttcgtacgcctggtaccagcgagacgtacccgtggaccacggccttacccgagtacctcctctactctagtgatcgaccactacccgaacgacgggacccacgtcggactactacccgagccgtaggttcgagtcggacgtagggttcggtacgtcgggaactacgtacttaccacgtcctacgacctagtcgacgcacgacctagacgtactagacgtcttctacgtacttaaatttacgttacgtcgtacgagtataagtacgtaactacgtccgccttcgaccttcgtacgtcggacggacggacgtagggagacgtacgtaacggaacgtacgtcggtcgcgtacgactaccgtgtccttgtaccttaccg

SEQ ID NO: 119817 - DNA, 645 bp, Homo sapiens
  misc_feature: GYAE6OF02G1XHR.16.2.A02.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (269)..(269): a, c, t, g, unknown or other
  misc_feature (269)..(269): n is a, c, g, or t
  modified_base (315)..(315): a, c, t, g, unknown or other
  misc_feature (315)..(315): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctaccagccacccttgtcctttcgccgtacccgggggaaancgcccaccctctcctcgccgaggccagtcagtagttntacgcagtcttcgttacgcctggtaaccngtacagacgtaccgtcggccacggcctacccgaacgtccttccgtntaacttccgtatcgattacgctaacgtacccaaacgcggtacccacgtggacctacgttccccgagttaccggtaggttacacggtcgtacgagggttcgggcgttagggctaacgtccttacacgtccacaccatccaagcctagacctaggacnctagaacgtnttgactattatttagtacgtgttacgatgtaagaactacctaacgccggttcctaccgtcttacgttaccgtacgggacggaacggtaccgagggtccgagtaccggacgtaaaggttaccgtggtaccgactcgtaccgacgttacgtcgttctagttacccg

SEQ ID NO: 119818 - DNA, 760 bp, Homo sapiens
  misc_feature: GYAE6OF02JN0Y9.16.2.A02.1.454.CMB.1.raw
  modified_base (304)..(304): a, c, t, g, unknown or other
  misc_feature (304)..(304): n is a, c, g, or t
  modified_base (635)..(635): a, c, t, g, unknown or other
  misc_feature (635)..(635): n is a, c, g, or t
tcagtgtactactccacgaccggtgctcgatttagactcatctacagggggagagaggagccttagccctggattccaaggcctatccacttggtgatcagcactgaccaccgaggattcaccatggagctggggctccgctgggttttccttgttgctattttagaaggtgtccagagtgaggtgcagctgggtggaggtttgggggaggtccgtggtcaacggccgtggggggtccctgagacctctcctgtgcagcctctagtaatcatctcagtatactatacatagtacgtcgggtccnccgagtacctaccggaggggtacgggcgtagggacggtgggtcgacgactacgtagttaggtcggtaggttaaattaacgttaactattaactacgtaacggactacgtacgtaagtacggtaacggacccgtaccgtaccgaacctacgttacccgacgtaaacgaccgtaaaccaaacccggtaacccgtaaaaacctccgttaacgtactaaccgttactcggaccgtaacgaattaaccggaaccgtacgtaccctagggaaacgtaccgaacccggaaacgtaacccggtacgggacctttaggttaaccgttatttacccggggngtaccgggtaacggtaggggttaaccctttaccgtttaaaggttaccgggttaaggggttaacccggggttaaagtttaacccgtaaagttaacccggttaaccgttttaggttaccgtaacggg

SEQ ID NO: 119819 - DNA, 732 bp, Homo sapiens
  misc_feature: GYAE6OF02GRWKD.16.2.A02.1.454.CMB.1.raw
  modified_base (200)..(200): a, c, t, g, unknown or other
  misc_feature (200)..(200): n is a, c, g, or t
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
  modified_base (645)..(645): a, c, t, g, unknown or other
  misc_feature (645)..(645): n is a, c, g, or t
  modified_base (688)..(688): a, c, t, g, unknown or other
  misc_feature (688)..(688): n is a, c, g, or t
tcagtgtactactccacgaccggtgctcgatttagactcatctacagggggaggaactgctcagttaggacccagagggaaccatggaagccccagctcagcttctcttcctcctgctactcgtggcctccagataccaccggagaattgtcgttgacacagtctccacgccaccctgtctttgtccgtaccggggaaancgccctaccctctcctgacgacggtccagtcgaggagttgtacgcagtcttcgtagccgttacgggtaccagcgaacgacgacccgtggacccagggtccctaccagtacctcctanaacttctagtgaacgtcgacttaaccgccaaaaccggngggaccctaagtcggaccctacctacccgacnccgggttagttaccgaggttcggaccgtaggtcgggttagacggactactaccgttcacgtatacccgacacgtacgacgcgtacgtacgtagaccggttccaagtagtacttacctacggtacttaaacttttcctaacgggtttaccacgtaaccggtaaccgtaaggtaaaaccgtttaaaccgtcgacccgggttcccgtaccgttaccgtaaccgtttaccgggttcccgggaaacgggacggtaaacccggnggtaccgggttacgaacgtacccggtaaaggtaccgttaacgnggttaccgacgaaccgtcgtaacgttcgtaccgtttaactcccg

SEQ ID NO: 119820 - DNA, 744 bp, Homo sapiens
  misc_feature: GYAE6OF02HWIPT.16.2.A02.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (722)..(722): a, c, t, g, unknown or other
  misc_feature (722)..(722): n is a, c, g, or t
tcagtgtactactccacgaccggtgctcgattttagactcatctacaggggggaggaactgctcagttaggacccagagggaaccatggaagccccagctcagcttctcttcctcctgcctactctggcctcccagataccacggagaattgtgttgacacagtctccagccaccctgtctttgccgtccgggaanacgccaccctcgtctgcagggcccagtcaggagttgttacgctagtcttactacgcctaggtaccagcagacgacctcggaccgaggcctcccagtcctcccgtntactacttagtcgacgttcnctaacctaacccgaacggtaccgggtaccccacggtcgaccaccgttccccgaagtacccggtaggttcgtaacgggtcggtacgtcgggtacggggtttcggacggtacgaacgttcttaccgactttacccaccgactacgtcgacgtacgaccggtactcggaccgttacgtaaggtacgttactttacgtagtttaaccttttaaagtttcgtttaatacggtaccgttaggtaaccgaacgtttaaaccggtaacctaaccggttacccgggttaccctacgttaccctaccgggtttaccgttaacggggaccgggaacgggttaaccggtaaggttgggaacgtaccgggtaacgtaacggttacgtcggttacgcgtacgaccttaccggttntttacgtaccgttacgttaccg

SEQ ID NO: 119821 - DNA, 790 bp, Homo sapiens
  misc_feature: GYAE6OF02FVYJG.16.2.A02.1.454.CMB.1.raw
tcagtgtactactccacgaccggtgctcgatttagactcatctacagggggaggaactgctcagttaggacccagagggaaccatggaagccccagctcagcttctcttcctcctgctactctggctcccagataccaccggagaaattgtgttgacacagtctccagccaccctgtctttgcctaccggggaaagacgccaccctctcctgcagggccagtcagtagtgttagctacgtcttctagccttggtaccagcaggacgaccgtggccaggctcccaagacctcctcactctatgatgctactccgaacgacgggacccacgtggccaactccccgacgtacccgtacggtttacgaacggtcggcgtaggggttcggggtcggttacggggaactacggtaccgttacctacgttccttacccgaaccctacttaccggaacgaccgtaccgtaccgtacgtaccgtaccgttaaggtaagttacttcgttacgtaacgtttaaacttttaacgtttaaccgttcgttaacggtaccgtaacgtaaacgggtaaccgttaaacgtaacggtttaccggaccccgtttaccgtaccccgtttaccgttaaccgggtttacccgggggtaccggtaaacggggtaacccggtaaggggtaccggtaacgggttaaccggtaaccgggttaaaccggtacgggttaccggggttagggtaacccggttacggttacccctaaccggttaaacgttcccggttaccgttttacccgtttaacccgg

SEQ ID NO: 119822 - DNA, 861 bp, Homo sapiens
  misc_feature: GYAE6OF02IRM0T.16.2.A02.1.454.CMB.1.raw
  modified_base (203)..(203): a, c, t, g, unknown or other
  misc_feature (203)..(203): n is a, c, g, or t
tcagtgtactactccacgaccggtgctcgatttagactcatctacagggggaggaactgctcagttaggacccagagggaaccatggaagcccagctcagcttctcttcctcctgctactctgctccagataccacgggagtaacttggtgttgacacagtctaccagccctaccctgttcctttgtccgtacccggggaaancgccctacctctccgtagcgacgggcctagtcgaaggacgttgttaacgcagtcctttacgttacgccttacgggaacctaagccgtaaaggcgtaccgtcggggcccgggcctcccgaaggtcccttaccgtcaacgttctaacgtacgtactcgaccttaactacccgacggtaacggggacccctacggtcggacctaccgtaccacggtaccgtaacggttcgaacgggttacgcggtaacggttggggtacgtcggggaataccgggtacgttccacgttcgttaccgaaccctagttaccgaacgtcgtaccgggtaccgtaacggtaccggtacccgtttaaggtaacccgtaacgtttcgaaaccgttactttaaccgggtttttaattacccgttttaacgaccgtttaacgggaaccgtaaccggttaaacggttaacgttaaccggttaacccggttaccccggttacccgttaccgttcccggttaacccgggtttacgggtaacccggggtaacccggtaaacggtaaccggggttacgggaacctaccgggtaacggttaaaccggtaaccggtcgggttaacggtcccggttaggaccctttaacccggaggtttccctacggttttacccgttacgtacccg

SEQ ID NO: 119823 - DNA, 681 bp, Homo sapiens
  misc_feature: GYAE6OF02F9BTH.16.2.A02.1.454.CMB.1.raw
  modified_base (144)..(144): a, c, t, g, unknown or other
  misc_feature (144)..(144): n is a, c, g, or t
tcagtgtactactccacgaccggtgctcgatttagactcatctacagggggaggaactgctcagttaggacccagagggaaccatggaagccccagctcagcttctcttcctcctgctactctggctcccagataccaccgganaaattgtgttgacacgagtctccagcccaccctgttctttgtccgtacccggggaaagacgcccacccttcctcctgcgacgggcctagtcaggtagtgttagcagtccttcttagccgtggtaccagccagacgcctcggccaggtccctccgacgaccttcctacatcttatcgatcgaccagtaccgaacgcgggacccacgtcgaccactcccgacgacccgtaggttcaacggtcggacgtacggtacgggtcggtacggaacgacgtaccttacgaacccttcgtacccctaacaacttcaacgcctacgtacctaaaggaccgtacctaggtaacgttacgttcctaacgtaccttaattttaacgtttctcggtaactacgacgtaacgtaaccgtaacgttaccgtcggtccctacgtccttacgtacgggtcggaacgtacggacggtcggtaggactaacggaaccggtaaacgtgggttaacgcggtacttacgccgtaaaccgtcggtttcttcgtaccctacg

SEQ ID NO: 119824 - DNA, 703 bp, Homo sapiens
  misc_feature: GYAE6OF02GXRKY.16.2.A02.1.454.CMB.1.raw
  modified_base (204)..(204): a, c, t, g, unknown or other
  misc_feature (204)..(204): n is a, c, g, or t
  modified_base (324)..(324): a, c, t, g, unknown or other
  misc_feature (324)..(324): n is a, c, g, or t
tcagtgtactactccacgaccggtgctcgatttagactcatctacaggggggaggaactgctcagttaggacccagagggaaccatggaagccccagctcagcttctcttcctcctgctactctggctcccagataccacggagaaattgtgttgacacgagtcctccagccctacccgtgttctttgccgtacccggggaaancgcccacctctcctgcgagggccagtcagagtcgttagcgagtcttcttacgccttaggtaccagtcaaggctaccgtggacctaggccctacccgagtaccttccgactagtacctagngtatgtacctactaccgaacggacggcctaacgtcggacctacgtcccgagccggttacgtcgaggtcggcgagggttgggtcggaggactacgtacttcacgttccacactacgtcgaacgtccagtaccgagtacgtaccgtaagtaacgtattacgtacgttaccttaaagtttacttaccggtacttacggaatacgtaacggtaacttaaaccgtacggtaccgttacccgtacccgtaccgttaaccgttccggttaccggggacgggtaaacggtaacgtaacgggtacgaacgtaaccggtaaccggaacggttaacggtcggtacggtctaccggtccgtaacgttcgttccttaccggttacttacccg

SEQ ID NO: 119825 - DNA, 805 bp, Homo sapiens
  misc_feature: GYAE6OF02IYPGX.16.2.A02.1.454.CMB.1.raw
  modified_base (192)..(192): a, c, t, g, unknown or other
  misc_feature (192)..(192): n is a, c, g, or t
  modified_base (629)..(629): a, c, t, g, unknown or other
  misc_feature (629)..(629): n is a, c, g, or t
  modified_base (666)..(666): a, c, t, g, unknown or other
  misc_feature (666)..(666): n is a, c, g, or t
tcagtgtactactccacgaccggtgctcgatttagactcatctacagggggagagaggagccttagcccttggattccaaggcctatccacttggtgatcagcactagaccaccgagattcaccatggagcgtgggctccgcttgggttttccttgttcgcttattttagaaggtgtccaagagtgacggtncagctggtggaggttggggaggtccgtagggtcaacgtccgtcgggggtccctaggacgaccttctcctcgtacgcacgtacctcgtacgtaattccacttcgttactacgtaacttccttaaagtaacacgttacggaaacggttcgggtaccccggacccgtaacgtaacccgttaccgggaagggggtagggggtaccggttcggggtaacgggttcgggttcccgtaccgtaacgtaccgtttagtttaacggttacggtaggttaaaaacttaacggttaacaacggttaactaacggttaccggtaactaacgttaacccggtaaggtaacggaacggggtccgttaccgttaaccaacccggttactccgttacccgaaggtaccgaaaccgaacccggaaccttaaaaacgttccacgttaacgtaccncggtaactcgaattacgtaaggacctagccgtaaagnggtaccaacgaagaccgttacggtcgtacgttaacttaacggtacttggacgtttagcgggtttaaaccttaggttacgttacgttaaggggtccgttaaagtattaacccggtaaacggtacctttacggtagtacgg

SEQ ID NO: 119826 - DNA, 1130 bp, Homo sapiens
  misc_feature: GYAE6OF02GPVBN.16.2.A02.1.454.CMB.1.raw
tcagtgtactactccacgaccggtgctcgatttagactcatctacagggggagagaggagccttagccctggattccaaggcctatccacttggtgatcagcactgaccaccgaggattcaccatggagctggggctccgctgggttttccttgttgtcttattttagaaggtgtccagagtggtaggtcgcgagtcgtgggtgggtagggttttggggggacggtcccgtgggtaccgaaacggtcccgggttcgggggggttcccctaggaacgtaccgttccttcccgttaggtcgacgtacggtccccttacgttacgtaactttccgtaacttcccgtttaccgtaacggtttacttacccgttaaaacttaaaacctagttaaccggttaaacccggtcggggggttacccccgtaccccggtaaccggtaacccgttaccccggggaaacggggggttaacgggggtaccgttacgggggtacggggtttaaccgggggtccgtaacccggttaaccgttaccccggttaagggtttttaacggggttacgggggtttaacgggttaaaaagttttaaaaccgtttaaaccgtaaaacgttttaaccggttaaacccgggttaaaccggggtaaacgtaacccgtttaaccggaaacggttaaggggtaaaccccgggggttaccccgttacccgtttacccggtaaacccctaccgtttaacccgtaccccgaaagggtaaaacccggaaaccccgaaaaacccccgggtaaacccggtaaaaaaccccgtttccaaaccggtttacgttaacccttccggttaacgggtaacgtaacgttaaagttaccggaaaccctacggtacccggttaacgggaacggtaacccggtaaaccgggtaaaccggtaacccggttaaccgggtcgttttaaaccgggtcgttttaaaacccgttacggtaacgtttccggggaaccgttacgggggttaaccgtttaacccggttttaaacgggttaaccggtttaaccggggggtttaacgggttaaaaccgttttaaaggttaaaaccccggtttaaaccggttaacggttttttaacccgtttaccggttaacggg

SEQ ID NO: 119827 - DNA, 156 bp, Homo sapiens
  misc_feature: GYAE6OF01EKWRS.12.80.H03.1.454.CMB.1.raw
  modified_base (156)..(156): a, c, t, g, unknown or other
  misc_feature (156)..(156): n is a, c, g, or t
tcagatacgacgtacacgaccggtgctcgatttagctgtgcgtcgaagggaaagggaccaaggtcatcgtcctaggtcagcccaaggccaacccactgtcactctgttcccgccctcctctacgtcgtatctgagcgggctggcaaggcgcatagn

SEQ ID NO: 119828 - DNA, 156 bp, Homo sapiens
  misc_feature: GYAE6OF01EB0FH.12.80.H03.1.454.CMB.1.raw
  modified_base (156)..(156): a, c, t, g, unknown or other
  misc_feature (156)..(156): n is a, c, g, or t
tcagatacgacgtacacgaccggtgctcgatttagctgtgcgtcgaagggaagggaccaaggtcatcgtcctaggtcagcccaaggccaaccccactgtcactctgttcccaccctcctctacgtcgtatctgagcgggctggcaaggcgcatagn

SEQ ID NO: 119829 - DNA, 158 bp, Homo sapiens
  misc_feature: GYAE6OF02ITHXZ.12.80.H03.1.454.CMB.1.raw
  modified_base (157)..(158): a, c, t, g, unknown or other
  misc_feature (157)..(158): n is a, c, g, or t
tcagatacgacgtacacgaccggtgctcgatttagctgtgcgtcgaagggaaagggaccaaggtcatcgtcctaggtcagcccaaggccaaccccactgtcactctgttcccaccctcctctacgtcgtatctgagcgggctggcaaggcgcatagnn

SEQ ID NO: 119830 - DNA, 157 bp, Homo sapiens
  misc_feature: GYAE6OF02GK7N3.12.80.H03.1.454.CMB.1.raw
  modified_base (157)..(157): a, c, t, g, unknown or other
  misc_feature (157)..(157): n is a, c, g, or t
tcagatacgacgtacacgaccggtgctcgatttagctgtgcgtcgaagggaaagggaccaaggtcatcgtcctaggtcagcccaaggccaaccccactgtcactctgttcccaccctcctctacgtcgtatctgagcgggctggcaaggcgcatagn

SEQ ID NO: 119831 - DNA, 486 bp, Homo sapiens
  misc_feature: GYAE6OF01CHL6N.2.38.D05.1.454.CMB.1.raw
  modified_base (439)..(439): a, c, t, g, unknown or other
  misc_feature (439)..(439): n is a, c, g, or t
tcagacgctcgacacacgaccggtgctcgatttagtatctgatagttgggtttggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtacttttgggngttcggcggagggaccaagctgaccgtctaggcagcccgaaggtccg

SEQ ID NO: 119832 - DNA, 529 bp, Homo sapiens
  misc_feature: GYAE6OF01AJG9F.2.38.D05.1.454.CMB.1.raw
  modified_base (519)..(519): a, c, t, g, unknown or other
  misc_feature (519)..(519): n is a, c, g, or t
tcagacgctcgacacacgaccggtgctcgatttagtatctgatagctgggttttccttgttgctattttaaaaggtgtccagtgtgaggtgcagctggtggagtccggggaggcttagttcagcctgggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagacacgctgtatctgcaaatgaacagtctgagagccgaggacacggctgtgtattactgtgcaagagatagcagcagctggtacgccgactacgtggggccagggaaccctggtccaccgtctcctcacgcctccaccaacgggcccacgtccggtccttcccccgtggccgccctcgcctccgaggcgccaccctccgagacgccacnggccggcccg

SEQ ID NO: 119833 - DNA, 489 bp, Homo sapiens
  misc_feature: GYAE6OF01DXATA.2.38.D05.1.454.CMB.1.raw
  modified_base (277)..(277): a, c, t, g, unknown or other
  misc_feature (277)..(277): n is a, c, g, or t
  modified_base (331)..(331): a, c, t, g, unknown or other
  misc_feature (331)..(331): n is a, c, g, or t
tcagacgctcgacacacgaccggtgctcgatttagtatctgatagttgggtttggggggcctcaggaagcagcatcggaggtgcctcagccatggcatggatccctctcttcctcggcgtccttgcttactgcacagggtccgtggcctcctatgagctgactcagccaccctcagtgtccgtgtccccaggacagacagccagcatcacctgctctggagataaattggggataaacatgcttgctggtatcagcagaagtcaggccagtcccctntgctggtcatccatcaagataccaagcggccctcagggatccctgagcgattcnctggctccaagtctgggaacacagccacttgaccatcagcgcgaccaggctatgatgaggctgactattactgtcaggcgtgggacagcagcgtggtagtcggcggaggaccgaagctgacccgtcgtaggtcacgcccaaggcctcgcccccgtcgg

SEQ ID NO: 119834 - DNA, 514 bp, Homo sapiens
  misc_feature: GYAE6OF01D0UEU.2.38.D05.1.454.CMB.1.raw
  modified_base (362)..(362): a, c, t, g, unknown or other
  misc_feature (362)..(362): n is a, c, g, or t
  modified_base (439)..(439): a, c, t, g, unknown or other
  misc_feature (439)..(439): n is a, c, g, or t
  modified_base (507)..(507): a, c, t, g, unknown or other
  misc_feature (507)..(507): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcacatctcaganacaacgccaagaacacgctgtatctgcaaatgaacagtctgagagccgaggacacggctgtgtattactgtgcaagngatagcagcagctggtacgccgactacggtggggccaggggaaccctgggtccacccgttctccctcncgtcccc

SEQ ID NO: 119835 - DNA, 577 bp, Homo sapiens
  misc_feature: GYAE6OF01BPSLE.2.38.D05.1.454.CMB.1.raw
  modified_base (389)..(389): a, c, t, g, unknown or other
  misc_feature (389)..(389): n is a, c, g, or t
tcagacgctcgacacacgaccggtgctcgatttagtatctgatagctgggttttccttgttgctatttaaaaggtgtccagtgtgaggtgcagctggtggagtccgggggaggcttagttcagcctgggggtccctgagactctctgtgcagcctctggatttcaccttcagtagtctactggatgcactgggtccgccaagctccgagggaggggctggtgtgggtctcgacgtattaatagtgatgggagtagcacaagctacgcggactccgtgaagggccattcaccatctccagacgacaacgccaaagaccacgctgtatctagactaaatgaacagtctgacgagcccgaggacacggcttgtgtaagttcgtgtgacaagngatagcagcagcgtcggtacgccgtaccgtacgtcgggccgacgggaccctggtacctaccgtcctcctccgaacgccctaccgacccgaaccgggtcccacgttacccgtccttcccccgtcggcccgcccgtcgccgtaccgacggtcgccgacccgtccgacgacgacgcgccggcggtccccgg

SEQ ID NO: 119836 - DNA, 489 bp, Homo sapiens
  misc_feature: GYAE6OF01A4YPI.2.38.D05.1.454.CMB.1.raw
  modified_base (440)..(440): a, c, t, g, unknown or other
  misc_feature (440)..(440): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctgagggatccctgagcgattctctggctccagctcgagggacaacagtcacgttgaccatcagtggagtccaggcagagatgagctgactatactgtcaatcagcagacagcagtggttacgttttgggngttcggcggtagggaccagcgtgaccgtctaggtcacgccgaaggtccg

SEQ ID NO: 119837 - DNA, 497 bp, Homo sapiens
  misc_feature: GYAE6OF01AP03O.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggactccctgagcgattctctggctccagctcgagggacaacagtcacgttgaccatcagtgagtcaggcagaagatgaggctgactattactgtcaatcagcagacagcagttgtacgttttgggtggttcggcggtagggaccaggctggaccgttctaggtccacggcccgaaggtccg

SEQ ID NO: 119838 - DNA, 546 bp, Homo sapiens
  misc_feature: GYAE6OF01B5FD6.2.38.D05.1.454.CMB.1.raw
  modified_base (171)..(171): a, c, t, g, unknown or other
  misc_feature (171)..(171): n is a, c, g, or t
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (228)..(228): a, c, t, g, unknown or other
  misc_feature (228)..(228): n is a, c, g, or t
  modified_base (276)..(276): a, c, t, g, unknown or other
  misc_feature (276)..(276): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (494)..(494): a, c, t, g, unknown or other
  misc_feature (494)..(494): n is a, c, g, or t
tcagacgctcgacacacgaccggtgctcgatttagtatctgatagttgggtttgggggagccccagccctgggattcccagctgtttctgcttgctcgatcaggactgcacacagagaactcaccatggagtttgggctgagcgtggttcgtctagcattaaagtgtcatntngtgnagctgtgagtcggggagctagtcagcctggggtcctgcgactctcctggtncagcctctggtattcaccttcagtagctaactggatgcacctggtccncaagctccgagggagggctggtacgtggtctcgacgtattaagngtnagtggatagcgacagctacggcgtactccggagaacgggtcctattccacctatctaccagacgacaacgcaagacacgctagtatctagactaaagtcgaacagtcgtagaacgacgtaccgtaggtaccgtacggcttaggtacttattaccgtgtaccgacgaaaggngtaagtcgcgtaaggcctaaggtccgtaggtacccgccgtaacgttaccggg

SEQ ID NO: 119839 - DNA, 488 bp, Homo sapiens
  misc_feature: GYAE6OF01CZV63.2.38.D05.1.454.CMB.1.raw
  modified_base (355)..(355): a, c, t, g, unknown or other
  misc_feature (355)..(355): n is a, c, g, or t
  modified_base (439)..(439): a, c, t, g, unknown or other
  misc_feature (439)..(439): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttatggtaccagcagaagccaggccaggcccctgtgctggtgatatataaaagacagtgagaggccctcagggatccctgagcgattctctggctccagctcagggacaacngtcacgttgaccatcagtggagtccaggcagagatgagctgactattactgtcaatcagcagacagcagtggttacttttgggngttcgggcggtagggaccagctgaccgtctaggcacgcccgaaggtccc

SEQ ID NO: 119840 - DNA, 502 bp, Homo sapiens
  misc_feature: GYAE6OF01BRAWT.2.38.D05.1.454.CMB.1.raw
  modified_base (313)..(313): a, c, t, g, unknown or other
  misc_feature (313)..(313): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctnagggatccctgagcgattctctggctccagctcagggacaacagtcacgttgaccatcagtgagtccaggcagaagatgagctgactattactgtcaatcagcagacagcagttggttacgtttttgggagtttcggcgggtagggaccgaagcgtcgtaccgtcgtaggtcacggcccgaaggtcccg

SEQ ID NO: 119841 - DNA, 554 bp, Homo sapiens
  misc_feature: GYAE6OF01BBSUG.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaaagaacacgctgtatctgacaaatgaacagtctgagagccgaggacacggctgtgtattactgtgcaagagatagcagcagctggtacgccgactacgtgggccacgggaccctggtccaccgtctcctcacgcctccgaaccgaacgggcccaacgtccggtacccttcccccgtcggcccgccccgtcggccttcccgacggcgccacccgtccgacgacgccacgacggccggtacccgg

SEQ ID NO: 119842 - DNA, 503 bp, Homo sapiens
  misc_feature: GYAE6OF01B943A.2.38.D05.1.454.CMB.1.raw
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
  modified_base (440)..(440): a, c, t, g, unknown or other
  misc_feature (440)..(440): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctnagggatccctgagcgattcnctggctccagctcagggacaacagtcagttgaccatcagtggagtccaggcagaagatgagctgactattactgtcaatcagcagacagcaggttgtacgttttgggngttacggcgggagggaccaaggctacggaccgttcctagggtaccaggaccccgaaggtcccg

SEQ ID NO: 119843 - DNA, 521 bp, Homo sapiens
  misc_feature: GYAE6OF01D1QA0.2.38.D05.1.454.CMB.1.raw
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (399)..(399): a, c, t, g, unknown or other
  misc_feature (399)..(399): n is a, c, g, or t
  modified_base (442)..(442): a, c, t, g, unknown or other
  misc_feature (442)..(442): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccaccaagctccgagggaagggctgggtgtgggtctcacgtattaatagtgatgggagtagcacaagctacgcggactccgtgaaggccattcacatcncaganacaacgccaagaacacgctgtatctgacaaatgaacngtctagagagccgaggacacggctgtgtattactgtgacaagngatagcagcagcgtggtaccgccgaacgtacgcggggacccagggtaaccctggtccaccgtcctcctcgacgtccccg

SEQ ID NO: 119844 - DNA, 556 bp, Homo sapiens
  misc_feature: GYAE6OF01AMNPX.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccaggggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagatagcagcagcgtggtacgccgactacgtggggccgacgggaaccctggtccaccgtcctcctcacgccctcccaccgaacgggcccacgtccggtcccttcccccgtcggcccgccccgtcgcctcccacgggacgccacccgtcccgacgacgaccaccgacggccggccccg

SEQ ID NO: 119845 - DNA, 516 bp, Homo sapiens
  misc_feature: GYAE6OF01C7WOG.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctgagggactccgtgagcgattctcgtggctccagctcgagggacaacgagtcacgttgaaccatcagtggagtccaggcaagaagagtgagctagactattactgtacaatcagcaagacagctaggttgttacgttttgggtgttcgggcgggtaagggaccaggtccgtcgacccggtcgtaggccacggcccgaagggtcccg

SEQ ID NO: 119846 - DNA, 547 bp, Homo sapiens
  misc_feature: GYAE6OF01EXGTP.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagcgaggacacggctgtgtattactgtgcaagagatagcagcagctggtacgccgactacgtcggggaccacgggaaccctggtccaccgtcctcctcacgccctccacccgaacgggccccacgtccggtccttcccccgtcggcccgccctcggcctccgacggcgccaccctccggacgacgccacgcgccggtcccgg

SEQ ID NO: 119847 - DNA, 499 bp, Homo sapiens
  misc_feature: GYAE6OF01DTNQ5.2.38.D05.1.454.CMB.1.raw
  modified_base (385)..(385): a, c, t, g, unknown or other
  misc_feature (385)..(385): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtcccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcgagggacaaacagtcacgttagaccatcagtggagtcaggnagaagatgagctgactattactgtacaatacagcagacagcagtggttacgttttgggtgttcggcgggagggaccaagcgtgaccgttcgtacggtcacgcccgaaggtcccg

SEQ ID NO: 119848 - DNA, 506 bp, Homo sapiens
  misc_feature: GYAE6OF01AS1WF.2.38.D05.1.454.CMB.1.raw
  modified_base (312)..(312): a, c, t, g, unknown or other
  misc_feature (312)..(312): n is a, c, g, or t
  modified_base (356)..(356): a, c, t, g, unknown or other
  misc_feature (356)..(356): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctnagggatccctgagcgtattctctggctccagctcagggacaacngtcacgttgacatcagtggagtccaggcaagaagagtgaggctgactattactgtcaatcagcagacagacaggttggttacgttttgggtgttcgggcggagggaccaaggctaggacccgtccgtaggtaccacgcccgaaggtcccg

SEQ ID NO: 119849 - DNA, 496 bp, Homo sapiens
  misc_feature: GYAE6OF01BL3UQ.2.38.D05.1.454.CMB.1.raw
  modified_base (312)..(312): a, c, t, g, unknown or other
  misc_feature (312)..(312): n is a, c, g, or t
  modified_base (441)..(441): a, c, t, g, unknown or other
  misc_feature (441)..(441): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctnagggatccctgagcgattctctggctccagctcagggacaacagtcacgttgaccatcagtggagtccaggcagaagatgagctgactattactgtcaatcagtcagacagcagtggttacttttgggngttcggcggtagggaccaagcgtagaccgtccgtaggtcacgcccgaaggtcccg

SEQ ID NO: 119850 - DNA, 513 bp, Homo sapiens
  misc_feature: GYAE6OF01BLNPX.2.38.D05.1.454.CMB.1.raw
  modified_base (433)..(433): a, c, t, g, unknown or other
  misc_feature (433)..(433): n is a, c, g, or t
  modified_base (505)..(505): a, c, t, g, unknown or other
  misc_feature (505)..(505): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccggtgaagggccgattcacatctccagagacaacgcaagaacacgctgtatctgacaaatgaacagtctgagagccgaggacacggctgtgtattacngtgcaagagatagcagcagctggacgccgactagcggggcccaggggaacccctggtccacccgtctccctnacgtcccc

SEQ ID NO: 119851 - DNA, 548 bp, Homo sapiens
  misc_feature: GYAE6OF01CEYJ8.2.38.D05.1.454.CMB.1.raw
  modified_base (371)..(371): a, c, t, g, unknown or other
  misc_feature (371)..(371): n is a, c, g, or t
  modified_base (509)..(509): a, c, t, g, unknown or other
  misc_feature (509)..(509): n is a, c, g, or t
  modified_base (535)..(535): a, c, t, g, unknown or other
  misc_feature (535)..(535): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccgattcaccatctccagagacaacgccaagaacacgctgtatctgacaaatgaacagtctgagagccgaggacacggctgtgtattacngtagacaagagatagcagcagctggtacgccgactacgtgggccacgggaaccctggtccaccgtcctcctcagccctccaccgacggcccacgtccgtccttcccccgtggccgccccgtcgcccgtccacgggtcnccgaccctaccggacgacgccaccgnggccggtccccgg

SEQ ID NO: 119852 - DNA, 541 bp, Homo sapiens
  misc_feature: GYAE6OF01EIGPN.2.38.D05.1.454.CMB.1.raw
  modified_base (530)..(530): a, c, t, g, unknown or other
  misc_feature (530)..(530): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccaggggaagggctggtgtgggtctcacgtattaatagtgatgggagtagcacaagctacgcggactccgtgaagggccattcaccatctcagagacaacgccaagacacgctgtatctgacaaatgaacagtctaggagagccgaggacacggctgtgtattactgtgacaagagatagcagcagctaggtacgccgactacgtggggccacgggaccctggtccaccggtctcctcacgccctaccgaccgaacgggcccagtccggtcccttccccgtggccgtccctcgcctccgaggcgccaccgtccgagacaccacgnggccggtcccg

SEQ ID NO: 119853 - DNA, 535 bp, Homo sapiens
  misc_feature: GYAE6OF01C0XTV.2.38.D05.1.454.CMB.1.raw
  modified_base (340)..(340): a, c, t, g, unknown or other
  misc_feature (340)..(340): n is a, c, g, or t
  modified_base (382)..(382): a, c, t, g, unknown or other
  misc_feature (382)..(382): n is a, c, g, or t
  modified_base (526)..(526): a, c, t, g, unknown or other
  misc_feature (526)..(526): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaaagaacacgctgtatctgacaaatgaacngtctgagagccgaggacacggctgtgtattactgtgacaagngatagcagcagctggtacgccgactacgtgggccgacgggaaccctggtcaccgtctcctcacgccctccaccgacgggcccagtccgtccttcccccgtggccgcccgtcgcctccgaggcgccgaccctccgacgacgcacngccggcccg

SEQ ID NO: 119854 - DNA, 504 bp, Homo sapiens
  misc_feature: GYAE6OF01C3RO0.2.38.D05.1.454.CMB.1.raw
  modified_base (392)..(392): a, c, t, g, unknown or other
  misc_feature (392)..(392): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcgagggatcccgtgagcgattctctggctccagctcgagggacaacgagtcacgttgaccatcagtggagtcaggcagagntgagctgactatactgtacatcagcagacagctaggttggttacgttttgggtgttcgggcggagggacctaaggccgtagacccgtcgtaggtcacggcccgaaggtcccg

SEQ ID NO: 119855 - DNA, 598 bp, Homo sapiens
  misc_feature: GYAE6OF01EHXTU.2.38.D05.1.454.CMB.1.raw
  modified_base (433)..(433): a, c, t, g, unknown or other
  misc_feature (433)..(433): n is a, c, g, or t
  modified_base (485)..(485): a, c, t, g, unknown or other
  misc_feature (485)..(485): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtgggtcccgccaagctccgaggggagggctgggtgtgggtctcgacgttattaagtagtgagtgggagtagcacgaagctacggcggactcggtaggaacgggcctattccacctatcctaccagacgacaacgacaaagaacncgtctagtatctagacaaatcgaactgtcaggacgacggcccggaaggaccncggtacttggttacgttatttaccgtggtacgacgaaaaggagaacgtacggaccgaaggaccctaagggtaccgttacggggtaacccgccccgggtaacttaaccgggggg

SEQ ID NO: 119856 - DNA, 573 bp, Homo sapiens
  misc_feature: GYAE6OF01BHEYV.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtggggggtccctgagactctcctgtgcagcctctggattcaccttcagtagctacgtggatgcacgtgggtccgcaagctccgagggagggctgggtgtgggtctcgacgttattaagtagtgagtgggagtagcagaagctacggcggactccgtaggaacggccgattcaccatctaccagacgaacaacgcaaagaacacgctagtatctagacaaatgaaactagtcaggaacgacgccgaaggaccacggtctagtagttacttacgtggtacgagaaacgtaggtaactaggacaggacctaaggtccttaggggaacccgacccggtaacggttaacccgggg

SEQ ID NO: 119857 - DNA, 692 bp, Homo sapiens
  misc_feature: GYAE6OF01BRXWQ.2.38.D05.1.454.CMB.1.raw
  modified_base (321)..(321): a, c, t, g, unknown or other
  misc_feature (321)..(321): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccgccaagctccgaggggaaggggctgggtgtgggtctcacgttattaagtagtgagtgggagtagcacaagctacgcggactccgtgaagggccatcacatctcagacgacaacgccaagaacncgctagtatcctgacaaaatgaactagtctaggagacggccggaaggaccaggcttggtagttattacgtggtacgactaaaggagtatacgacgaagcgaaggtccgtacgggtaaccgcccggtaacgtaccgggtcgggggacccgaacggggtaaccccttcgggtacccgtaacccggttcctacccgtccgaaccggtcccctaccccgaaacccggaacccggggtacccccttacggttaccccggtttccccttaccccccgggtcggtcccccggtccccttccggtcccgttacccggacgggtacccgacccgtacccgtaccggaacgaccgcccgaacgacggcccgggtaccccgg

SEQ ID NO: 119858 - DNA, 531 bp, Homo sapiens
  misc_feature: GYAE6OF01AJHUM.2.38.D05.1.454.CMB.1.raw
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
  modified_base (524)..(524): a, c, t, g, unknown or other
  misc_feature (524)..(524): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccgaggggagggctggtgtgggtctcacgtattaatagtgagtgggagtagcacaagctacgcggactccgtgaaggccgattcacatctcagagacaacgcaaagacacgctagtatctagacaaatcgaaacagtctagagacgccgaggaccacggctgtagtattacngtnacaaganatagcagcagcgtaggaccgaccgacgtacgcggggcccaacggggaccccttgggtacccaccgttctccctncgtcccc

SEQ ID NO: 119859 - DNA, 504 bp, Homo sapiens
  misc_feature: GYAE6OF01D2U10.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctcgtggctccagctcagggacaacagtcacgttgaccatcgagtggagtccaggcagaagatgagctgactatactgtcaatcagcagacagcaggttggttacgttttgggtgttcgggcggtagggaccaaggcgtagacccgttctaggtccacggcccgaaggtcccg

SEQ ID NO: 119860 - DNA, 501 bp, Homo sapiens
  misc_feature: GYAE6OF01EK4AX.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaaagcaatatgcttatggtaccagcagaagccaggccaggcccctgtgctggtgatatataaagacagtgagaggccctgagggatcccgtgagcgattctctggctccagctcgagggacaacagtcacgttgaccatcagtggagtccgaggcaagaagagtggaggctgtactattactgtacaatcgagcagacagctagtggttacgttttgggtgttcgggcggaggaccagctgacccgtactacgtcacgccgaggtccg

SEQ ID NO: 119861 - DNA, 570 bp, Homo sapiens
  misc_feature: GYAE6OF01AR4V4.2.38.D05.1.454.CMB.1.raw
  modified_base (340)..(340): a, c, t, g, unknown or other
  misc_feature (340)..(340): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggagtagcacaagctacgcggactccgtgaagggccattcaccatctccagagacaacgccaaagaacacgctgtatctgacaaatgaacngtcagagacgccgaggacacgggctggtagtattactgtgacaagagatagacagcagcgtagggtacgccgaacgtacggtcggggaccaacgggacccgtcggtccaccgtcctcctcacgccctaccgaccgaccgggcccacgtccgtccttcccccgcggccctcccgtcgccgtccgacggcgcccgacccgccggacgacgaccaccgcggcccgggtcccgg

SEQ ID NO: 119862 - DNA, 749 bp, Homo sapiens
  misc_feature: GYAE6OF01CVI71.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagcccaccctcggtgtcagtcgtccccaggacagacggccaggatcacctgctcgtggagatgacattgaccaaaagcaatatgtacttattggtaccagacaagaagccaggccacggcccctggtcgcgtggtgataataataaagacagtgaagacggccctagagggtactcccgtaggacgtcgtactttcgtcgtacggcctaccgagtccgtacgaacgggaacaaacgagttaccgaacgttacgaaccctaagtccgaggtacgggacgtaccggaagggtaacgaagggaaacgtagtacgggaacgggtacgttaacggttaacttaagtttaaccgttacggtaacctaaacgttaccgaaacggtaccgaaaggaaccgaacggtacggttaaacgggtttaccggggtttttaacgggttttttccggggggttacggttacccgggggtaacgggggtaaacccgggggtaacccgtaaacggggttcccgggttaaccggttaacccgggttaccccggttaaacggggtacccgtaacccgggaccccgtaaaccggggttacccccg

SEQ ID NO: 119863 - DNA, 512 bp, Homo sapiens
  misc_feature: GYAE6OF01DMLM2.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagcaggccaggcccctgtgctggtgatataataaagacagtgagaggccctcaagggactccctgagcgtattctctggctcagctcgaggacaacagtcacgttcgaccatcagtggacgtcaggcagaagatgagctgacttattactgtacaatcgagtcagacagctaggttagttacgttttgggtgttcgggcggtaagggaccaagcgtcggaccgttcgtacggtcgacgtcccgaaggtcccg

SEQ ID NO: 119864 - DNA, 503 bp, Homo sapiens
  misc_feature: GYAE6OF01A7JYJ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggccccctgtgctggtgatatataaagacagtgagaggccctcagggatccctgagcgattctctggctccagctcagggacaacagtcacgttgaccatcagtggagtccaggcagaagatgagctgactattactgtcaatcagcagacagcaagtggttacttttggggtgttcgggcggtagggaccaaggctagacccgttcctagggtcacggccccgaaggtcccg

SEQ ID NO: 119865 - DNA, 532 bp, Homo sapiens
  misc_feature: GYAE6OF01BZQSC.2.38.D05.1.454.CMB.1.raw
  modified_base (332)..(332): a, c, t, g, unknown or other
  misc_feature (332)..(332): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagagccaggccaggcccctgtgctggtgatatataaagacagtgagaggccctgagggatccctgagcgattcnctggctccagctcgagggacaacgagtcacgttcgaccatccgaggtggagtccgaaggcaagaagatggaggctaggacttattactgtacaatcaagtcaagacagctaaggttggttacgttttgggtagttcgggacgggtagggaccaggccgtacggtaccgtaccgtaggttaccgacgcccgaaggtccccg

SEQ ID NO: 119866 - DNA, 541 bp, Homo sapiens
  misc_feature: GYAE6OF01BVNI7.2.38.D05.1.454.CMB.1.raw
  modified_base (505)..(505): a, c, t, g, unknown or other
  misc_feature (505)..(505): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccgattcaccatctccagagacaacgccaagacacgctgtatctgcaaatgaacagtctgagagccgaggacacggctgtgtattactgtgacaagagatagcagcagctggtacgccgactacgtcggggccgaacgggaaccctggtcctaccgtcctcctcacgccctccaccgacggcccagtccgtcctccccgtggccctcccgtgcctccgacggcnccaccgtccgacgacgaccacgcggcccggtcccgg

SEQ ID NO: 119867 - DNA, 498 bp, Homo sapiens
  misc_feature: GYAE6OF01A5OFG.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggccccctgtgctggtgatatataaagacagtgagaggccctcagggatccctgagcgattctctggctccagctcagggacaacagtcacgttgaccatcagtggagtccaggcagaagatgagctgactattactgtcaatcagcagacagcagtggttagttttgggtgttcgggcggtagggacaaggctgacccgttcgtacggtcacgcccgaaggtcccg

SEQ ID NO: 119868 - DNA, 523 bp, Homo sapiens
  misc_feature: GYAE6OF01C6MUP.2.38.D05.1.454.CMB.1.raw
  modified_base (415)..(415): a, c, t, g, unknown or other
  misc_feature (415)..(415): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttatggtaccagcagaagccaggccaggccccctgtgctggtgatatataaagacagtgagaggccctcagggatccctgagcgattctctggctccagctcgagggacaacagtcacgttgaccatcagtggagtccgaggcagaagatgagctgactatactgctaatnagcagacagcgagttggttaacgtttttggggtacgtttcgggacgggtagggacccgtaagccgttacggacccgttccgtagggtccaacggcccgaaaggtcccg

SEQ ID NO: 119869 - DNA, 534 bp, Homo sapiens
  misc_feature: GYAE6OF01AO12I.2.38.D05.1.454.CMB.1.raw
  modified_base (439)..(439): a, c, t, g, unknown or other
  misc_feature (439)..(439): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttatggtaccagcagaagccaggccaggcccctgtgctggtgatatataaagacagtagagaggccctcgagggactccctgacgcgattctcgtcggctccagctacgagggaacaacgtagtacacgttcgaccatcgaggtgggaacgtccgaaggtcaaggaagagtcggaggctagactattaactgtanaatcagcagacagctagtggttacttttggggtggttcggacgggtaggacgagcgtaggtaccgttcgtaggtacacggtcccgaagggtcccg

SEQ ID NO: 119870 - DNA, 545 bp, Homo sapiens
  misc_feature: GYAE6OF01D1PQP.2.38.D05.1.454.CMB.1.raw
  modified_base (431)..(431): a, c, t, g, unknown or other
  misc_feature (431)..(431): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctgagggatcctgagcgtattctctggctccagctcgagggacaacgagtaccacgttgacctatcgagtggacgtccgaaggcaaggaagataggaggtctagactattacgtgtacaancagcagacagctaggttcggttaacgtttttggggtcggttcgggacgggtaaggggaccgtaaggcgttacggacccgttacgtacggtaccaaccggcccgaagggtccccg

SEQ ID NO: 119871 - DNA, 500 bp, Homo sapiens
  misc_feature: GYAE6OF01BMAG8.2.38.D05.1.454.CMB.1.raw
  modified_base (484)..(484): a, c, t, g, unknown or other
  misc_feature (484)..(484): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggccccctgtgctggtgatatataaagacagtgagaggccctcagggatccctgagcgattctctggctccagctcagggacaacagtcacgttgaccatcagtgagtccaggcagagatgagctgactattactgtacaatcagtcagacagcagtggttactttttgggtgttcgggtcggagggaccaagcgtagaccgttccgtaggtanacgcccgaaggtcccg

SEQ ID NO: 119872 - DNA, 557 bp, Homo sapiens
  misc_feature: GYAE6OF01DFRTM.2.38.D05.1.454.CMB.1.raw
  modified_base (362)..(362): a, c, t, g, unknown or other
  misc_feature (362)..(362): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagacggccctcgagggatcccgtgagcgattctctggctccgagcctcgagggacaacngtcacgttgaccagtcagtggagtccgaggacagaagagtgaggctagacttattactgtacaatcagcagacgagctaggttcggtttaacgttttggggtggttacggggacgggtaagggacccgtaaaggtccgttacggtaaccccggttccggttaagggcccgtaaccggccccgtaaagggtccccg

SEQ ID NO: 119873 - DNA, 498 bp, Homo sapiens
  misc_feature: GYAE6OF01CZGLY.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagaagccaggccaggcccctgtgctggtgatatataaagacagtgagaggccctcagggactccctgagcgattctctggctccagctcagggacaacagtcacgttagaccatcagtggagtcaggcagaagatgaggctgactattactgtacaatcagcagacagctaggtggttacgttttgggtgttcgggcggagggaccagctggaccgtcgtaggtcgacgccgagtcccg

SEQ ID NO: 119874 - DNA, 508 bp, Homo sapiens
  misc_feature: GYAE6OF01D7YG3.2.38.D05.1.454.CMB.1.raw
  modified_base (376)..(376): a, c, t, g, unknown or other
  misc_feature (376)..(376): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
  modified_base (499)..(499): a, c, t, g, unknown or other
  misc_feature (499)..(499): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgcaagctccgaggggaaggggctgggtgtgggtctcgacgtattaatagtgatgggagtagcacaagctacgcggactccggngaacgggcattcaccatctcagacgacaacgccaagaacncgctagatcngacaatgaacngtcagagngccgaggacacggctagtgtattacgngtgacaaggnatagcagcagctggacnccgatacgg

SEQ ID NO: 119875 - DNA, 541 bp, Homo sapiens
  misc_feature: GYAE6OF01EB8YN.2.38.D05.1.454.CMB.1.raw
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccaggggaaggggctggtgtgggtctcacgtattaatagtgatgggatagcacaagctacgcggactccgtgaagggccgattcaccatctccagagacaacgccaagaacacgctgtatctgacaaatgaacagtctgagagccgaggacncggctgtgtattacngtgacaagagatagcagcagcgtggaccgccgacgtacggtcggggaccacgggaaccctggtccaccgtcctcctcacgccctccaccgaacggcccagtccgtcctccccgtggcccgccctcgcctcgaggcgccaccgtccgagacgaccacgcgccggtcccgg

SEQ ID NO: 119876 - DNA, 558 bp, Homo sapiens
  misc_feature: GYAE6OF01BUV1O.2.38.D05.1.454.CMB.1.raw
  modified_base (339)..(339): a, c, t, g, unknown or other
  misc_feature (339)..(339): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggagtagcacaagctacgcggactccgtgaagggccattcaccatctccagagacaacgccaagaacacgctgtatctgacaaatgaacngtctgagagccgaggacacggctgtgtattactgtgacaagagagtagcagcagcgtggtacgccgactacgtcggggaccgacgggacccgtcggtccaccgtctcctcacgccctccaccgacggcccacgtccggtcccttccccgtcggcccgtcccgtcgccgtccgacggcgacccgacccgtaccgacgacgaccaccgcggccggtcccgg

SEQ ID NO: 119877 - DNA, 519 bp, Homo sapiens
  misc_feature: GYAE6OF01AUGIS.2.38.D05.1.454.CMB.1.raw
  modified_base (329)..(329): a, c, t, g, unknown or other
  misc_feature (329)..(329): n is a, c, g, or t
  modified_base (355)..(355): a, c, t, g, unknown or other
  misc_feature (355)..(355): n is a, c, g, or t
  modified_base (388)..(388): a, c, t, g, unknown or other
  misc_feature (388)..(388): n is a, c, g, or t
  modified_base (473)..(473): a, c, t, g, unknown or other
  misc_feature (473)..(473): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgaggggaagggctggtggtgggtctnacgtattaatagtgatgggatagcanaagctacgcggactccgtgaacgggcattcacntctcagagacaacgccaaagacacgctgtaactctagacaaatgaacagtctggaagacgccggaggacacggctgtgtattacnggtagacaagtagaatgcagcagtctaggaccgccgaactaccggg

SEQ ID NO: 119878 - DNA, 573 bp, Homo sapiens
  misc_feature: GYAE6OF01BCRMM.2.38.D05.1.454.CMB.1.raw
  modified_base (461)..(461): a, c, t, g, unknown or other
  misc_feature (461)..(461): n is a, c, g, or t
  modified_base (496)..(496): a, c, t, g, unknown or other
  misc_feature (496)..(496): n is a, c, g, or t
  modified_base (554)..(554): a, c, t, g, unknown or other
  misc_feature (554)..(554): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtgggtcccgccaagctccgaggggaagggctggtgtgggtctcacgtataatagtgatgggagtagcaacaagctaacggcggactccggtagaacggggccattccacctatcctccaagacgacaaaccgccaaagaaccacgctagtatctagacaaatgaaactagtctaggagacgaccgaggacacggctggtatattacngtgacgaagagatagcagcaggcctagggtacccnccgtacgttacggcggggacccaacggggtaaccccttggggtaccctacccgttccncccgtacgccgtacccccg

SEQ ID NO: 119879 - DNA, 939 bp, Homo sapiens
  misc_feature: GYAE6OF01BCPOI.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgaccaaaagcaatatgtactttagttacggtaaccagacgaaaggaaccggcccgaacggggccccctacgggtcccccgttggtcggtacgttagggttagtaaaagttaaacgtaacgttaaaaggaaccgtaagggttaccgaacggaacggggtacccccgttacccgaacggggtaacgttacccccggtaggttaaccggtccggttaacgtttcccgttaccgtacgggtcccgttaccggaacggacccggttacggaaacgggtaactaaccgtacgtaccgttaaccggttacgtaaccgtacgttaccggtaagggtcggaaccggtaccggaacgggacggtaacggtaacgggtaacgtttaacggtaaggttaccgtttaacgtaaacgtttaaccccgtttaaagtaacgttaacctaaaccgttaacgtaaccgttaaccgttaaacgttaaccggttaacggtttaccggttaaagggttttacccgggggtttaaaccgggttttttaccgggggtaaaccgggtttacccggggtaaaccccggggttaaaccggggttaaccccgggtaaaccgggttacccggttaaacccccggggttaaacccccgggttaaccccggttaaacccccggggtaaacccggttaacccccgggtaaacccccgttaaacccgggtttaaccccccggg

SEQ ID NO: 119880 - DNA, 563 bp, Homo sapiens
  misc_feature: GYAE6OF01B3QBX.2.38.D05.1.454.CMB.1.raw
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (556)..(556): a, c, t, g, unknown or other
  misc_feature (556)..(556): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggaggcttagttcagccgtggggggtccctgagactctcctgtgcagcctctggattcaccttcagtagctactggatgcacgtgggtcccgccaagcctccgaaggggaaggggctgggtggtgggtctcgacgttattaagtagtgagtgggagtagcaacaagctacgcggactcgtgaacgggcatcacatcncaganacacgacaagaacacgctgtactctagacaaatcgaaactagtctaggaagacgccggaaggaccacgggcttggtagttaacttacgtggtagacgaaagacgaatgacagcgaggtcgtaggtaccgccgtagtacggcggggacccaggggtaccctgggtaccacccgtctccgtcncgtcccc

SEQ ID NO: 119881 - DNA, 850 bp, Homo sapiens
  misc_feature: GYAE6OF01D1U1E.2.38.D05.1.454.CMB.1.raw
  modified_base (182)..(182): a, c, t, g, unknown or other
  misc_feature (182)..(182): n is a, c, g, or t
tcagacgctcgacacacgaccggtgctcgatttagtatctgatagttggggtttgggggtgggtccaggaggccagaactctgggtgtctcaccatggcctgggactcctctacttctcccctcttcgactctctgcacaggctctgaggcctcctatgagctgacacagccaccctcggtntcagtcgtccccaggacagacggccaggatcgaccgtgctcgtggagatgcattcgaccaaagcaatactagtacttagttacggtaacctaagtacgtaagaacgaccgaacggacccgaaaccgggtcccccgttgggttaccgggtacccgtttaggggttacgtaaagtttaaacgttaaacgtaaaaacggtacgtaaggttacgggaacggtaacgggtaccccgtacggtaacggggtaaccttccccggtaggaacgtccggtaacgttttcgtacggttcggaccttaccgaggtaccttacgtaaacgggttaaacctaaccgtaacgttaccgtaacggtttacgaacctaacgttccggtaacggtacggggtaaccgtaacccggtaagggtacgtaaacggtaaacggtaagttaacgggtacggtaccgttacggtttaaaccgtttaacgttttaaccgttacgttaacccgttaaacgttaccgtaccgggttacgtaacggttaacggaaccgttacggttaaacgtttccgggtttaacgggtttttcggggacggtttaccggggtaccggggtaaggtaaccggtacggtacgtaccggtacccggtaccggttacggtaccgtacggtcccgtaacggttcccccg

SEQ ID NO: 119882 - DNA, 502 bp, Homo sapiens
  misc_feature: GYAE6OF01ARDRZ.2.38.D05.1.454.CMB.1.raw
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
  modified_base (472)..(472): a, c, t, g, unknown or other
  misc_feature (472)..(472): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccgccaagctccgagggagggctggtgtgggtctcacgtattaatagtgatgggagtagcacaagctacggcgactccgtgaacgggccgatcaccatccncagagacacgccaagacacgctgtatcngacaangaacngtacngagngccgaggcacgntgtgtatctgtnacgaagngatgcagcacgcgtaggacgccgtagtcgg

SEQ ID NO: 119883 - DNA, 586 bp, Homo sapiens
  misc_feature: GYAE6OF01D10LY.2.38.D05.1.454.CMB.1.raw
  modified_base (420)..(420): a, c, t, g, unknown or other
  misc_feature (420)..(420): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctatttaaaggtgtccagtgtgaggtgcagctggtggaggtccgggggaggcttagttcagccgtgggggtccctgagactctcctgtgcagcctctggattcaccttcagtagctacgtggatgcacgtggtccgcaagctccgagggaggcgtggtgtggtctcacgttattaatagtgagtgggatagcaacaagctacggcggacgtccgtagaacggcgattcgaccatcctaccaagacaacaacgccaaagaacncgtactgtactctagactaaaagtcgaaactgtactaggaacgacgacccggaaggacgtaccggcttagtagttaacttaccgtgggtacaacgtaaaggaagaagtaacggcaaaggcctaacgggtccgttagggtaaccccgccggtaaacgtacccggggg

SEQ ID NO: 119884 - DNA, 569 bp, Homo sapiens
  misc_feature: GYAE6OF01CRPME.2.38.D05.1.454.CMB.1.raw
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
tcagacgctcgacacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcactgggtcccgccaagctccgagggaaggggctggtgtgggtctcacgtattaatagtgagtgggatagcacaagctacgcggactccgtgaaggccgattcacatcnccagagacaacgccaaagaacacgctgtatctgacaaatgaacngtctgagagccgaggacacggctgtgtattacngtagcaagngatagcagcagcgtggtacgccgactacgtcggggaccagggaccctggtccaccgtctcctacacgccctaccgaccgaacgggcccacgttccggtcccttcccccgtcggcccgtccccgtcgcccgtccgacgggtacgcccgtacccgtaccgagacgccaaccgcggcccgggtccccg

SEQ ID NO: 119885 - DNA, 537 bp, Homo sapiens
  misc_feature: GYAE6OF01AWL2O.2.38.D05.1.454.CMB.1.raw
  modified_base (343)..(343): a, c, t, g, unknown or other
  misc_feature (343)..(343): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccaggggaaggggctgggtgtgggtctcacgtattaatagtgatgggagtagcacaagctacgcggactccgtgaagggccattcaccatctccagagacaacgccaagaacacgctgtatctgcaaatgaacagtcngagagccgaggacacggctgtgtattactggtgcaaggagatagcagcagctggtacgccgactacgtgggccgagggaccctggtccacgtcctcctcacgtccctccaccgaacggcccacgtccggtccttccccgtcggccgccctgcctccgacggcgccaccctccggagacgcacgcggccggcccg

SEQ ID NO: 119886 - DNA, 641 bp, Homo sapiens
  misc_feature: GYAE6OF01DAYJU.2.38.D05.1.454.CMB.1.raw
  modified_base (370)..(370): a, c, t, g, unknown or other
  misc_feature (370)..(370): n is a, c, g, or t
tcagacgctcgacacacgaccggtgctcgatttagtatctgatagttgggtttgggggtgggtccaggaggcagaactctgggtgtctcaccatggcctggattcctctacttctccccctcttcactctctgcacaggctctgaggcctcctatgagctgacacagccaccctcggtgtcagtgtccccaggacagacggccaggatccacctgctctggagatgcattgaccaaaagcaatatgcttatggtaccagcagaagccaggccaggcccctgtgctggtgatatataaagcagtgagtagccctgacgggatcccgtagagcgtattctcgtggtctccaggcctcgaggggaaccaacgnggtacacgtttacgaccataccgtaggtcggaacgttccgaagggaccgaaggaaaggagtacgggaggtaccttaggtaacgttaatttaaccgttaggtaacctaaacttccgaagcgaagaacaacgtccgaaggtttcgggttttaacgtttttggggttcggtttcggggaacgggaggggtaacccgtaaagggtcccgtttaacgggaccccggtttaccgtaacgggttaccaaccgggtacccccggtaagggttcccccgg

SEQ ID NO: 119887 - DNA, 540 bp, Homo sapiens
  misc_feature: GYAE6OF01A669F.2.38.D05.1.454.CMB.1.raw
  modified_base (297)..(297): a, c, t, g, unknown or other
  misc_feature (297)..(297): n is a, c, g, or t
  modified_base (374)..(374): a, c, t, g, unknown or other
  misc_feature (374)..(374): n is a, c, g, or t
  modified_base (441)..(441): a, c, t, g, unknown or other
  misc_feature (441)..(441): n is a, c, g, or t
  modified_base (482)..(482): a, c, t, g, unknown or other
  misc_feature (482)..(482): n is a, c, g, or t
  modified_base (529)..(529): a, c, t, g, unknown or other
  misc_feature (529)..(529): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggagtagcacaagctacgcggactccgtgaagggccgattcaccatcnccagagacaacgccaagaacacgctgtatctgacaaaatgaacagtctgagagccgaggacacggctgtgtattacngtgacaagagatagcagcagcgtggtacgccgactacgtgggccagggaccctggtccacgtcctcncacgccctccaccgacgggcccactccggtcccttccccgnggcccgcccgtcgcctccgaggcgcccacccgtccgacgacgcacgnggccggtcccg

SEQ ID NO: 119888 - DNA, 549 bp, Homo sapiens
  misc_feature: GYAE6OF01CB8PM.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattgtaccagcagaagccaggccaggcccctgtgctggtgatatataaagacagtgagaggccctcgagggactcccgtgagcgattctctggctccagctacgagggacaacgagtctacgttgacctatcgagtgggacgtccgaggaccaaggaagagtggaggctaggacttaattacgtgtacaatcagtcaagacagctaaggttcggttacgtttttggggtcgttcgggacgggacgggtaaccaggtccgtaggacccggttccgtacgggtaccacggtcccgaaagggtcccg

SEQ ID NO: 119889 - DNA, 518 bp, Homo sapiens
  misc_feature: GYAE6OF01DZDAE.2.38.D05.1.454.CMB.1.raw
  modified_base (323)..(323): a, c, t, g, unknown or other
  misc_feature (323)..(323): n is a, c, g, or t
  modified_base (339)..(339): a, c, t, g, unknown or other
  misc_feature (339)..(339): n is a, c, g, or t
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
  modified_base (504)..(504): a, c, t, g, unknown or other
  misc_feature (504)..(504): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattccaccttcagtagctactggatgcactgggtccgccaagctccgagggaaggggctggtgtgggtctcacgtattaatagtgatgggagtagcanaagctacgcgactcgngaaggccatcacatctcagagacaacgcaagaacacgctgtatctgacaaatgaaacngtactgagacgccgagacgcggntggtntattacngtcgacaagngatagacagcagcgtggtaccgccgactacgcgggcccaagggaccctggtccaaccgttcncctcgcgtaccccg

SEQ ID NO: 119890 - DNA, 525 bp, Homo sapiens
  misc_feature: GYAE6OF01CWP9A.2.38.D05.1.454.CMB.1.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (376)..(376): a, c, t, g, unknown or other
  misc_feature (376)..(376): n is a, c, g, or t
  modified_base (514)..(514): a, c, t, g, unknown or other
  misc_feature (514)..(514): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtggggggtccctgagactctcctgtgcagcctctggattcaccttnagtagctactggatgcactgggtccnccaagctccgagggaagggctggtgtgggtctcacgtattaatagtgagtgggagtagcaacaagctacggcggactccgngaagggccgatcacatctacagacgacaacgccaaagaaccacgctgtatctagacaaatgaacagtctagaagagaccgaggacacggtctgtagttattacgtgtagacgaagagaatagcaagccagctaggacnccgaatacggg

SEQ ID NO: 119891 - DNA, 630 bp, Homo sapiens
  misc_feature: GYAE6OF01CHN3U.2.38.D05.1.454.CMB.1.raw
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggatcacctgctctggagatgctattgaccaaagcaatatgcttagttcggtaccagcaaggaacgccgaggcccacggcccctgtcgcgtggtnataataataaagacagtggaagacgccctagagggtactcccgngacgcgtacttcgtcgtcggtctaccgagccgtacgaagggaaccaacgtagtaccgtacgttacgaacctagtccgtaggtacgggtcgtaccgaagggtacaaggaacgtagttaggacggtcgtacggtaacttaagtttaccgtgtaaacctaacgttacgaacgtacgagacgtacgacgttagttcgggtttcgttttaggggtcggttaccgggacggttaggacctacggtacgtacggtaccgttaccgacggtacgtacggcccgtaagggtccccg

SEQ ID NO: 119892 - DNA, 520 bp, Homo sapiens
  misc_feature: GYAE6OF01EX5FM.2.38.D05.1.454.CMB.1.raw
  modified_base (479)..(479): a, c, t, g, unknown or other
  misc_feature (479)..(479): n is a, c, g, or t
  modified_base (484)..(484): a, c, t, g, unknown or other
  misc_feature (484)..(484): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccaggggaaggggctggtgtgggtctcacgtattaatagtgatgggagtagcacaagctacgcggactccgtgaagggccgattcaccatctccagagacaacgccaaagaacacgctgtatctgacaaatgaacagtctgagagccgaggacacggctgtgtattactgtgacaagagatagcagcagctggtacgccgactacgtggggccagggtaccctggtaccaccgtctcctcacgcctccaccgacggcccagtccgtcctccccnggccncctgctccgagcgcaccncgagacncacngccgccg

SEQ ID NO: 119893 - DNA, 667 bp, Homo sapiens
  misc_feature: GYAE6OF01CS2Z6.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggagtagcacaagctacgcggactcggtagaagggccgattcaccatctccagagacaacgccaagaacacgctgtactctgacaaatgaacagtctgagacgccgaggacacggctgtagtattactggtgacaagagagtagcagcagctacggtacgacccgtacgtaacgtcggggaccgaacggggaacccgtcggtaccaacccggttcctcccgttaccgaccggtaccccgttaccccgaacccggaaaccggggtccccctaacggttccccgggttaccccgttttcccccccggtcggggtccccggcccccgttccggtcccgttaccccgacgggtaccgaccccgaacccccgttcccgggaacggaacggacccaacccggtccggcccggggtacccccggg

SEQ ID NO: 119894 - DNA, 551 bp, Homo sapiens
  misc_feature: GYAE6OF01CKVYP.2.38.D05.1.454.CMB.1.raw
  modified_base (362)..(362): a, c, t, g, unknown or other
  misc_feature (362)..(362): n is a, c, g, or t
  modified_base (408)..(408): a, c, t, g, unknown or other
  misc_feature (408)..(408): n is a, c, g, or t
  modified_base (462)..(462): a, c, t, g, unknown or other
  misc_feature (462)..(462): n is a, c, g, or t
  modified_base (488)..(488): a, c, t, g, unknown or other
  misc_feature (488)..(488): n is a, c, g, or t
  modified_base (501)..(501): a, c, t, g, unknown or other
  misc_feature (501)..(501): n is a, c, g, or t
  modified_base (542)..(542): a, c, t, g, unknown or other
  misc_feature (542)..(542): n is a, c, g, or t
tcagacgctcgacacacgaccggtgctcgatttagtatctgatagttgggtttggggggaagaggaagactgacggtcctgccacaggtggtgctgggcacggtgggcactcgacacaacattttgcgctcaactgtcttgtccagtgtgaggtgcagctggtggagtccgggggagcttagttcagcctggggggtccctgagactctcctgtgcagcctctggattcacctttcagtagctactggatgcactgggtccgccaagctccgagggaaggggctggtgtgggtctcacgtatttaatagtgatgggagtagcacaagctacgcggactccggtgaagggccattcaccatcnccagagacaacgccaaagaccacgctgtatctagacaaatgaaacngtctagagagaccgaggaccacggcttggtgtaactttacgtgtagacaaaggngaagtagacagcagtctacgggaccnccggtactacggnggggacccgacgggtaaccctggtaccctaccgtctccctnacgtccccg

SEQ ID NO: 119895 - DNA, 742 bp, Homo sapiens
  misc_feature: GYAE6OF01CJLH7.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggatcacctgctctggagatgcattcgaccaaagcaatatgcttattggtaccagcagaagccaggccacggcccctgtgctggtgatataataaagacagtgagacggccctgagggactccgtagacgcgtattcgtcgtggctccgagccttacgaacgggtaacaaacgtacgtacctaacggtttacgaacctaagtacgtaacggtacgggtaacggttacccgaagggaccaaagggtaaacgagttacgggaaggtacgttacggtaaacgtttaacgtttaacctaggttaacctaaagttacccaaacgggtaccaaacgggaacctaacgggtacgttaacgggtttacgggtttttaacccgggttttttttggggggtaccgggtttttacccgggggaaccgggggttaaacgggggttaaaccccgtaaacggggttcccgttaaaccggggttaacccccggtttaccggttaacggggttacccgtaaccgggtaccccccggtaaacggggttacccccg

SEQ ID NO: 119896 - DNA, 585 bp, Homo sapiens
  misc_feature: GYAE6OF01DST6R.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagaagccaggccaggcccctgtgcgtggtgatataataaagacagtgagacggccctgagggactcccgtggacgcgtattctcgtcggctccagcctcgagggaacaacgagtctacgttcgaaccatcagtcggagtccgagggacaaggaagagtaggaggactggtaacttagtttactcgttacaagtcaagtcaagtacagtacgtaggttcggtttacggtttttggggtcggtttcggggacgggtaacgggaaccgtaggtaccgtacggtacccggttaccggtacgggtaccaccgggacccgtaacggtccccg

SEQ ID NO: 119897 - DNA, 651 bp, Homo sapiens
  misc_feature: GYAE6OF01AGAGR.2.38.D05.1.454.CMB.1.raw
  modified_base (490)..(490): a, c, t, g, unknown or other
  misc_feature (490)..(490): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcaggccgtggggggtccctgagactctcctgtgcagcctctggtacttccaccttcgagtacgctacgtggatcgcacgtcgggtcccgaccaacgccgtaccgaggggaacggggtcgtgggtggtcgggtctcgtacgttattaacgtaggtgagtgggagtacgacacgaacgcgtacgcgtactcggtgaacgggctagtcacctatcctacgaagacgaaccaacgaccaaagaaccacgtctaggtactcgagaacaagtcgaacnggttcagggaacgacggaccggaaggaccgacgggtcttagggtacgtttaacttcggtaggttacggaacgtaaaggtacgtaaagttacgaccggaaaggtccggaacggttaccgggttaccgggaaccccggtccggtaaaccggttacccgggggg

SEQ ID NO: 119898 - DNA, 683 bp, Homo sapiens
  misc_feature: GYAE6OF01DX2K5.2.38.D05.1.454.CMB.1.raw
  modified_base (200)..(200): a, c, t, g, unknown or other
  misc_feature (200)..(200): n is a, c, g, or t
  modified_base (393)..(393): a, c, t, g, unknown or other
  misc_feature (393)..(393): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccnccaagctccgagggaagggctggtgtggtctcacgtattaatagtgatgggagtagcacaagctacgcggactccgtagaagggccaattcaccatctcagagacaacgacaaagaacacgctgtatctgacaaatgaacagtctagagacgccgaggacacggtctgtagttattacgtggtcgacgaaagngtaatacgacgagcgaagtcgtacgggtaaccgcccgtaacgtacgggtcggggacccgaacggggtaaccccttgggtaccctacccggtaccttccaccggtacgaccccccgtacctaaaccggaacccggggtccccttaaggttacccgggttccccctttccccgggacggtccccgtaccccgttcgggaaccccttcccgggaaacggcccggtcccgtaaaccccggttacccgggagtacccggacccaacccggtaccgggccccggttacccccgggg

SEQ ID NO: 119899 - DNA, 518 bp, Homo sapiens
  misc_feature: GYAE6OF01ARC7O.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagcttagttcagcctggggggtccctgagactctcctgtgcagcctctggattcaccttcagtagctactggatgcactgggtccgccaagctccagggaagggctggtgtgggtctcacgtattaatagtgatgggatagcacaagctacgcggactcgtgagggccgattcacatctccagagacaacgccaaagaaccacgctagtatctgacaaatgaacagtctagagacgccgaggacacggctgtgtattactgtgacaagagatagcagcagctggtaccgccgactacgtggggcccacgggaccctcgggtccaccgtcctcctcgacgtccccg

SEQ ID NO: 119900 - DNA, 659 bp, Homo sapiens
  misc_feature: GYAE6OF01DEIXV.2.38.D05.1.454.CMB.1.raw
  modified_base (303)..(303): a, c, t, g, unknown or other
  misc_feature (303)..(303): n is a, c, g, or t
  modified_base (588)..(588): a, c, t, g, unknown or other
  misc_feature (588)..(588): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcgttgggttttccttgttgcttaattttaaaaggtgtccagtgtgaggtgcagcgtggtggaggtccggggagtcttagtcagccgtgggggtccctgagactctcctgtgcagcctctggacttcaccttcagtagctacgtggatcgcacgtcgggtccncaagcctaccggaggggaacgggcgtgggtggtgggtctacgtaacgttaattaagtaggtgagttacgggagtagacaaacgaacgtcgtaacggcggaccgtccggtaggaacgggtcctaacttccaaccgtatccctacccgaaggtaaccgaaaccaaaccggaccctaaaagaacccgaacgtcgttacgtaacgttcctagaacctaaaagttcgaaactcgttcgtaaggaacgtacggacccggtagaccgtacggtcttaggtagttaacttcgngtgaacgtaaaggagtaactcggactaaggaccaggtaccgttgggaaacccgtccgtaaacgtaccgggg

SEQ ID NO: 119901 - DNA, 594 bp, Homo sapiens
  misc_feature: GYAE6OF01E1KSJ.2.38.D05.1.454.CMB.1.raw
  modified_base (297)..(297): a, c, t, g, unknown or other
  misc_feature (297)..(297): n is a, c, g, or t
  modified_base (340)..(340): a, c, t, g, unknown or other
  misc_feature (340)..(340): n is a, c, g, or t
  modified_base (379)..(379): a, c, t, g, unknown or other
  misc_feature (379)..(379): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggccctgagactctcctgtgcagcctctggattcaccttcagtagctactggatgcacgtgggtccgccaagctccgaggggaagggctggtgtgggtctcacgtattaatagtgatgggagtagcacaagctacgcggactccgtgaagggccattcaccatcnccagagacaacgccaagaacacgctgtatctgacaaatgaacngtctaggagagccgaggacacggctgtgtattacgtgtnacaagagatagcagcagctaggaccgccgaactacggtcggggaccacgggaaccctggtacccaccgttctccgtcacgtccctacccgaaccgaacgggcccctaagttcccggttcccttcccccggtcgggccccgtccccgtggcccttacccgagggaccgcccgtaacccgtcccggaacgacggaccaaccggcggcccggtcccgg

SEQ ID NO: 119902 - DNA, 577 bp, Homo sapiens
  misc_feature: GYAE6OF01BONC7.2.38.D05.1.454.CMB.1.raw
  modified_base (514)..(514): a, c, t, g, unknown or other
  misc_feature (514)..(514): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaaagaacacgctgtatctgacaaaatgaaacagtctgagacgccggaaggacacggctggtgtattacgtgtgacaagagatagcagcagctagggtacgccgaacgtacgtcggggacccgacgggtaaccctgggtacccaccggttcctcctcacgccctacccgaaccgacgggccccagttcccggtcccttcccccgnggccgtcccctgccctccgaggccgcctacccgtccgacgacgaccacgcgccgggtccccgg

SEQ ID NO: 119903 - DNA, 764 bp, Homo sapiens
  misc_feature: GYAE6OF01ADN0C.2.38.D05.1.454.CMB.1.raw
  modified_base (334)..(334): a, c, t, g, unknown or other
  misc_feature (334)..(334): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagtcgttgggtttttccttgttgtcttaagttttaaaaggtgtccagtgtgaggtgcagctggtggaggtccgggggaggtcttagttcgacggtccggtcggggggttccctggacgtaccttcctcctggtcgcacgtccctcgtggtacttcctacccttcagtacgctacgtggatgcacgtcgggtcccnccgaacgccgtccggaggggaacgggtcgttgggtcggttgggtcctacgtaacgttaagttaagtaggttgagtggggtaagtacggacaacgtaacgtaccgtaccggccggtaaccgttcccgggtaggaaacgggtcccgtaacgttcccgaacctacgttacccgtaccgaaaggtaaccgaaccgaaacccggacccaaaacggaacccacggttaccgtagttaaccttccgtagaaccgtaaagtacgaactacggttcgtaaggaacggaccggacccgggaaagggacccgtacgggttacgttaggttacggtttaacttacggttacggtagaacggtaaaggtacgaagtacgaccgaagtccggtaaggtcccgggttaacgggccccgtaacccgggttacgtaaccccgggggg

SEQ ID NO: 119904 - DNA, 572 bp, Homo sapiens
  misc_feature: GYAE6OF01B1FQ2.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcgagggactcccgtgagcgattctcgtggcctccgagctcgagggacaacgagtcacgttcgacctatcgagtggacgtccgaggacaaggaagagtaggaggtctaggtaacttaatttaaccgtgtacaaattccaagtacaagacaggacgtaggttgggtttaacgtttttggggtaggtttcgggacggggtaagggaccgtaaagccgttacggacccggttccgtacggtacgacgacccgtaaaggtccccg

SEQ ID NO: 119905 - DNA, 531 bp, Homo sapiens
  misc_feature: GYAE6OF01DOOTM.2.38.D05.1.454.CMB.1.raw
  modified_base (338)..(338): a, c, t, g, unknown or other
  misc_feature (338)..(338): n is a, c, g, or t
  modified_base (401)..(401): a, c, t, g, unknown or other
  misc_feature (401)..(401): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcaagaagccaggccacggcccctgtgctggtgatataataaagacagtgagacggccctcgagggactcctgagcgattcnctggctccagctacgagggacaactagtcacgttgaccatcgagtcggatccgaggcagaagntggagctgactattacagtacaatcagacagacagctaggttcgtttacgttttgggtacgttcgggcggtagggaacctaaggtccgtaggaccccgttcgtacggtacaacggtcccgaaggtccccg

SEQ ID NO: 119906 - DNA, 551 bp, Homo sapiens
  misc_feature: GYAE6OF01BMST1.2.38.D05.1.454.CMB.1.raw
  modified_base (313)..(313): a, c, t, g, unknown or other
  misc_feature (313)..(313): n is a, c, g, or t
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
  modified_base (432)..(432): a, c, t, g, unknown or other
  misc_feature (432)..(432): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctnagggatccctgagcgattctctggctccagctcgagggacaacgagtcacgttcaccatcagtgacgtccgaggcagaagntaggaggctgactattacgngtacaatcagcagacagngagttggttacgtttttggggtacgtttcggggacgggtacggggtaaccgaacggtccgtacggtaaccccggttccggttaacgggtaccgaacggtacccccggaagggtcccccg

SEQ ID NO: 119907 - DNA, 546 bp, Homo sapiens
  misc_feature: GYAE6OF01BXPD4.2.38.D05.1.454.CMB.1.raw
  modified_base (337)..(337): a, c, t, g, unknown or other
  misc_feature (337)..(337): n is a, c, g, or t
  modified_base (442)..(442): a, c, t, g, unknown or other
  misc_feature (442)..(442): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtatcacaagctacgcggactccgtgaagggccattcaccatctccagagacaacgccaagaacacgctgtatctgcaaatgaacngtctgagagccgaggacacgggctgtgtaattctgtgacaagagatagcagcagctggtacgccgactacgtcggggaccacgggaccctggtccaccgtctccncacgccctccgaccgaacgggccccagtcccggtccttcccccgtggcccgcccgtgcctccgaggccgccacccgtccggagacgaccacgcggccggtcccg

SEQ ID NO: 119908 - DNA, 568 bp, Homo sapiens
  misc_feature: GYAE6OF01C6V99.2.38.D05.1.454.CMB.1.raw
  modified_base (198)..(198): a, c, t, g, unknown or other
  misc_feature (198)..(198): n is a, c, g, or t
  modified_base (341)..(341): a, c, t, g, unknown or other
  misc_feature (341)..(341): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccnccaagctccagggaaggggctggtgtgggtctcacgtattaatagtgatgggagtagcacaagctacgcggactccgtgaacgggccgattcaccatctccagagacaacgccaagaacacgctgtatctgacaaatgaaacngtctgagagaccgaggacacggctgtgtattacngtagcaagngaatagcagcagcgtggtacgaccgacgtacgtcggggacccaacgggaccctggtccaccgttcctccctcacgccctaccgaccgaacgggccctagtcccgtccttcccccgtggcccgtcccctcgccctccgacggcgcccgacccttcccggacgacgcacgtacggccgggtccccg

SEQ ID NO: 119909 - DNA, 651 bp, Homo sapiens
  misc_feature: GYAE6OF01B26DP.2.38.D05.1.454.CMB.1.raw
  modified_base (429)..(429): a, c, t, g, unknown or other
  misc_feature (429)..(429): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtcccaggacagacggccaggatcacctgctcgtggagtatgcattgaccaaaagcaaatatgtacttagttcggtaccagacaagaacgccaggaccacggcccctggtcgcgtggtgaataataaataaagacagtagaagaacggccctagacgggtactcccgtggacgtcgtacttctcgtggcctacgagtccgtacgaagggaaccaacgtacgttccgtaacgttccgaacccgtanacgtaggtcggtacgtaccggaaggacaaaggaagtagtaggacggtactacgttaacttagttaaccgttgtaacgaaacttccgaagtaccgaaggaacagtacggtaaggtttcgggttttagttttcgggggtacggtacccgggtacgggaaggtaccgaaacggtcgtacggttaccgtaccggttaggaccgaccggaaccgtcggtacccccgg

SEQ ID NO: 119910 - DNA, 638 bp, Homo sapiens
  misc_feature: GYAE6OF01D0PUB.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgcttaattttaaaaggtgtccagtgtgaggtgcagctggtgggaggtccgggggaggtcttagttcagccgtgggggtccctgagactctcctgtgcagcctgtggtacttccaccttcagtagctacgtggatgcacgtcgggtcccgaccaagccgtaccggaaggggacggggtcgtgggtggttgggtcctacgtaacgttaattaagtagtgagtgggagtagacacgaagcgtacggcggtactccggtaggaacgggcctacttaccacctactcctaccaaggaacgaaccaaccgaccaaagaacacgtactagtatctagaactaaatcgaaactgtacgtaggacgacggccggtaaggaccgtacgggtcttaggtagttaacgttcgtggtacgacgtaaagagtagtacggacgtagtaccgaggttaccggtacgggtaaccccgtccggtaacgtaacccggggg

SEQ ID NO: 119911 - DNA, 547 bp, Homo sapiens
  misc_feature: GYAE6OF01C7X4X.2.38.D05.1.454.CMB.1.raw
  modified_base (372)..(372): a, c, t, g, unknown or other
  misc_feature (372)..(372): n is a, c, g, or t
  modified_base (481)..(481): a, c, t, g, unknown or other
  misc_feature (481)..(481): n is a, c, g, or t
  modified_base (509)..(509): a, c, t, g, unknown or other
  misc_feature (509)..(509): n is a, c, g, or t
  modified_base (532)..(532): a, c, t, g, unknown or other
  misc_feature (532)..(532): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccgattcaccatctccagagacaacgccaaagaacacgctgtatctgacaaatgaacagtctgagagccgaggacacggctgtgtattacngtgcaagagaatagcagcaagcgtggtacgccgactacgtggggccacggaccctggtcaccgtctcctcacgcctccaccaacgggcccagtccggtccttcccccgnggcccgccctcgccctccgacgggaccnccacccgtccgacgacgccaacncggccggtaccccgg

SEQ ID NO: 119912 - DNA, 657 bp, Homo sapiens
  misc_feature: GYAE6OF01EKXN6.2.38.D05.1.454.CMB.1.raw
  modified_base (288)..(288): a, c, t, g, unknown or other
  misc_feature (288)..(288): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaaatatgcttattggtaccagcagaagccaggccaggcccctgtgctggtnatataataaagacagtagaggacggccctacgaagggactcccgtgacgcgtattctctggtcctccgagcctacggaggggtacaaacgagtaccgtacgtttacgaaccctaatccgtaggtagggacgtaccgaagggacgaaaggaaagtagtagggaacggtcgtaggaactttaatttaacgtacggtaacctaaagttaccgaagtaccaaggacaaggtaccgtaagggtttacgggtttacggttttttggggtacggttttaccggggacggggtaaacggggaaccctaaagggtcccgttacggtaaccccggttaccgttacgggtaccgaaccggtaccccgaaagggtcccccg

SEQ ID NO: 119913 - DNA, 493 bp, Homo sapiens
  misc_feature: GYAE6OF01ASL2I.2.38.D05.1.454.CMB.1.raw
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagagccctcagggatccctgagcgattctctggctccagctcagggacaacagtcacgttgacatcagtggagtccaggcagaagangagcngactattacngtcaatcagcagacagcagtgtacgttttgggtgttcgggcggtagggaccagtcgtgaccggttctaggtcacgcccgaaggtcccg

SEQ ID NO: 119914 - DNA, 781 bp, Homo sapiens
  misc_feature: GYAE6OF01D5NZ5.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacgagacgcgagactcactcgctcgtggaagtatcgactagttcgaaccaaagactaaatagtcgtactttagttacggtaccagacgaagaacgaccgacggaccgaccggtccccgtggtcgtcggtaggtagtaattaagtaaagtaaacgaacgtaggtaggaacggaccggtacccgtacggaacgggtaccttaccgtaggacgtacgttactttcgtcgtcgtccctaccgacgtcgtacggaacggtaaacctaacggtacgttaccgttaccggttacgaacctaacgtacggtacgggttacgggtacccgtacggaacggacgaaaaggtaagtaggtacggacggtactacgtaacttaatttacgtacgtaactaacgtcgaacgaacgtaacggaacgtaacggtacggttaagggttttacgggtttttacggggtttttcggggtacggggttacccggggtaacgggggtaaacggaacccggttaaacggtcccggttacccgggttaaccccggttacccgggttaaacgggtaccccgtaaccgggtaaccccgtaagggttcccccgg

SEQ ID NO: 119915 - DNA, 506 bp, Homo sapiens
  misc_feature: GYAE6OF01A7JQB.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctagagggactccctgagcgattctctggctccagctcgaggtacaacagtcacgttgaccatcagtggagtccgaggcagagatgagctagacttattactgtacaatcagtcagacagctaggtggttacgttttgggtcgttcgggcggtagggaccagacgtgaccgtcgtaggtcacgcccgaggtcccg

SEQ ID NO: 119916 - DNA, 604 bp, Homo sapiens
  misc_feature: GYAE6OF01BBB8K.2.38.D05.1.454.CMB.1.raw
  modified_base (255)..(255): a, c, t, g, unknown or other
  misc_feature (255)..(255): n is a, c, g, or t
  modified_base (295)..(295): a, c, t, g, unknown or other
  misc_feature (295)..(295): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggagcttagttcagccgtggggggtccctgagactctcctgtgcagcctntggattcaccttcagtagctactggatgcacgtgggtccnccaagctccgagggagggctgggtgtgggtctcgtacgtattaagtagtgagtgggagtagacaacgaagcgtacgcggactccggtagaacgggccgattcactatctccgagacgacaacgccaaagacacgactgatctagacaaatcgaactagtccgtagagacgaccggtaggaccgacggcttaggtgttaagttaccgtgggtacaaaccggtaaggtaaggtaacggtcggacgtacggaccgttaacgggacccggttaccggggtaacccgaccccgggttaacggttaacccggggg

SEQ ID NO: 119917 - DNA, 527 bp, Homo sapiens
  misc_feature: GYAE6OF01A1J4A.2.38.D05.1.454.CMB.1.raw
  modified_base (262)..(262): a, c, t, g, unknown or other
  misc_feature (262)..(262): n is a, c, g, or t
  modified_base (416)..(416): a, c, t, g, unknown or other
  misc_feature (416)..(416): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaanccaggccaggcccctgtgctggtgatatataaagacagtgagacggccctcgagggactccctggacgcgtattctcgtggcctcagctacgagggacaacagtcacgttgaccatcagtggacgtcaggcagaagatggagctgactattacngtacaatcagcagacagctaggtggtttacgtttgggtcggttcggcgggtaggacctaaggccgtaggaccccggttcgtaacgggtacaccgtacccggaaggtccccg

SEQ ID NO: 119918 - DNA, 587 bp, Homo sapiens
  misc_feature: GYAE6OF01A88JS.2.38.D05.1.454.CMB.1.raw
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (374)..(374): a, c, t, g, unknown or other
  misc_feature (374)..(374): n is a, c, g, or t
  modified_base (387)..(387): a, c, t, g, unknown or other
  misc_feature (387)..(387): n is a, c, g, or t
  modified_base (550)..(550): a, c, t, g, unknown or other
  misc_feature (550)..(550): n is a, c, g, or t
  modified_base (559)..(559): a, c, t, g, unknown or other
  misc_feature (559)..(559): n is a, c, g, or t
tcagacgctcgacacacgaccggtgctcgatttagtatctgatagctgggttttccttgttgctattttaaaaggtgtccagtgtgaggtgcagctgggtggaggtccgggggaggcttagttcagcctggggggtccctgagactctcctgtgcagcctctggattcaccttcagtagctactggatgcactgggtccgccaagctccgagggaagggctggtgtgggtctcagttattaatagtgatgggagtagcanaagctacgcggactccgngaaggccattcacatctccagagacaacgccaaagacagctgtatctgacaaatgaacagtctggagacgcgaggacacggctagtgtaattacgngtagactaagganagtagcgagcaggtcgtacgggtacgcccggtaactacgtcggggcccaacggggtaacccctgggtaccaccggtcccttccgtaccgacgtcccgtacccgaacccggaacgggccctaacgtccggtcccttccccgtgcccgtccctgcctcgacggcnccgtacccnccgagacgaccacgcgggccggtcccgg

SEQ ID NO: 119919 - DNA, 533 bp, Homo sapiens
  misc_feature: GYAE6OF01DR143.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgtcttattggtaccagcagaagccaggccaggcccctgtgctggtgatatataaagacagtgagacggccctgagggactcccgtgagcgtattctctggctccagctcgagggacaacagtcacgttgaccatcagtggagtccaggacaggaagagtggaggctgactattacgtgtacaatcagcagacgagctaggttaggttacgtttttgggtggttcggggacggtaagggaaccgaaggtccgtaggacccgttacgtacggtccaacggcccgaaggtcccg

SEQ ID NO: 119920 - DNA, 532 bp, Homo sapiens
  misc_feature: GYAE6OF01AM5KK.2.38.D05.1.454.CMB.1.raw
  modified_base (420)..(420): a, c, t, g, unknown or other
  misc_feature (420)..(420): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcgagggactcccgtgagcgattctctggctccgagctcgagggacaacgagtcacggttcgaccatcgagtggagtccgaggcaagaagatggagctgactattacgngttacaatcgagcgaagacagcaaggttggttacgttttgggtcggttacgggcgggtaggaccgaggccgtagaccccgttcgtaacggtcacggtcccgaagggtccccg

SEQ ID NO: 119921 - DNA, 521 bp, Homo sapiens
  misc_feature: GYAE6OF01BCJP5.2.38.D05.1.454.CMB.1.raw
tcagacgctcgacacacgaccggtgctcgatttagtatctgatagttgggtttgggggtggatccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattgccaaagcaatatgcttattggtaccagcagaagccaggccaggcccctgtgctggtgatatataaagacagtgagaggccctcagggatcccgtgagcgattctctggctccagctcgaggacacagtcacgttgaaccatcgagtggacgtccaggcagaagatgaggctagactattacgtgtacaatcgagcagacgagctaggtggttacgttttggggtcgttcgggacgggagggacctaaggccgtacggtacccgtaccgttaggccacggcccgtaacggg

SEQ ID NO: 119922 - DNA, 580 bp, Homo sapiens
  misc_feature: GYAE6OF01D80W6.2.38.D05.1.454.CMB.1.raw
  modified_base (299)..(299): a, c, t, g, unknown or other
  misc_feature (299)..(299): n is a, c, g, or t
  modified_base (527)..(527): a, c, t, g, unknown or other
  misc_feature (527)..(527): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgcttattttaaaaggtgtccagtgtgaggtgcagctggtggagtccgggggaggcttagttcagccgtggggggtccctgagactctcctgtgcagcctctggattcaccttcagtagctacgtggatgcacgtgggtcccnccaagcctaccggagggggaaggggcgtgggtgtgggtctacgacgttaattaagtagtgagtggggagtagacaacgaagctacgcggacctcggtaggaacgggccgtattccaacctatccctaccgaagaacgaccaaaccgacccaaaggaaccacgtcttgtaatctagacaaagtcgaactgtcagagacgccgaggacacggtctaggttagtattacgngtcgacaaaggagaatagacagacaggacgtaggtaccgccgtagtaccgggg

SEQ ID NO: 119923 - DNA, 545 bp, Homo sapiens
  misc_feature: GYAE6OF01A11RM.2.38.D05.1.454.CMB.1.raw
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (536)..(536): a, c, t, g, unknown or other
  misc_feature (536)..(536): n is a, c, g, or t
tcagacgctcgacacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaaggccgattcaccatctccagagacaacgccaagaacacgctgtatctgacaaatgaacagtctagagagccgaggacacggctgtgtattactgtgacaagtagatagcagcagctaggtacgccgactacgtggggccacgggtaaccctgggtccaccggtcctccgtcacgtccctaccaccgaacgggccccagtccggtccttcccccgnggccncccctgcctaccgaggacgccaccgtccgagacacacngcggtcccg

SEQ ID NO: 119924 - DNA, 616 bp, Homo sapiens
  misc_feature: GYAE6OF01AF16W.2.38.D05.1.454.CMB.1.raw
  modified_base (263)..(263): a, c, t, g, unknown or other
  misc_feature (263)..(263): n is a, c, g, or t
tcagacgctcgacacacgaccggtgctcgatttagtatctgatagttgggtttggggggaaggaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtcccnccaagcctccgaggggaggggctggtgtgggtctcacgtatttaatgtgatgggatagcacaagctacgcggactccgtgaacgggcctattccaccatctaccagacgaacaacgccaaagaacacgctagtatctagacaaatgaaacagtctagagacgccgaggaccacggtcttagtgttacttacgtggtacgactaaaggagacttagaccgagaccgtaggtcgttacgggtaacccgaccccggtaacgttaccgggtcggggggaccccaaaccggggggtaacccccttcggggtaaccccaaccccggtttccctaccccgttccgaacggtacccccccg

SEQ ID NO: 119925 - DNA, 610 bp, Homo sapiens
  misc_feature: GYAE6OF01C6PON.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgcgtggtgatataataaagacagtgagacggccctagagggactcccgtagacgcgtatttctcgtcggccttccgagtcctacgaagggaacctaaacgtacggtacctaccggtttacgaaccctagtacgtaaggttcgggaacgttacccgaagggaccaaggaaagtacgttaggacggtcgtagtaacttaattacgttgtaacaattcgagtacagacagcgtaggttggttttacgtttggggttacggtcgggacgggtacgggtaacccaaggtccgttacggtacccgttcggtaaggtccaacggcccgaaggtccccg

SEQ ID NO: 119926 - DNA, 575 bp, Homo sapiens
  misc_feature: GYAE6OF01CF55T.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagcccaccctcggtgtcagtcgtccccaggacagacggccaggatcacctgctctggagatgcattcgaccaaagcaattatgtcttagttcggtaccagcaagaacgccgaggccacggcccctggtcgctggtagatataataaagacagtagagacggccctgagggtactccgtggagtcgtattctcgtcggcctccgacgcgtacgagggaacaacgagtccacgttacgaaccataccgaggtggacgtaccgaggacaaggagagtggaacgtcgtagtaacttagttacgtgtacaagtcaagcaagacagtactaggttaggtttacgtttgggtaggttacgggcgggagggtacctaggccgtacggtacctcggtacgaccacgaccgtacggtcccg

SEQ ID NO: 119927 - DNA, 737 bp, Homo sapiens
  misc_feature: GYAE6OF01D404P.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgccaagctccgaggggagggctggtgtgggtctcacgttattaatagtgagtgggagtagcacaagctacgcggactccgtaggaacgggccattcaccatcctaccgaagacgaacaaccgaccaaacggaacacggctgtatctagacaaatgaactagtctagagacgcccggaagggaccacgggtcttagggttagttaaactttacgtggtacgaaccgaaagggacgtaagtacggacgacggacacggtacgttacgggtacccgacccgtaaccgttaccgggtaccgggggacccgaaccggggtaaccccttcgggtacccgtacccggttccctacccgtaccacccggtcccctaccccgaaacccggaaccgggaccccctacggttccccgggttccccttccccccggtcggtccccgtaccccgtcggtacccgttacccggaaccgggtcccgtacccgtaacccccgtacccgggaacgaccggacccgaacccggtacgggccccgggtacccccggg

SEQ ID NO: 119928 - DNA, 691 bp, Homo sapiens
  misc_feature: GYAE6OF01CRMHY.2.38.D05.1.454.CMB.1.raw
  modified_base (289)..(289): a, c, t, g, unknown or other
  misc_feature (289)..(289): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgtcttattggtaccagcagaagccaggccaggcccctgtgctggtnatataataaagcagtgagacggccctgagggactccctgacgcgtatttccgtctcgggcctaccgacgtccgtacgaacggggtaacaaacgtacggttacgaaccggtttacgaaccctaagttaccgaaggtacgggaacgtcccgaagggtaccgaaggaacgaagtagggaacggtacgttacgtaaacgttaacgtttaaccgttacggtaactaaacgttacgaacgtaccgaacgtaacgtaaggtccgtaagggtttacgggtttaaccggttttttgggggtacggtttaccggggtacgggggtaagggaacccggtaaaggtacccgttaccgggtaaccccgttaccggtaacgggtcccgaaaccggtccccggtaaagggtcccccg

SEQ ID NO: 119929 - DNA, 659 bp, Homo sapiens
  misc_feature: GYAE6OF01D6U3S.2.38.D05.1.454.CMB.1.raw
  modified_base (269)..(269): a, c, t, g, unknown or other
  misc_feature (269)..(269): n is a, c, g, or t
  modified_base (585)..(585): a, c, t, g, unknown or other
  misc_feature (585)..(585): n is a, c, g, or t
  modified_base (592)..(592): a, c, t, g, unknown or other
  misc_feature (592)..(592): n is a, c, g, or t
  modified_base (602)..(602): a, c, t, g, unknown or other
  misc_feature (602)..(602): n is a, c, g, or t
  modified_base (607)..(607): a, c, t, g, unknown or other
  misc_feature (607)..(607): n is a, c, g, or t
  modified_base (615)..(615): a, c, t, g, unknown or other
  misc_feature (615)..(615): n is a, c, g, or t
tcagacgctcgacacacgaccggtgctcgatttagtatctgatagttgggtttgggggagccccagccctgggattcccagctgtttctgcttgctgatcaggactgcacacagagaactcaccatgggagtttgggctgagcttgggtttttccttgttgtcttaattttaaaaggtgtcagtgtgaggtgcagctggtggagtccggggagcttagtcagccgtgggggtcctgagactctcctgtgcagcctctgacttcaccttnagtagctaactggatcgcacgtcgggtcccgaccaagtccgtaccgagggggaacgggcgtgggtcggtgggtctacgtaacggttaattaagtaggtgtaaggtggggaagtagacaacgaacgccgtaacggccggtaacctccgggtaagggaaccggggtcctaatttaccgaaccctaattacccgtacccgaaagggaaaccgaacccaaaaccgggaccccaaaaaggaaccgaccgtacgttagttaactctacgaaacaaattcggaaacctgtacgtagaaggacggccggaaggtacgaccggtntaggttntaatttacgnggtanacgaaagngtatagacagcaacggtcgagggtacccgccggtagtaccgggg

SEQ ID NO: 119930 - DNA, 567 bp, Homo sapiens
  misc_feature: GYAE6OF01CJZPP.2.38.D05.1.454.CMB.1.raw
  modified_base (508)..(508): a, c, t, g, unknown or other
  misc_feature (508)..(508): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccggggaggcttagttcagcctggggggtccctgagactctcctgtgcagcctctggattcaccttcagtagctactggatgcacgtgggtccgccaagctccgaggggaaggggctgggtgtgggtctcacgttattaatagtgagtgggagtagcacgaagctacgcggactcgtggaacgggccgattcaacctatcctaccaagacgaaccaaacggaccaaagaacaccgcttagtaactctagacaaagttcgaacagtctagaaggacggaccggaggaccacggtctgtacgtattacgngtagactaaaggagataggcagacgacggtcgtagggtacccgccgtaacgtaccgggg

SEQ ID NO: 119931 - DNA, 555 bp, Homo sapiens
  misc_feature: GYAE6OF01AEQSH.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtcccgccaagctccagggaaggggctgggtgtgggtctcacgtattaatagtgatgggagtagcacaagctacgcggactccgtgaagggccattcacatctccagagacaacgccaaagacacgctgtatctgacaaatcgaaacagtctagaagacgccggaagaccacggtctggtagtacttacgtggtagactaaggagatagcagcagcgtggaccgccgtaacgtacggcggggcccaaacggggtaaccccttgggtaccccacccgttcctcccctcgaccgtcccccg

SEQ ID NO: 119932 - DNA, 678 bp, Homo sapiens
  misc_feature: GYAE6OF01D3HVY.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcgagggactcccgtgagcgtattctcgtggctccagctacgagggaacaacgtagtacacgttgaaccctatacgaggtgggacgttacccgaagggtccaacggaaagtagttacgggaacgggtcttaacggtaactttaacgtttaacgttaggttaacctaaattaccgaaacgggtccaaagggtaacccgaaggtaccggttaaggtttaacggggttttaaccgtttttttggggggtacgggttttccgggggtaccggggtaaacggggtaaccccgaaagggtacccgttccgggtaaccccgggttaccggttaaacggggttacccaaccgggtaccccggaaacgggtcccccg

SEQ ID NO: 119933 - DNA, 566 bp, Homo sapiens
  misc_feature: GYAE6OF01AXEHB.2.38.D05.1.454.CMB.1.raw
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (440)..(440): a, c, t, g, unknown or other
  misc_feature (440)..(440): n is a, c, g, or t
  modified_base (538)..(538): a, c, t, g, unknown or other
  misc_feature (538)..(538): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccncaagctcgagggagggctggtgtggtctcacgtattaatagtgagtgggatgcacagctacgcgactcgagaggccatcacatcncaganacacgcaagaaccgctgtatctgacaaatgaacngtcngagcgcgagacacggntgtatatacgngtgacaaggagatagacagcagcgtagggtaccgccgtaacgtaccgggtggggacctaacgggtaccctggtctagtccgtccnccgtacgacgccctaccgaaccgacggcccttagtcccgttccctccccgtgggccctcccgtcgtcccacggacggaccgccctacccggtccgganaccggtccaaccggtccgggtccccggg

SEQ ID NO: 119934 - DNA, 781 bp, Homo sapiens
  misc_feature: GYAE6OF01DJ3SE.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggaggtccgggggaggtcttagttcaggccgtgggggtccctgagactctcctgtgcagcctcgtggtattccgacctttcagtagctacgtggatgctacgtcgggtcccgaccaagcctacggaggggaacgggtcgtgggttggtcgggtctacgtaacgttaattaagtagtagtagtagggaacgtacggactaacgaagccgtaaccgggccggtaaccgttcccggtaagggaaccggggtacccgtaactttacccgaaccctaattacccgtaccgaaaggaaccgaaacccgaaaaccggaacccgaaaaggaacccgtaccggtacgtttaacggttacttaccgttaagaaaccgtaaaagttacggaaacctaggtttaaccgaggaacgggaaccgaccgggaaggacccgtaacgggtcgtaggtttaacgttaacgttacgtggtaacgacgtaaaggtacgtaagtacgaaccgtagaaccggtagtccggtaacgggtacccgaaccggtacccggtagggaacccggggacccggtaacccgggttacccgtccggtacccgtaccccgtaccctttacccgccgtaccccggtacccccg

SEQ ID NO: 119935 - DNA, 573 bp, Homo sapiens
  misc_feature: GYAE6OF01A57AX.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagaacgccaggccacggcccctgtcgcgtggtgatataataaagacagtgagacggccctgagggactcccgtgacgcgtattctcgtggctccagctacgacgggaacaacgagtcgtacgttgaccatacgagtggacgtccgaggacaagagagtgagctagaacttattactgtacaacgtcgagacagacagactaggtacggtttacgttttggggtacgtttacggggcgggtaacgggaaccgtaaggtccgtacggtaacccggttaccgtaacgggtaccaaccggtcccggaacgggtccccg

SEQ ID NO: 119936 - DNA, 658 bp, Homo sapiens
  misc_feature: GYAE6OF01D6JEG.2.38.D05.1.454.CMB.1.raw
  modified_base (578)..(578): a, c, t, g, unknown or other
  misc_feature (578)..(578): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtgggggtccctgagactctcctgtgcagcctctggacttcaccttcagtagctactggatgcacgtcgggtcccgaccaagcctccgaagggggaggggcgtgggtgtgggtctcgacgttattaagtagtgagtgggagtagacaacgaacgcgtacggcggtactccggtaggaacgggtccacttaccacctatcctaccgaaggaacgaaccaaacggacccaaaagaacctacgtcttaggtaactccgtagaacctaaaagttcgaaactgtcgtaaggaacggacggccggaaggaccgaccgggtcttaggtaagttaatttaccggtggtagaaccgaaaaggganaaaggttacggaccgtaacggaccgtaagggtacccgttacgggggtaaacccgccccggtaaacggttaacccgggggg

SEQ ID NO: 119937 - DNA, 654 bp, Homo sapiens
  misc_feature: GYAE6OF01CUD3V.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctctggattcaccttcagtagctactggatgcacgtgggtcccgccaagctaccgaggggaagggctggtgtgggtctcgaacgttattaatagtgagtgggagtagcaacgaagcgtacgcggactccggtaggaacgggcctattccacctatcctaccaggacgaaccgaacgaccgaaacgaacacgctagtactctagacaaagtagaaactagtactaggagacggacccggaagggaaccgtacgggtcttacggtgtttaacgttacgttggacgaacgaaaggtagtaagtacggactagggaccaggtccggtaccgggtaacccggacccggtaacggttaccgggtacgggggtaaccccgaacgggggtaaccccttcgggtaccctaacccggttcccgtccctaccgacccgtacccccg

SEQ ID NO: 119938 - DNA, 714 bp, Homo sapiens
  misc_feature: GYAE6OF01BC4FZ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctcgtggagatgctagttcgaccaaagacaatatgtactttagttacggtacagacgaagaacgccgacggaccacggcccctggtcgcgtggtagtataataaagaaagacgtaaggtaggaacggacggtaccccgtacgacgggaccttacccgtggaacggtcgtatttaccgtcggtcggtcctaccgacggtcctacggaacgggaacaacgtagtaccgtacgttacaaccgtagtcgtagggtaggtacgtaccgaagggacgtaaggaagtaggtacggacggtacttaacgtactttaacgtttactaggttaactaactacgaacggacaacggaactacggtacggttagggtttacgggttttacgggtttttcggggttacgggggttaccggggtacggggtaaccggggaaccgtaacgggtccgttaccgggtacccggttaccggtacgggtaccgaaccggtaccggaaccggtccccgg

SEQ ID NO: 119939 - DNA, 768 bp, Homo sapiens
  misc_feature: GYAE6OF01D1E83.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtcccaggacagacggccaggatcactgctctggagatgcattgaccaaagcaatatgcttattggtaccagcaagaacgccaggccacggcccctgtcgcgtggtgatataataaagacgagtgagacggccctgacgggtactcccgtgacgcgtattccgtcgtcggtcctaccgagcctacggaacgggaaccaaacgtacggtacctaacgtttcgaaccctagttaccgaggttacgggtaacgtaccgaacgggtacgaacggaaagagttaggacgggtacgttacggtaaccgtttaagttttaaccgtacggttaaccgtaaacgttaccggaacggtaaccgaacggtaaaccgtaacgggtaccggttaacggggttttacgggtttttaaaccggggttttttttcggggggtaccgggttttaacccggggggaccggggggttaaaccgggggtaaccccggttaaacgggttcccggttaacccggggttaacccccgggtttacccgggttaaccggggttaacccggaaccccggggtaacccccggtaaacggggttccccccgg

SEQ ID NO: 119940 - DNA, 761 bp, Homo sapiens
  misc_feature: GYAE6OF01EROHM.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgtcttattggtaccagcaagaagccaggccacggcccctgtgctggtgatataataaagacagtgagacggccctgagggactcccgtgacgcgtacttctcgtcggtcctccgacgcctacgaacgggaaccaaacgtacgttaccgtaaccggtttacgaacccgacgtttttacgaaggttacgggacgtaccggaacgggacgaaaggaaaggtaaggtacggaacggtacgttacggtaactttaacgtttaaccgtacgttaacctaacgttaccgaacggtaaccgaaacggtaaccgtaacggtacggtttaacgggtttaacgggttttttaccggggtttttacgggggtttaccggggttaccgggggtaaccgggggtaaaccgggtaaaccggtaaccgggttacccgggttaaccccgggttaaccccgggtttaacccgggttaaccgggttaacccgggtaaaccccgggtaaaccccgggtaacccgggttaccccccggg

SEQ ID NO: 119941 - DNA, 724 bp, Homo sapiens
  misc_feature: GYAE6OF01DBK7L.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccgaggacagacggccaggactcacctgctctggagatgcattgaccaaagcaatatgtcttatggtaccagcaagaagccaggccacggcccctggtcgtcgtggtagatataataaagacgagtagaacggacggtccctacggaagggactcccgtaggacgacgtactttcgtcgtcggtcctaccgacggtacctacggaacgggaaacgaaaccgtaggttaccgtaaccggtttacggaaccctaagttaccgtaagggttacgggtaacgttacccgaacggggaccaaaagggaagtaacgtacggacggtcgtaacgtaacgtttaattaccgtacggttacctaagtaccaacggtacaaacgtacgaacggtacttaacgggtttacgggtttacgtttttcgggggttacgggtttaccgggggtccgggtaaacggggtaacccgtaggtacccggtaacggtaccccggttaccgggttaacggtaccgtaacccggtaccccggtaaagggttcccccgg

SEQ ID NO: 119942 - DNA, 510 bp, Homo sapiens
  misc_feature: GYAE6OF01BY8YM.2.38.D05.1.454.CMB.1.raw
  modified_base (393)..(393): a, c, t, g, unknown or other
  misc_feature (393)..(393): n is a, c, g, or t
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctctggattcacctttcagttagctactggatgcacgtgggtcccgccaagctccgagggaaggggctggtgtgggtctcacgtattaatagtgatgggagtagcacaagctacgcgactccgtgaccgggcgattcaccatctccagacgacacgcaagaaccacgctgtatcngacaatgaacagtctgagagccgagacgacggctgtgtacttacgtgtagacaagagatagcagcagctcggacnccgactagngggccagggacctggccaccgtncncgcgtccc

SEQ ID NO: 119943 - DNA, 827 bp, Homo sapiens
  misc_feature: GYAE6OF01DAIBQ.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagtcgttgggttttccttgttgtcttaagtttttaaaaggtgtccagtgtgaggtgcagtcgttgggtgggagggtccgggggaggtcgttagttcgaggcccggttcggggggtccctggacgtaccttccgttccgtggtcgccgacgtcccttcgttggtactttccctaccctttacgaggtacgtccttacgtggtatcggccgtaccggtccggggtccccgaccgtaacggccgtaccgggaagggggtaacggggtcgttggggttggttcgggtccttacgtaacggtttaattaaagtaggtaggtaggtaggggtagtaacgacgtaaacgaaacggtaccgtaaccggaccgggtaaccgttcccgggtagggaaaccggggacccgttaacttacccgaacccgttttttacgacccgttacccgaacggaaccggaaaccgaaacccggaaacccgaaaacggaaaccgtaaccgtaccgttacgttaacttaccgtacgtaacctaaacgtaacgtaaacgtacggttacgtaaggaacggaaccgggacccgggtaacggaaccgaccggtacgttaggttacgttacgtttacgtaggtacggaacgaaaggtaagtaaggtacgacgacgacgtacggtacgtacggtaacccgaccggtacgtaccggg

SEQ ID NO: 119944 - DNA, 583 bp, Homo sapiens
  misc_feature: GYAE6OF01AE6QW.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattcgaccaaagcaatatgcttatggtaccagcagaagccaggccacggcccctgtcgctggtgactataataaagacagtagagacggccctacgagggactcccgtagacgcgtacttctcgtcggcttaccgagtctacgaacgggtaacaacgagtaccaacgttgaacccgatacgagtacggagtaccgaggcaaggaagagtggacgacgtagactattacgtgtacaatcgacgtacagtacgagtactaggttcgttacgtttttggggtacgttcggggacgggtaagggtaccgaacgtccgttacgacccggttaccgtacggtaccacgtcccgtaaggtccccg

SEQ ID NO: 119945 - DNA, 627 bp, Homo sapiens
  misc_feature: GYAE6OF01DZSZ5.2.38.D05.1.454.CMB.1.raw
  modified_base (306)..(306): a, c, t, g, unknown or other
  misc_feature (306)..(306): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
tcagacgctcgacacacgaccggtgctcgatttagtatctgatagacgtgggtttccttgttgctatttaaaaggtgtaccagtgtgaggtgcagctggtggagtccggggagcttagttcacgccttggggggtccctgagacctctcctgtgcagcctctggattcaccttcagtacgctactggatgcactcgggtccgccaagctccgagggaaggggctggtgtgggtctcacgtattaataggtgagtgggagtagcacaagctaacggcggactccggtagaacgggccattcaaccgntctccaagacgacaacgcaaaggacacgctgtatctagacaaaatgaacagtctagacgagccgtaggacacggtntagtagtattacgngtacgacgtaaaggagtaagtacgacgagacgacgtacgtacggtaccgtaccgtacgtacgggtacgggtaccgtaacgggtaccgtcggtaccgtaccgtcctccgtacgaccgtacccgtaccgaccgaaccggtccctacgtcccgtcccgttccccgtcgcccgtccctcgccgtacgacggccaccgtacccgtaccggacgacgaccgaccgtcgccggtcccg

SEQ ID NO: 119946 - DNA, 656 bp, Homo sapiens
  misc_feature: GYAE6OF01DXIHU.2.38.D05.1.454.CMB.1.raw
  modified_base (465)..(465): a, c, t, g, unknown or other
  misc_feature (465)..(465): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagcccacccgtcggtgtcagtcgtccccaggacagacggccaggatccacctgctcgtaggagatgctattcgaccaaagacaatatgtacttagttacggtaccagacaagaacgccgacggcccgacggtcccctgtgcgtggtagatataataaagacgagtgagacggccctcgaacgggactcccgtaggacgtcgtacttcgtcgtcggcctcacgtcctacggaacgggaaccaaacgtacgtacgtacggttacgaaccctagtaccgtaggtacggtacgtacgaacggganaaggaagagtaggagacgttagtaacttactttacgtagtaactaagtacgaagtaacgacgagtacgtaggttaggttttacggttttaggggtcggttacggggaccgggaacgggtaaacccgtaggtcccgtaacggtacccggtaacgtacggtaccgaccggacccggacggtcccgtaccccgg

SEQ ID NO: 119947 - DNA, 671 bp, Homo sapiens
  misc_feature: GYAE6OF01C7U6Q.2.38.D05.1.454.CMB.1.raw
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccggggagcttagtcagccgtgggggtccctgagactctcctgtgcagcctctggtacttcaccttcagtagctactggatgcacgtcgggtcccgacaagctaccgaggggaagggctgggtcgtgggtcctactacggttattaatagtgagtgggagtagcaacaagcgtacgcggactccgngaacggcgatcacatcncagagacacgacaagacncgctgtatcgagacaaagtcgaacagttcaggacgtacgaccggtaaggaaccgacggtcttaggttgttaaacgtttacgtaggtacggaaccgaaagggtagaacgttaacggaccgtaaggaccctaaagggttacccgtacggggttaaacccggccccggttaaacgttaaccggggtacccggggggacccgtaaaccggggggttaaacccccccgttggggtaaccccctaacccggtttcccccttaacccgaccggtaacccggtacccccccg

SEQ ID NO: 119948 - DNA, 543 bp, Homo sapiens
  misc_feature: GYAE6OF01A2JPF.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccacggcccctgtcgcgtggtgatatataaagacagtgagaggccctgagggactccctgacgcgtattctcgtggcctccgagtctcgagggacaacgagtcacgttcgacctatcgaggtggacgtcaggcaagacgatggacgctagacttaattactgtacaatcaagtcaagacagcgtaggttggttacgttttgggtcggttacgggcgggtacgggacctaacggccgtacgtacccggtccgtacggaccacgcccgacggtcccg

SEQ ID NO: 119949 - DNA, 651 bp, Homo sapiens
  misc_feature: GYAE6OF01BDD0C.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacaggacggccaggatcacctgctctggagatgctattcgaccaaagcaatatgcttattcggtaccagcagaacgccaggccacggcccctgtgcgtggtgatataagtaagacagtagagacggccctgaggactccgtgagcgtacttctcgtcggtcctccgagcctcgaacggacaacgtacgtactacgttcgacctagtcgaggtcggacgtaccgaggacgaagaagagtaggaacggtctacgtacgtttacttacgtacgtactaacgttacgaacgtacgaacgaacaggtacgttaagggtttacgggttttaacggtttttcgggggttacggttacccggggtacggggtaacgggggtaacccgtaagggtacccggttaccggtaaccccggttccggttaacgggttaccgaaccccggtaccggtaaccggggtccccg

SEQ ID NO: 119950 - DNA, 589 bp, Homo sapiens
  misc_feature: GYAE6OF01C4VMZ.2.38.D05.1.454.CMB.1.raw
  modified_base (360)..(360): a, c, t, g, unknown or other
  misc_feature (360)..(360): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggagcttagttcagccgtggggggtccctgagactctcctgtgcagcctctggattcaccttcagtagctactggatgcacgtgggtccgccaagctccgagggaagggctggtgtggtctcacgttattaatagtgagtgggagtagcacaagctacgcggactccgtgaacggctatccacatcnccagacgacacgaccaacgacacgctgtatctgaacaaatcgaaacagtactaggacgacgaccggaacggacacggtcttaggtaggttaactttacgtgtacgacaaaggtgaatacggcagcgacgtcgtaccgggtaacgcccggtaagttaccgggcggggtacccgaaaccggggtaaccccttgggtacccgtaacccttctccctaacgtccgtacccccg

SEQ ID NO: 119951 - DNA, 598 bp, Homo sapiens
  misc_feature: GYAE6OF01BQ8FH.2.38.D05.1.454.CMB.1.raw
  modified_base (275)..(275): a, c, t, g, unknown or other
  misc_feature (275)..(275): n is a, c, g, or t
  modified_base (316)..(316): a, c, t, g, unknown or other
  misc_feature (316)..(316): n is a, c, g, or t
  modified_base (493)..(493): a, c, t, g, unknown or other
  misc_feature (493)..(493): n is a, c, g, or t
  modified_base (532)..(532): a, c, t, g, unknown or other
  misc_feature (532)..(532): n is a, c, g, or t
  modified_base (538)..(538): a, c, t, g, unknown or other
  misc_feature (538)..(538): n is a, c, g, or t
tcagacgctcgacacacgaccggtgctcgatttagtatctgatagctgggttttccttgttgctattttaaaaggtgtccagtgtgaggtgcagctggtggaggtccgggggaggcttagttcagcctggggggtccctgagactctcctgtgcagcctctggattcaccttcagtagctactggatgcacgtgggtccgccaagctccaggcaaggggctgggagtgggtggctagttatctcagacgtatagaaagtcaataaaatactacanacgactccggtagaacgggccgtattccacatctaccaganacaattaccaaagagatgttaatatctagacaaatgaacagacctagacgacctaggacgacacggtactagttaattagtttagtggttaggtacggacgggtactacgtaacgtcggtacggggaccctacgttacgaacgaggtcgggaccgacggacccgtcacgtctctccncgacgcctccgaccgacgccctcgtccgtaccctcccgngtcccnccctaccaccgacgtacgcctaccgcggtacgggccacgacgcccggccgtggccgtcgg

SEQ ID NO: 119952 - DNA, 804 bp, Homo sapiens
  misc_feature: GYAE6OF01B0E9M.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatccacctgctctggatatgcattcgaccaaagcaatatgtcttattcggtaccagacagaacgccaggaccacggcccctgtgctggtcgatataagtaaagacagtagagacggccctacgacgggactcccgtgacgcgtacttcctcgtacgggtcctaccgacggtccgtacggaacggggtaacctaaaccgtacgggtttaccgtaacccggtttaccggaaacccttacgttaccgtaaacggggttacggggtaacccgggttacccggtaacggggtaccgtaaaagggtaaacggtaacggtttacggggaaccggttaccggttaacggttaaacgttttaaacccgttttaaccgtttaacggtaaccgtttaaaaccggtccggtaaaccggtaacccgaaagggtaacccgtaggtaaccggttaacgggtttacggggttttttaccgggttttttagggggttccggggttttaccggggtacggggtaaccggggtaaacccgtaacgggtccggttaccggttaaccccggttccggttaccggttaacccgaccggtaccccggtaacgggttcccccg

SEQ ID NO: 119953 - DNA, 505 bp, Homo sapiens
  misc_feature: GYAE6OF01A8IL1.2.38.D05.1.454.CMB.1.raw
  modified_base (445)..(445): a, c, t, g, unknown or other
  misc_feature (445)..(445): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaaagcaatatgcttattggtaccagcagaagccaggccaggcccctgtgctggtgatatataaagacagtgagaggccctcagggactccctgagcgattctctggctccagctcgagggacaacagtcacgttgacctatcagtggagtccgaggcagaagatggagctgatatactgtcaatcagcagacagcagtggttactttttgggnggtttcgggcggtagggaccaagcgtagacccgttcgtaggtcacgtcccgaaggtcccg

SEQ ID NO: 119954 - DNA, 660 bp, Homo sapiens
  misc_feature: GYAE6OF01AJ053.2.38.D05.1.454.CMB.1.raw
  modified_base (266)..(266): a, c, t, g, unknown or other
  misc_feature (266)..(266): n is a, c, g, or t
tcagacgctcgacacacgaccggtgctcgatttagtatctgatagttgggtttgggggtgggtccgaggaggcagaactctgggtgtctcaccatggcctggatccctctacttctcccctcttcactctctgcacaggctctgaggcctcctatgagctgacacagccaccctcggtgtcagtcgtccccaggacagacggccaggatcacctgctctggagatgcattgccaaagcaaatatgcttattggtaccagcaagaanccgacggccaggccccctgtcgcgtggtcgatatataaagacagtgagacggcctagagggactcccgtgaacgcgattcgtctggctaccgacgctacgagggtaaccaacgtaggtaccgtacgtttacgaccctaataccgtagggtacggtacgtaccgacggtacaagaaggaagtgagggtacctaggtaacttaagtttaccgtacggtacctaaagtccgtaaggaaccgtaacggaacgtaaccggtcgtaacgggtttcgggtttacggttttttacgggggtacggtttaccgggggaccgggtacgggtaaacgtaacggtacccgtacggtaaccccgttcggttaacgggtaccgtaaccggacccggtaaggtccccgg

SEQ ID NO: 119955 - DNA, 654 bp, Homo sapiens
  misc_feature: GYAE6OF01BJLL4.2.38.D05.1.454.CMB.1.raw
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
  modified_base (492)..(492): a, c, t, g, unknown or other
  misc_feature (492)..(492): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtgggggtccctgagactctcctgtgcagcctcgtggattcaccttcagtagctactggatgcacgtgggtcccgacaagctccgaaggggaagggctggtgtggtctcgacgttattaatggtagagtgggatacgacacaagccgtacggacggtactccggtaggaacgggcctaattccaacctaagtcctaccgaagaacgaacgaaaccgacaaaaggaccagtactgtaactcagacaaagtnaactagtntaggagacgccgaaggaccacggtctggttacgtaactttacggngtaggaacaaagggtacgtaagtaacgcaaggaccgtaggacccggttaggtaaccccggacccggttaacgtaccgggtaccgggggaaccctaaaccggggaacccctttcggggtaccccgacccgtttacccgcccgtaccggtaaacccgtcccccg

SEQ ID NO: 119956 - DNA, 521 bp, Homo sapiens
  misc_feature: GYAE6OF01DVTVP.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgagtgggagtagcacaagctacgcggactccgtgaaggccgattcacatctcagagacaacgcaaagaacacgctgtatctagacaaatgaaactgtactgagacgccgaggacacggctagtgtattactgtgacaagagatagcagcagctggaccgcgaacctacggtgggcccaaggggacccctgggtccaccgtctccctcagtcccc

SEQ ID NO: 119957 - DNA, 552 bp, Homo sapiens
  misc_feature: GYAE6OF01ETRNJ.2.38.D05.1.454.CMB.1.raw
  modified_base (441)..(441): a, c, t, g, unknown or other
  misc_feature (441)..(441): n is a, c, g, or t
  modified_base (459)..(459): a, c, t, g, unknown or other
  misc_feature (459)..(459): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctctggattcaccttcagtagctactggatgcacgtgggtcccgcaagctccgaggggaagggctggtggtgggtctcgacgtattaatgtgagtgggagtagcacgaagctacgcggactcgtagacgggccattcaccatctcaagacgacaacgcaaagacacgctgtatctagacaaatcggaacagtctagagacgaccgaggacacggtctagtntattcgtgtgacgaaganactagacaggcagtcgtacggtacacccggtacgtacggcggggcccaacggggtacccctggtacccctacgttccacctcgccgtaccccg

SEQ ID NO: 119958 - DNA, 771 bp, Homo sapiens
  misc_feature: GYAE6OF01COFB5.2.38.D05.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctcgtggattccaccttcagtagctactggatgcacgtcgggtccncaagctccgaggggaagggctgggtgtgggtcctcgaacgttaattaatagtgagttgggagtagcaacaagctacgcggactcgagacggccatcacntcncaganacaacgccaagaacncgntagtatctagacaaagtgaacagtcagacgacgaccggagacgacggtctgtacgttaattacgtggtacgacgaaaggcgaagtacgacgacggcgaaggtcgttacgggaaccgaccgtaacgtacgggtaccggggacccgtaaaccgggtaaccccgttcgggtaaccctacccggtttacccgtacccgttaccccgaaccggttacccccgttaacccccggaaacccggtaaaccccgggggttcccccttaaaccgggtttcccccgggtttcccccccgtttaacccccggtcccgggtaccccccgttaccccgttcccggtaccccgttaccccgggaaaccgggtccccggaacccccgtaaccccggttacccgggaaaccggaaccgttaccccgaacccggtaccggggtccccccgggttacccggg

SEQ ID NO: 119959 - DNA, 577 bp, Homo sapiens
  misc_feature: GYAE6OF01AX46V.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggccctcctatgagctgacacagccaccctcggtgtcagtgtccccaggacagacggccaggatcacctgctctggagatgcattgaccaaagcaatatgcttattggtaccagcagaagccaggccacggcccctgtgcgtggtgatataataaagacagtgagacggccctcgagggactcccgtgagcgtattctctggcctccagctacgagggacaacacgtcacgttgacctatcgagtggagtccgaggacaaggaagagtaggaggtctaggtacttagttactgtacaactacgagtacgaagacgagacgtagttcggtttacggtttttagggtcgggttccgggtacgggtaacgggaccgtaaggccgtacggacccggttaccgtacggttacgacccggtcccgtaacggtccccgg

SEQ ID NO: 119960 - DNA, 557 bp, Homo sapiens
  misc_feature: GYAE6OF01AYWOC.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaaatatgcttattggtaccagcagaagccaggccaggcccctgtgctggtgatatataaagacagtgagacggccctcgagggactcccgtgacgcgtattctcgtggcctccagctacgagggaaccaacgacgtacacgttcgaacctatcgaggtaggacgtccgaggcaagaagagtaggacggctagaacttattacgtgtactaatcagacagacagcgtaggttggttacgttttgggtcggttcgggcggtaacgggtacgaggtccgtacggtacccgttacgtaggtaccacggcccgaacgggtcccg

SEQ ID NO: 119961 - DNA, 656 bp, Homo sapiens
  misc_feature: GYAE6OF01CFDDB.2.38.D05.1.454.CMB.1.raw
  modified_base (267)..(267): a, c, t, g, unknown or other
  misc_feature (267)..(267): n is a, c, g, or t
  modified_base (508)..(508): a, c, t, g, unknown or other
  misc_feature (508)..(508): n is a, c, g, or t
  modified_base (525)..(525): a, c, t, g, unknown or other
  misc_feature (525)..(525): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggaggcttagttcagccgtgggggtccctgagactctcctgtgcagcctctggattcaccttcagtagctacgtggatgctacgtcgggtcccncaagcctaccggaaggggaacggggctgggtggtcgggtctcgaacgttaattaaagtagtgagtgggaagtaggcaacgaagcctacggcggtactccggtagaaacggaccgtattccgaaccatcctacgaagacgaacaacgaccaaagaccacgctagtatcgtagactaaagtgaaactgtactaggaacgacggtaccggaaggaaccgcggtactggttattaacgtttacgnggtaacacgaaaggtanaagtacgacgtaaggcctaaggtcccgttagggacccgaccggtaacgttacgggaccggggtacccggaaaccggggtacccttcgggtaacccgtacccgttaccctacccgtccaaccggtacccccg

SEQ ID NO: 119962 - DNA, 843 bp, Homo sapiens
  misc_feature: GYAE6OF01AC4WH.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagcgtgggttttccttgttgcttaattttaaaaggtgtccagtgtgaggtgcagcgtggtgggaggtccgggggaggtcgttaggttcgacggtccggtcgggggggttccctggacgtaccttccgtccgtggtcgccgacgtcccgtcgtcggtactttcctaaccctttcgaaggttacgaccgttaaccgtgggtaacttcggaccgtaaccggttccggggtaccccgacccgtaaacggtcccgttacccgggaaggggggtaaacggggtccgttggggttcgggttacgggttcctaccggtaaaccggtttaaagtttaaacggttaggttaggtaacggttagggggtaacgttaacggaccgtaacggtaaaccggtccgtaacccgggaccggtaacccggttccgggtaacgggtaaacccggggtacccgttaacgtttacccgaacccgtacgttccccgtaacgaaacggaccgtaaacccgaaccggaaccccgaaaagaacccgtaccggtacttacggttaacttccgaagaaacctaaagtacgaaacttaggtacgtaggaaacggcggaccgggaaggacctacggtccgtttagtacgttaacttcgtacggtacgaacgttaaggagtaatcggacgtacgacgtcgacggttacggtacccgcggtacgtacccggggg

SEQ ID NO: 119963 - DNA, 785 bp, Homo sapiens
  misc_feature: GYAE6OF01BQ43V.2.38.D05.1.454.CMB.1.raw
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
tcagacgctcgacacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtcgggtccgaccaagcctaccgaggggaaggggctgggtggtgggtctcgacgttattaatagtgagtgggagtagcaacaagctacggcggactcggtaggaacgggccattcacatccacagacgacaacgcaagaacacgntagtatctagactaaagtgaaacngttacgaggaagacggaccggaaggaccacggtctaggtagttattacgtggtacgaacaaggagaagtacgacgaacgcgaggtaccgttacgggtaacccggacccgtaacggttaccgggccgggggtaaccccgtaaccgggggtaaccccttcgggtaaccccgtacccggttcccgttaccccgtaccgaacccgtacccccgtaaccccgtaaaccccgggaaacccggggtcccccttaacgggttcccccgggtttacccccgtttccccccgggtagggtcccccccggttacccccgtccggtaccccgttaccccggaacggggtacccctaccccgtaacccccggttacccggggaaacggtacccgaacccggaacccggtcccgggggacccccgggttaccccgggg

SEQ ID NO: 119964 - DNA, 546 bp, Homo sapiens
  misc_feature: GYAE6OF01CM411.2.38.D05.1.454.CMB.1.raw
  modified_base (261)..(261): a, c, t, g, unknown or other
  misc_feature (261)..(261): n is a, c, g, or t
  modified_base (400)..(400): a, c, t, g, unknown or other
  misc_feature (400)..(400): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccncaagctccgaggggaagggctggtgtgggtctcacgtattaatagtgagtgggatagcacaagctacgcggactccgtagaacggccatcacatctcagacgacacgaccaagacacgctgtatctgacaaatgaaacngtctagacgagccgaggacgacggtctagtgtaattacgtgtacgacgaaaggtgaatagcagcagctagggtaccgaccgacgtacggtacggggccaacggggtacccctcgggtacccaccgttcctccctcgacgtaccccg

SEQ ID NO: 119965 - DNA, 658 bp, Homo sapiens
  misc_feature: GYAE6OF01C1VRH.2.38.D05.1.454.CMB.1.raw
  modified_base (262)..(262): a, c, t, g, unknown or other
  misc_feature (262)..(262): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcgtggtttctgtgctatttaaagtgtcagtgtgagtgcagctggtggagtccggggagcttagtcagccgtgggggtccctgagactctcctgtgcagcctcgtggattcaccttcagtanctactggatgcacgtggtccgacaagcctaccgaggggaaggggtctgggtggtcgggtctacgaacgttattaagtagtagagtgggagtagacaacgaagtcgtaacggcggtaacctccggtaggaaacgggcccgtattaccaaccagtcctacgaggaacgaaccaaccgacctaaacgaaccgtacgtacgttagttactacgtacgaaaccaaagttcgaaacgtagttcgtaaggaaccggacggacccgaagggacctaccgggttattacgggttagtttaacctttacggtaggtacggaaacgtaaagggtataaacgttcgacgtaacggcctaaacgggttacggtaccgggtaacccggccgttaaacggtaccccggggg

SEQ ID NO: 119966 - DNA, 772 bp, Homo sapiens
  misc_feature: GYAE6OF01DFUY5.2.38.D05.1.454.CMB.1.raw
  modified_base (370)..(370): a, c, t, g, unknown or other
  misc_feature (370)..(370): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtcccaggacagacggccaggatcacctgctctggagatgcattcgaccaaagcaattagtgtacttattggtaccagtcaagaagccaggccacggcccctgtgcgtggtagataatataaaagcgagtgaagacggccctgaacgggtactcccgtagacgcgtattctcgtggctccagtccncgtaacggggaccaaacgtcggtacctacggtttacgaacccgtaatacggtacggtacggggtaacttaccgggaacggaaccgtaaagggaaagtacggtacgggtaacggggtccttaacgggttaaacccttaaagttttaccgttacggttaaactacgttaaaccggaggtacccaaagggaacgttaacgggtcgttaaccggggttttacgggtttttaaccgggtttttcggggggtttaacggttaccccgggggtaacgggggtaaaccgggggtaaacccccttaaaaggggccccgttttaaaccggggtaacccccggtttacccgggttaaacggggttacccaaaccccgggggtaaccccgtaaccggggtttacccccccgggg

SEQ ID NO: 119967 - DNA, 585 bp, Homo sapiens
  misc_feature: GYAE6OF01EKTVP.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaaagcaatatgcttattggtaccagcagaagccaggccaggcccctgtgctggtgatatataaagacagtgagacggccctcgaagggactcccgtgacgcgtattctcgtggctccgagctcgacgggaacaacgagtacgtacgttcgacctatcgagtcgggacgtccgaaggcaaggaagtagtggacggcgtagtaacttattactagtacaatacgagtacaacgacacgactaggttaggtttacgtttttggggtaggtttccgggacgggtacgggaacccgtaaggtaccgtacggtacccggttaccgtacgggtaccgaccggacccgaagggtccccg

SEQ ID NO: 119968 - DNA, 675 bp, Homo sapiens
  misc_feature: GYAE6OF01CIA0L.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgtcttattggtaccagcagaagccaggccagcccctgtgctgtgatataataaagacagtgagacggccctcgagggactcccgtgacgcgtacttctacgtggccttaccgagcctacgaagggaacaaaacgacgttacctaacggtttacgaaacctagtaccagggtacgggaacgttacccgaagggaacgaaggaaaggtaagttacgggacgggtaccttaagggtaaacctttaacttaaaccggtttaggtaaccctaaacgtccgaaacgacgtaaacggaaccgagtaccggtaaggtttacgggttttacgttttttaggggttcggttacgggggaccgggtaaggggaccctaaacgggccgttacggtaacccgtcccggttaaacggtcgtaaccggacccgtaacggtaccccgg

SEQ ID NO: 119969 - DNA, 563 bp, Homo sapiens
  misc_feature: GYAE6OF01CX3J6.2.38.D05.1.454.CMB.1.raw
  modified_base (262)..(262): a, c, t, g, unknown or other
  misc_feature (262)..(262): n is a, c, g, or t
  modified_base (344)..(344): a, c, t, g, unknown or other
  misc_feature (344)..(344): n is a, c, g, or t
  modified_base (407)..(407): a, c, t, g, unknown or other
  misc_feature (407)..(407): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
  modified_base (489)..(489): a, c, t, g, unknown or other
  misc_feature (489)..(489): n is a, c, g, or t
tcagacgctcgacacacgaccggtgctcgatttagtatctgatagttgggtttggggggaagaggaagactgacggtcctgccacaggtggtgctgggcacggtgggcactcgatacaacatttgcgctcaactgtcttgtccagtgtgaggtgcagctggtggagtccgggggagcttagttcagccgtgggggtccctgagactctcctgtgcagcctctggattcaccttcagtagctactggatgcacgtgggtcccnccaagctccgaggggaagggctggtgtgggtctcgacgttatttaatagtgatgggagtagcacaagctacgcggactccgngaacggcatcacatctcagacgacaacgcaaagacacgctgtatctgaactaaagtcgaaacngtactagagacgcgaaggaccncggctgtntaacttntgtanacgaaagngtaatacgacgagccaagtcgtacgggtaccnccggtaacgtacggtcggggacccaaacggggtacccctgggtacccaacccgttctcccgtgaccgtaccccg

SEQ ID NO: 119970 - DNA, 659 bp, Homo sapiens
  misc_feature: GYAE6OF01CYVG4.2.38.D05.1.454.CMB.1.raw
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagacgctcgacacacgaccggtgctcgatttagtatctgatagctgggttttccttgttgctatttaaaaggtgtccagtgtgaggtgcagctggtggagtccgggggaggcttagttcagcctggggggtccctgagactctcctgtgcagcctctggattcaccttcagtagctactggatgcacgtgggtccgccaagcctccgaggggaagggctggtgtgggtctcacgtattaatagtgagtgggagtagcacaagctacggcgactcgagaaggccattcacatcncagagacaacgccaaagacncgctgtatctagacaaatgaactagtcgtagaacggagaccggaaggacacgggcttagtagttacttacgtggtacgacaaagagtagtagcaagcgtaacgcgtacgggaccgaccgtacgtacggtcggggaccaaccggggtcctacggtccacccgttcctccgtacaccgtacccgtacccgaacccggaacccgggcccctacgttccccggttacccccgttcccccggtcgggtacccccgtccccggtccgtcccgacccggtacgggaccccgacccgtaccccgtaccgggaacgtacccgaccgaacccggccgggcccgggtaccccggg

SEQ ID NO: 119971 - DNA, 982 bp, Homo sapiens
  misc_feature: GYAE6OF01B4O6I.2.38.D05.1.454.CMB.1.raw
tcagacgctcgacacacgaccggtgctcgatttagtatctgatagctgggttttccttgttgctattttaaaggtgtccagtgtgaggtgctagctggtggagtccggggaggcttagttcagcctgggggtccctggagactctcctggtagcgagcctctggatttccaccgtttcagttagtctacgtggatggcacgtgggtccgccaagcgtccggaggggaggggcgtggggtcgtcggggtcctacggaaccgggttaattaaagtaggtagtacgtgggggtagttaacggcctaaccgtaaaggtccttaaccgggccggtaaccgttcccgggtaggaaaacgggggtccccttaagttttccgaaaccctagttccccgttacccggaaggaaccggaacccgtaaaacccggacccgaaaagggtaaacccgaccgggtccgttaggttaaccgttccgttaacggaacccgtaaaaattcgggaaaaaacccgtgggtttacccgtagggaaaccggtaaaccgggaccccggaaaaggggtcctaacggggtccgtttacgggttaagttttaacgtttaaaccggtgggtttacccggaaagtaaaccgggttaggtaacgtttacgggaccccgaaaggggcccgtaaacgggttaccccggttaccggggtaaaccccggtcccggtaaacccgtttaccggggtaccgggggaacccctaaccgggggtaaccccttacggggttacccctaaccggttaccccgtttaccctacccggaccggtaccccgtaaccccgaaccggaaccggggtcccctaacgggttccccggttccccgttcccccggtagggtccccttacccggtccgtcggttaaccccggagggtaccgtccccgggtaacccttaccggggaacggtacccggaacccgtaccggtacgggtcccccgggtacccggg

SEQ ID NO: 119972 - DNA, 822 bp, Homo sapiens
  misc_feature: GYAE6OF01C6FYX.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggatcacctgctcgtggagatgcattgaccaaagcaatatgtacttagttacggtaccagacaagaacgccgaggccacggcccctgtcgcgtggtagtataataagtaaagacgtaggtgaaggacggccctcgaagggtactcccgtaggacgcgtactttcgtcgtcggtaccttaccgacgtccgtaccgaacgggaacctaaacgtaacggtccgtaacggtttacgaaccctagtaccgtacgggtacgggaccggttccgaagggtaaccgaaaggtaaacgggtacgttacgggaacggtacctttaacgggtaaacctttaacggtttaccgttacggttaaacctaaacgttaccggaaacgtaccgaacggtaaccgaacggttacgggttaaacgggttttcggggttttttaaaccggtttttttcggggggttacggggttttaacccgggggtaacccggggggtaaaccggggtttaaacccggtaaacggggttccccggtttaaacccggggttacccccgggtttaacccgggtttaaaccggggttacccggtaaaccccgggtaaacccccgggtaaccggggtttacccccccggg

SEQ ID NO: 119973 - DNA, 681 bp, Homo sapiens
  misc_feature: GYAE6OF01DJB72.2.38.D05.1.454.CMB.1.raw
  modified_base (337)..(337): a, c, t, g, unknown or other
  misc_feature (337)..(337): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggatcacctgctctggagatgctattgaccaaagcaatatgtcttagttcggtaccagacagaacgccaggccacggcccctggtcgcgtggtagatatataaagacagtgagacgccgtagagggactccgngacgcgtattctcgtcggctccgagctacgaacggacaacgtagtaccacggttacgaacctagtacaggtacggacgtaccgaagggaccaaggaacgtagtacggacggtacttacggtaactttaagttaccgttaggtaacctaagttaccgaacggtaccaacgggaacgtacggtacgttaacgggttttacgggttttaacgggtttttttacgggggtcggtttaaccgggggtaccggggtaaacggggtaaccggtaagggttacccgtacgggttaaccccggttacccggttaacggtaccgaacccgggtacccgaaacgggttcccccgg

SEQ ID NO: 119974 - DNA, 606 bp, Homo sapiens
  misc_feature: GYAE6OF01DNKMT.2.38.D05.1.454.CMB.1.raw
  modified_base (266)..(266): a, c, t, g, unknown or other
  misc_feature (266)..(266): n is a, c, g, or t
  modified_base (407)..(407): a, c, t, g, unknown or other
  misc_feature (407)..(407): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgacgactctcctgtgcagcctctggattccaccttcagtagctactggatgcacgtcgggtccnccaagctaccgaggggaagggctggtgtggtctcacgttattaatagtgagtgggatagcacaagctacggcggtactccggtagaacgggcctattcaccatcctaccagacacaacgccaaagacacgctagtactctnacaaatgaaactgtctaggagacgaccgaaggacacggtcttagtagttattacgtgtacaacgaaaggtacagtacgagacgacgaagtcgtacggtaacccggcccggtaaacgttacccgggacgggggtaacccgaaccggggaacccccttgggtaacccctacccggttccttacccgactcccggtaccccg

SEQ ID NO: 119975 - DNA, 638 bp, Homo sapiens
  misc_feature: GYAE6OF01B40LX.2.38.D05.1.454.CMB.1.raw
  modified_base (266)..(266): a, c, t, g, unknown or other
  misc_feature (266)..(266): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctgggtggaggtccgggggaggcttagttcagccgtggggggtccctgagactctcctgtgcagcctctggattcaccttcagtagctactggatgcacgtcgggtccnccaagctccgaaggggaagggctgggtggtgggtctcgacgttattaagtagtgagtgggagtagacaacgaagcgtaacggcggtacgtccggtaggaaacggggccgtaattccaacctatcctaccgaagaacgaccaacgaccaaagaacacgactagtactctagaactaaatgaaactagtcgtagaggacgaccgaaggaccacgggtcttaggtagttaacttacgtgtacgacgaaaagagtaatagcgaagccaaggtcccgtaacgggtacccgaccggtactaccgggtcgggggaccccaaagggggtacccccttgggtacccaacccggttcctaccccgtcgacccggtacccccg

SEQ ID NO: 119976 - DNA, 609 bp, Homo sapiens
  misc_feature: GYAE6OF01CAHY1.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtgtccccaggacagacggccaggatcacctgctctggagatgctattcgaccaaagcaatatgtcttagttcggtaccagacaagaacgccaggccacggcccctgtgctggtgatataataagacagtgagacgccctgaggactcccgtgacgcgtattctgtcggcctccgagctacgacgggaacaacgtagtctacgttcgaacctagtcgaggtcggacgtaccgaggactaaggaacgatagggacggctacggtaacttaagttacttcgtaacaatcgagtacgaacgacgaacgtcgtaggtttcggtttacggtttttggggtacgggttcggggacggggtaacgggaacggtaacggtccgtacggtacccgttacggtacggtaccgtaccggacccggtaaggtccccgg

SEQ ID NO: 119977 - DNA, 763 bp, Homo sapiens
  misc_feature: GYAE6OF01BNEBS.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacacgccacccgtcggtgtcagtcgtccccaggacagacggccaggatcacctgctctggagatgcattcgaccaaagcaatatgtcttattggtaccagcagaacgccgaggccacggcccctgtcgcgtggtcgaatataagtaaagacgaggtagagacggccctacgaacgggtactcccgtagacgcgtactttcgtcgtcggtcctccgagccgtacggaacgggaacaaacgtacgtaccgtaaccgtttacgaaccctagtaccgaggtcgggtaacgtacccggaagggaccgtaaaggaagtaggtacgggaggtaccgttaacggtaactttaacgtttaaccgttacggtaactaacgttaccgaacgtaaccgaacgtaaccgtaacggtacgttaacgggtttacggggtttttaaccgggtttttttgggggttaaccggggtttaccggggtaacccgggggttaacggggtaaaacccggttacggggttaacccggttaaccgggttaaacccccgggttacccgggtttaacgggtaacccggtaaccccgggtaaaccccgggtaaccggggtacccccgg

SEQ ID NO: 119978 - DNA, 554 bp, Homo sapiens
  misc_feature: GYAE6OF01A1KMR.2.38.D05.1.454.CMB.1.raw
  modified_base (277)..(277): a, c, t, g, unknown or other
  misc_feature (277)..(277): n is a, c, g, or t
  modified_base (316)..(316): a, c, t, g, unknown or other
  misc_feature (316)..(316): n is a, c, g, or t
  modified_base (496)..(496): a, c, t, g, unknown or other
  misc_feature (496)..(496): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgaggggaaggggctggtgtgggtctcacgtattaatagtgatgggatagcacaagctacgcggactccgngaagggccattcaccatctccagagacaacgccaagacncgctgtatctgacaaatgaacagtctagagacgccgaggacacggcttggtagttacttacgtgtgacaagagatagcagcagctggtaccgccgtacgtacgcggggaccacgggaccctggtccaccgtcctccgtcacgccctaccgaccgacggcccacgtccgtcccttccccgnggcccgtccctgccctccgaggccgccacccgtccgagcgaccacgcggccggtcccg

SEQ ID NO: 119979 - DNA, 560 bp, Homo sapiens
  misc_feature: GYAE6OF01B41P2.2.38.D05.1.454.CMB.1.raw
  modified_base (400)..(400): a, c, t, g, unknown or other
  misc_feature (400)..(400): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgcaacgctaccgaggggaaggggctgggtgtgggtctcgacgtattaatagtgatgggagtagcacaagctacgcggactccgtagaacgggccgattcaccatcncaagacacaacgacaagaaccacgctagtatctagacaaagtcgaactagtctagaagacggccgaaggacgtacggcttaggtagttaacttacgtgtacgacgaaaaggtgaagtacggcagacgaggccgtagggaccgacccggtcgttaaccggg

SEQ ID NO: 119980 - DNA, 656 bp, Homo sapiens
  misc_feature: GYAE6OF01BH116.2.38.D05.1.454.CMB.1.raw
  modified_base (472)..(472): a, c, t, g, unknown or other
  misc_feature (472)..(472): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtgggggtccctgagactctcctgtgcagcctctggattcaccttcagtagctactggatgcacgtcgggtccgccaagctccgaggggaggggctggtgtgggtctcgacgtattaagtagtgagtggggagtagacacgaacgctacggcggactccggtaggaacgggcctagttccacctatcctaccgaagacgaacaaaccgacaaaagaaccacgtctagtattctagaacaaagtcgaaacngttacgtaggaacggaggaccccgggtaagggaacccgtaacggtcgtttagggttacgttaaagtttccgtaggtaccggaagtaaaaacgggtaggtaaagtaacggccctaaaagggcccgaaccgggttacgttaacccggggtaaaccccgcccggttaaaacccggttaccccggggg

SEQ ID NO: 119981 - DNA, 736 bp, Homo sapiens
  misc_feature: GYAE6OF01AB6K1.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtcccaggacagacggccaggatcacctgctctggagatgcattgaccaaagcaatatgcttatggtaccagcagaagcaggccaggcccctgtgcgtggtgatataataaagacagtgagacggccctagagggactcccgtggacgtcgtatttccgtcgttcggtccctccgacgtcctaccgaaaggggaacccaaaaccgtacggttacccgtaaccgggtttacgaacccctaagttaccgaagggttggggtaaacggttcccggaacggggaccgtaaagggaaacggtaagtacgggaacggtcgttaacggtaacctttaattttaccgtaacggtttacctaaacttaccgaagtaccgtaaacggtaacgacggtacgttagggtttacgggttttacggttttttacgggggttacggggtttacggggtaccgggggtaaccggggttaacccggaagggttacccggttaacgggttaccccgggttaccggttaacgggtacccgtaaccgggtaccccggtaaacgggttccccgg

SEQ ID NO: 119982 - DNA, 556 bp, Homo sapiens
  misc_feature: GYAE6OF01BXHON.2.38.D05.1.454.CMB.1.raw
  modified_base (263)..(263): a, c, t, g, unknown or other
  misc_feature (263)..(263): n is a, c, g, or t
  modified_base (333)..(333): a, c, t, g, unknown or other
  misc_feature (333)..(333): n is a, c, g, or t
  modified_base (398)..(398): a, c, t, g, unknown or other
  misc_feature (398)..(398): n is a, c, g, or t
  modified_base (480)..(480): a, c, t, g, unknown or other
  misc_feature (480)..(480): n is a, c, g, or t
  modified_base (498)..(498): a, c, t, g, unknown or other
  misc_feature (498)..(498): n is a, c, g, or t
  modified_base (541)..(541): a, c, t, g, unknown or other
  misc_feature (541)..(541): n is a, c, g, or t
  modified_base (547)..(547): a, c, t, g, unknown or other
  misc_feature (547)..(547): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctctggattcaccttcagtagctactggatgcacgtgggtcccnccaagcctaccgaaggggaagggtctggtggtgggtctcgacgttaattaagtgtgagtgggagtagcanaagctacgcgactcggtagaacggccattcacctatctcaagagacaacgaccaaagaaccacgntagtatctagacaaatgaactagtcaggacgcgaccggaggaccacggcttagtagttaacttagtcgtagaacaagagtanagcagcagcgtcggaccnccgtatacggcgggaccacgggtaaccctcgtcctacccgtcncccgtncggtacccc

SEQ ID NO: 119983 - DNA, 796 bp, Homo sapiens
  misc_feature: GYAE6OF01BPXMZ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggccctcctatgagctgacacagcccaccctcggtgtcagtcgtccccaggacagacggccaggactcacctgctcgtggagatgctattcgaccaaaagacaatatgtactttagttacggtaaccagacaagaacgccaggaccacggtcccctggtgcgtgggtacgtaataattaaagtaaaacggacaaggtaggaagaacccgggcccttacggaacgggtaacctcccgtaggacggtcgtaactttcgtcgtcgggtacccttccgaagccgtaacgaagggaaacctaaacgacggttaccgtacgttacggaaaccctagtaccggtaaggttagggacccgttaccggaaggaacgaagggtaaacgtaggttacgggaacggttaccgtaggttaaacctttatttaaaccggtttcgtaaactaacgttaacgaggtaacctaaggtacgacggtacgttagggttttacgggttttaaaccggggtttttttgggggtaaccgggtttacggggaaccggggggtaaccggttaaaccggttaaacgggtcccgggttaaccggggaaaccccggttttccggtaaacgggtttacccggaaccccggtaacccccgggtaaggtacccccccggg

SEQ ID NO: 119984 - DNA, 573 bp, Homo sapiens
  misc_feature: GYAE6OF01CGNJV.2.38.D05.1.454.CMB.1.raw
  modified_base (432)..(432): a, c, t, g, unknown or other
  misc_feature (432)..(432): n is a, c, g, or t
  modified_base (459)..(459): a, c, t, g, unknown or other
  misc_feature (459)..(459): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctctggattcaccttcagtagctactggatgcactgggtccgccaagctccgaggggaaggggctggtgtgggtctcacgttattaatagtgagtgggagtagcacaagctacggcggactccggtgaacggcatcacatctcagagacacgcaaagacacgctgtatctgacaaatcgaaacagtctagaacgacgaccggaaggacacggnttgtagtattacgtgtgactaaagganatagcagacgagtcgtagggaccgccggtaacttaccgggacggggacccgtaaaccgggggtaaccccttgggaccccttacccggttcctacccgtccgacccggtaccccc

SEQ ID NO: 119985 - DNA, 618 bp, Homo sapiens
  misc_feature: GYAE6OF01D36EL.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgctattcgaccaaagcaatatgcttattggtaccagcagaacgccaggccaggcccctgtgctggtgatataataaagacagtgagacggccctgagggactcccgtaggacgcgtacttctcgtcggctaccagctacgagggaacaacgtacgtacgtacgttacgaccgtatacgtaggtagggacgtacccgaaggtaccgaaaggaagtagttagggacggtacgtacgtaacttacgtttacgtagtactaactcgaacgtacgaagacgagtacgttaggttacgggttttacggttttggggtcggttacggggacgggtacgggaacgtacggtcgtaccggtaacccggtccgttacggaccgaaccggtcccgacggtccccgg

SEQ ID NO: 119986 - DNA, 674 bp, Homo sapiens
  misc_feature: GYAE6OF01BNAS0.2.38.D05.1.454.CMB.1.raw
  modified_base (260)..(260): a, c, t, g, unknown or other
  misc_feature (260)..(260): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (344)..(344): a, c, t, g, unknown or other
  misc_feature (344)..(344): n is a, c, g, or t
  modified_base (620)..(620): a, c, t, g, unknown or other
  misc_feature (620)..(620): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgaggggaaggggctggtgtgggtctcacgtattaatagtgatgggagtagcanaagctacgcggactcgtgaacggccattcacatcncaganacaacgccaaagaacacgctgtaatcgtagacaaaatcgaaacngtctaggagacgccgaaggacacggcttggtagtattacgtggtacgaacgaaaggagtaagtacgcaagcgaaggtccgtagggtaacccggcccggtaaccgttaccgggacggggggaccccgtaaacgggggtaacccccttgggtacccctaaccggttccctaccctaccgacgtcccctacccgaacccgtaacccggggcccctagtccccgggttacccttcccccggtcggccccgtccccgtggcccctacccggacgggacccncccgtaacccgtcccggaagacccgaccgaaccggcccgggcccggtaccccgg

SEQ ID NO: 119987 - DNA, 552 bp, Homo sapiens
  misc_feature: GYAE6OF01B39XG.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattgccaaagcaatatgcttattggtaccagcagaagccaggccaggcccctgtgctggtgatatataaagacagtgagaggccctgagggactccctgacgcgtattctcgtgctcagctcgaggacaacgacgtctacgttcacctatcgaggtggacgtcgacggcaacggagagtaggagtcgtagtacttattactgtactaatcaagcagacagtacgtaggttacggtttacggtttttgggtcggttcgggtacgggtacggaacgcgtaccgtacggtacccgttcgtacggtaccgaccggtccgaacggtcccg

SEQ ID NO: 119988 - DNA, 651 bp, Homo sapiens
  misc_feature: GYAE6OF01D384L.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgccaagcctccgaggggaaggggctggtgtgggtctcacgtattaatagtgagtgggagtagcacaagctacgcggactccgtgaaggccattcaccatctccagagacaacgcaagacacgctgtatctgacaaatgaacagtctgagacgccgaggacacggctgtagtattacgtgtagacaaaggagaagtagacaggcaaggtcgtacgggtaccgcccgaaccgttacgggacgggggacccgaaccggggtaaccccgttcgggtacccacccggttcctccctccgaccgtccctaccccgaaccgaaccggggtcccctacgttcccgggttaccccttccccccgtcgggtccccggtccccgttcggtccccgtaccggacgggaccacccgtaaccccgtaccggaacgacggacccaccggacgggccccggtacccggg

SEQ ID NO: 119989 - DNA, 528 bp, Homo sapiens
  misc_feature: GYAE6OF01DZYL0.2.38.D05.1.454.CMB.1.raw
  modified_base (298)..(298): a, c, t, g, unknown or other
  misc_feature (298)..(298): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
  modified_base (493)..(493): a, c, t, g, unknown or other
  misc_feature (493)..(493): n is a, c, g, or t
  modified_base (516)..(516): a, c, t, g, unknown or other
  misc_feature (516)..(516): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctgggtggagtccgggggaggcttagttcaggccgtggggggtccctgagactctcctgtgcagcctctggattcaccttcagtagctactggatgcacgtgggtccnccaagctccgaggggagggcgtggtgtgggtctcgagtattaatagtgagtgggagtagcaacgaagctacgcggactccgtagaacgggccatccacatcctacagacgacaacgcaaagaaccagctagtatcngacaatgaacngtcagagacgaccgaggacacggctggtntaattangtagacgaaagngaatgcagcaggctagggacccncgtagtaccggg

SEQ ID NO: 119990 - DNA, 553 bp, Homo sapiens
  misc_feature: GYAE6OF01CHB7L.2.38.D05.1.454.CMB.1.raw
  modified_base (325)..(325): a, c, t, g, unknown or other
  misc_feature (325)..(325): n is a, c, g, or t
  modified_base (405)..(405): a, c, t, g, unknown or other
  misc_feature (405)..(405): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtgggtcccgcaagctccgaggggaagggctggtgtgggtctcacgtattaatagtgagtgggagtagcaanaagctacggcgactcgtgaagggccattcacatctcagacgacaacgcaaagaacacgctagtatctagacaaatgaacngtcagagagaccgagacgacggcttgtagtattagtgtagacgaagagatagcagcagcgtacggtaccgaccgtacgtaccggtcgggggcccaacgggtaacccccgttggtacccacccggttccaccgtccgaccgtacccccg

SEQ ID NO: 119991 - DNA, 796 bp, Homo sapiens
  misc_feature: GYAE6OF01CCM87.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggacttccaccttcagtagctactggatgcacgtcgggtccgaccaagcctccgaggggaacgggcgtgggtggtcgggtctcgtaacgttatttaagtaggtggaggttggggaagtacgaccaacgaaacggtccgtaaccgggccggtaaccgttcccgggtagggaaaccggggtcccgtaacgtttacccaaccctacttcccgtacccgaaaggaaccgtaaacccgaaaaccccgacccgtaaaaacggaaacccgtaacccggtaccgtttagggttaaccttaccgttaacggaaaccctaaaagttacggaaaacctaacgggtttaccgtaagggaaaccgggaccggaacccggggaaagggtaacccccccgaaggggttccgtttagggttaggtttaaaccgtttaccgttagggtaccgaaacggaaaagggtaagtaacgttacggaaccgaggtacccgaacgggttaccggttaacggggaccccggtaccccgggtaaacgtttaaacccccggggggg

SEQ ID NO: 119992 - DNA, 838 bp, Homo sapiens
  misc_feature: GYAE6OF01CJGAA.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattcgaccaaagcaatatgtctttagttggtaccagacgaagaacgccgaggccacggtcccctgtgcgtggtagataagtaataaagacgtaggtagagacggccctagacgggtactcccgtaggacgaccgtagtttcctacgtcgggtcccttaccgaacgtccgtacgaaacggggaaacctaaacgtacggttcccgtaaccggtttacgaacccgttacgttaccggaagggtttaccggggtaaccggttaccgggaacgggacgaaaacgggtaaacgggtaacgttacggggacggtaccgtttaacggtaaacccgttttaacttttaaaccggtacggtttaaaccctaaacgttacccgggtaaaaccgtacgtaaaacgggtacccttaaaggggtccgtttaaaaccgggtttttcggggggtttttaacccggtttttttacgggggggtccgggtttttaacccggggggaacggggtaaacccggggtaacccggttaaacgggtacccgggttacggttaaacccccggggttacggttaacccggggttaccgtaacccgggttaacccccggtaaacgggttccccccggg

SEQ ID NO: 119993 - DNA, 619 bp, Homo sapiens
  misc_feature: GYAE6OF01EEXKJ.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtggggggtccctgagactctcctgtgcagcctctggattccgaccttcagtagctacgtggatgcacgtgggtccgccaagctccgaggggacgggcgtgggtgtgggtctctacgtattaagtagtgagtgggagtagcaacgaagctacggcggtactccggtaggaacgggccgtattccaaccactcctaccgaagtaacgaaccaaaccgaccaaaacgaacacgactgtaactcctagaacaaattgaaactgtactaggaagaccggccggaacggaccgacggtcttaggttacgttaattaccgtggtaacgacgaaaggtagaagtacggacgaagaccgtacggcggttaacggacccggtacccggtaacgttaaccccggggg

SEQ ID NO: 119994 - DNA, 775 bp, Homo sapiens
  misc_feature: GYAE6OF01BFXRE.2.38.D05.1.454.CMB.1.raw
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagcccaccctcggtgtcagtcgtccccaggacaggacggccaggactcacctgctctggagatgctattcgaccaaagcaatatgtcttagttcggtaaccagacaagacgccgaggccacggcccctgtcgcgtggtnatataataaagacagtgaggacgcctacgagggtactcccgngacgtcgtactttccgtcgttcggcctaccggagtaccgtacggaacgggaacctaaacgtacggttaccgtaaccggtttacgaaccctagttaccgaacgggttacggaacggttacccggaagggtaccgaaagggtaaacgagttacggggaaggtacgtaacgtaaccgtttaacgtttaccgtaacggttaaccgtaacttaccgaaacgtaccggtaaaccggtaacggtacggtaccggtttaaacggggttttcgggttttttaaacgggttttttcggggggttaccggggtttaccgggggaccgggggttaaaccgggtaaacccgggtacggttacccgttacccgggtaaaccccggtttcccgggtaaacgggtacccggtaacccgggtaccccgggtaaccggttcccccggg

SEQ ID NO: 119995 - DNA, 573 bp, Homo sapiens
  misc_feature: GYAE6OF01DCY57.2.38.D05.1.454.CMB.1.raw
  modified_base (261)..(261): a, c, t, g, unknown or other
  misc_feature (261)..(261): n is a, c, g, or t
  modified_base (360)..(360): a, c, t, g, unknown or other
  misc_feature (360)..(360): n is a, c, g, or t
  modified_base (402)..(402): a, c, t, g, unknown or other
  misc_feature (402)..(402): n is a, c, g, or t
  modified_base (449)..(449): a, c, t, g, unknown or other
  misc_feature (449)..(449): n is a, c, g, or t
tcagacgctcgacacacgaccggtgctcgatttagtatctgatagttgggtttgggggaagaggaagactgacggtcctgccacaggtggtgctgggcacggtggcactcgacacaacatttgcgctcaactgtcttgtccagtgtgaggtgcagctggtggagtccgggggaggcttagtcagccgtggggggtccctgagactctcctgtgcagcctctggattcaccttcagtagctactggatgcacgtgggtcccnccaagctccgaaggggaagggctggtgtgggtctcgacgttattaataggtgagtgggagtagcacaagctacggcgactcgtgaaggctatcacatcncagagacacgaccaagacagctgtatctgactaaatgaaacngtctgagacgaccggaaggacacgggtcttggtagttaactttacgnggtacgacgaaaggtagaagtagacagaccgaggccttacgggaccacccggtaacgtaccggtcggggaccctaaccggggacccttgggtaccctacccggtccctccgtacgcgtaccccc

SEQ ID NO: 119996 - DNA, 808 bp, Homo sapiens
  misc_feature: GYAE6OF01B2KRQ.2.38.D05.1.454.CMB.1.raw
  modified_base (252)..(252): a, c, t, g, unknown or other
  misc_feature (252)..(252): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcttgggttttccttgttgcttaattttaaaaggtgtccagtgtgaggtgcagctggtggaggtccggggagcttagttcagccgtgggggtccctgagactctcctgtgcngcctcgtggtattccaccttcagtacgctacgtggatgctacgtcgggtcccgccgaacgccgtaccggaaggggaacggggtcgttgggtcggttgggtcctacgtaacgttaatttaagtaggtagtagtggggagtaacgcaacgaacgtcgtaaccggccggtaaccgtccggtagggaaaccgggtccgtaacgtttacccaacctacgttacccgtaccgaaaggaaccggaaaccgtaaaccgaacccgaaaacggaaccctaaccggtcttaacggttaacttcccgtaagaacccgtaaaagttcgaaacgttacggttacgtaacgggaacggaaccggacccggggtaacggtaaccgtacccggggtacgtttacgggtttaacggtttaaacgtttaacggttgggttaacggtaaacccggtaaaagggtaacggttaaacgttaaccgggaaccgtaacgggacccggttaaacgggttcccgggttaaacggggtaaccccccggtaacccgggttaacccgggttaaaccccggggggg

SEQ ID NO: 119997 - DNA, 672 bp, Homo sapiens
  misc_feature: GYAE6OF01BC1CJ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgaccaaagcaatatgcttattggtaccagcaagaacgccaggccacggcccctgtgctggtgatataataaagacaggtgagaggccctacgaagggtactcccgtggacgcgactttctcgtggcctccgagctacgaacgggaacaaacgtagttaccgaacgtttcgaaccctagttcgaaggtcggtaacgtaccgaaggaccgaaaggaaacgtagtagggaaggccttaggtaaaccttttacgtttaactacggttaacaaacgttaccgaaggaccctaaggaaaccaggtacgtaacgggttaggttttaaccggtttttggggtacggggttttccggggaccggggtaacgggtaacccggtaaacggtcccgttaccgggaacccgttccgttaaccgggtaccgaaccggacccgtaaacggggtcccccg

SEQ ID NO: 119998 - DNA, 602 bp, Homo sapiens
  misc_feature: GYAE6OF01BJTVN.2.38.D05.1.454.CMB.1.raw
  modified_base (325)..(325): a, c, t, g, unknown or other
  misc_feature (325)..(325): n is a, c, g, or t
  modified_base (502)..(502): a, c, t, g, unknown or other
  misc_feature (502)..(502): n is a, c, g, or t
  modified_base (587)..(587): a, c, t, g, unknown or other
  misc_feature (587)..(587): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgaggggaaggggctgggtgtgggtctcacgtattaatagtgatggggagtagcacaagctacgcggactccggtgaacgggccgattcaccatctccagacgacaacgccaaagaacncgctgtatcgtagacaaatcgaacagtctagaaggacgaccggaacggacacgggtcttggttagttactttacgtggtacgacgaaaggagtaagtagacgaagcgagtcgtacggtaccgccggtacgtacggtcggggaccgtaacgggacccgtcggtcctacccgtctcccncgacgccctccgaccgacggccacgtccgtcctcccgcgccgccctcgcctaccgacggccgccctaccgtacggacgacgaccncgcgcccggtcccgg

SEQ ID NO: 119999 - DNA, 610 bp, Homo sapiens
  misc_feature: GYAE6OF01DE5O3.2.38.D05.1.454.CMB.1.raw
  modified_base (261)..(261): a, c, t, g, unknown or other
  misc_feature (261)..(261): n is a, c, g, or t
  modified_base (410)..(410): a, c, t, g, unknown or other
  misc_feature (410)..(410): n is a, c, g, or t
  modified_base (459)..(459): a, c, t, g, unknown or other
  misc_feature (459)..(459): n is a, c, g, or t
tcagacgctcgacacacgaccggtgctcgatttagtatctgatagttgggtttggggggaagaggaagactgacggtcctgccacaggtggtgctgggcacggtgggcactcgacacaacattttgcgctcaactgtcttgtccagtgtgaggtgcagctggtggagtccgggggagcttagttcagcctggggggtccctgagactctcctgtgcagcctctggattcaccttcagtagctactggatgcactgggtccnccaagctccgagggaagggctggtcgtgggtctcgacgtatttaatagtgatgggatagcacaagctacgcggactccgtgaacggcattccaccatctccagagaccacgaccaaagaacacgctgtaatcctgactaaagtgaaacngtactaggagacgaccgaaggaccaggtcctggttacgtaactttacgngtaggaccaaaggtcgaattaaggcaaggcaacgtccgtagggaccctacccggtaacttaccgggtcgggggacccccaaaaccgggggtaaccccttacggggttacccaaacccccggttccttaacccgccgtacccggtacccccg

SEQ ID NO: 120000 - DNA, 803 bp, Homo sapiens
  misc_feature: GYAE6OF01DBIPH.2.38.D05.1.454.CMB.1.raw
  modified_base (277)..(277): a, c, t, g, unknown or other
  misc_feature (277)..(277): n is a, c, g, or t
tcagacgctcgacacacgaccggtgctcgatttagtatctgatagttgggtttgggggtgggtccaggaggcagaactctgggtgtctcaccatggcctggactccctctacttcctccccctcttcactctctgcacaggctcgtgacggccctctatgagctgacacacgcccaccctggtgtcagtccgtcccaaggacacggacggccaggactccaccgtgctcgtggagatgctatcgaaccaaagcaattatgtacttagtacggaaccngacaaggaacgccgacggccgaccggtcctgtcgtcgtaggtataataagtaaagtaaacgagtggacgaacggaccggtaccctaggaaacgggtcctacccgtaggacgtaccgttagttcccgtaggtcggtacccttacggacgttaccgtaacggaaaccgggaaacctaaccggttaacgtaccgtaacccgttacggaaacccgtagttaaccgggtacggttaacggggtaccccgtaaccggaaggggtaaaccaaagggtaaagtaacgggtaggtaaccgggtacctttaaagtaaccgttttaacgtacgtttaacggaacctaacggtacgaaacgtacgaaaggttaccgaaggttaccggttagggtttacggtttttaacgggttttccgggggaacggttacccgggggaaaggttacccgggaactttaacccgggtaccgttaccggaacccggtttacggtaaaccggaccggaaccccggttaaccgggaaccgttccccccggg

SEQ ID NO: 120001 - DNA, 765 bp, Homo sapiens
  misc_feature: GYAE6OF01A64S0.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcacatggagtttgggctgagtcgttgggttttccttgttgtcttaagttttaaaaggtgtcctagtgtgaggtgcagcgtggtggaggtccggggaggtcttagttcgagccgtgggggtccctgacgtactctccgtgtcgctacgcctcgtaggtacttcctaccttcgagtacgtctacgtggaactcgctacggtcgggtacccgaccaacggccgtaccggaagggggtaagggtccggttgggttcggtacgggtcctagtaacgttaatttaaggtagtaggtaggtaggggaatacgacgaacgacgtacgtacggaccggtactaccgggtaggaacgggtccgtaacttccgacctacgttcccgtaacgaacgaaccggaaaccaaacccgtaccgaaaaacggtaacccaaccgttcgtaacggttactaacggtaccgtaaacgtaaacgtcgaaacgtaggtactaacggggaacggtaacgaacccgggtaaacgggcctaaacggggttcttaacggtttacgttaaacgttccggtaggtaccgtaaacgtaaagggaaccgtagtaacggacgaacggtcgtacgttcgggtaacgggtaccccggaccgttacggtaaccccgggg

SEQ ID NO: 120002 - DNA, 652 bp, Homo sapiens
  misc_feature: GYAE6OF01C9C44.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggatccacctgctcgtggagatgctattcgaccaaagcaatatgtactttagttcggtaccagacaggaacgccgaggcccgacggtccccctggtcgtcggtaggtagaattaataagtaaaagacgtaggtagaggacggtccctacgagggtacctccgtagacgacgtattctcgtcggcctaccgacgctacgaagggaaccaacgtagtcctacgttacgaacctagtaccgaggtcggtacgtccgaaggacgaagaagtagtggacggacgttagtaacttacgttacgtcgtaactagtacgagcaacgacgtagtacgtaggtttacggttttacggtttggggttacggtacggggacgggtacgggtaaccgtacggtaccgttacggtaaccccggttcgtaacggtaccaaccggccggtaacggtccccgg

SEQ ID NO: 120003 - DNA, 550 bp, Homo sapiens
  misc_feature: GYAE6OF01EDT66.2.38.D05.1.454.CMB.1.raw
  modified_base (468)..(468): a, c, t, g, unknown or other
  misc_feature (468)..(468): n is a, c, g, or t
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctaccgaggggaagggctggtgtgggtctcacgtattaatagtgatggggatagcacaagctacgcggactccggtgaagggccgattccacctatctaccagagacaacgcaaagaacacgctgtatcgtagacaaatcggaaactggtctaggacgacgcccgaaggaccacggtctgtacttaattacgtgtagacaagngatagcagcaggtctaggacgccgtaatcggcgggaccaacgggaaccctgggtccaacccggttntcccncncggtacccc

SEQ ID NO: 120004 - DNA, 630 bp, Homo sapiens
  misc_feature: GYAE6OF01A0M4O.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgctattcgaccaaagcaatatgtcttagttcggtaccagacaagaacgccgaggccgacggcccctgtcgcgtggtgatataagtaaagacaggtagagacggaccctacgacgggtactcccgtgacgtcgtacttctcgtcggcctacgacgtctacgaacgggaacaaacgtacgtacgtacgttacgaacctagacgtaggtacggtacgtaccgaggacaaggaagtagtacggacggacttacggtaacttacgtttactagtactaatcgacgacaagacgagtacgttaggttacggtttacgttttggggtaggtttccgggacgggtacggaaccgagggtccgtaacggtacccggttaccgtacgggtaccaccggtccgtacgggtaccccg

SEQ ID NO: 120005 - DNA, 601 bp, Homo sapiens
  misc_feature: GYAE6OF01BICEJ.2.38.D05.1.454.CMB.1.raw
  modified_base (331)..(331): a, c, t, g, unknown or other
  misc_feature (331)..(331): n is a, c, g, or t
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
tcagacgctcgacacacgaccggtgctcgatttagtatctgatagttgggtttgggggaagaggaagactgacggtcctgccacaggtggtgctgggcacggtgggcactcgacacaacattttgcgctcaactgtcttgtccagtgtcgaggtgcagctggtggagtccgggggagcttagttcagccgtggggggtccctgacgacgtctccgtgtgcacgccctgtgggattctaccttcagtagctactggatgcacgtgggtccgccaagctccgagggaagggctggtgtgggtctgacgtattaagtagtgagtgggatagcanaagctacgcgactcgagaggcatcacntcncagacacacgcaagaacncgctgtactcgtagactaagtgaactagtacgtagacgacgaccggaaggaccgtacggtcgtggttacgttaagttaccgtggtacgacgaaaggtagatacgcacggacgtacgtaccggttacggtaacccggcccggacgttacccgggcgggggtaccccaacggggtacccctcgggttacccacccggttcccctaccgtccgacccgtaccccg

SEQ ID NO: 120006 - DNA, 627 bp, Homo sapiens
  misc_feature: GYAE6OF01DQRIU.2.38.D05.1.454.CMB.1.raw
  modified_base (200)..(200): a, c, t, g, unknown or other
  misc_feature (200)..(200): n is a, c, g, or t
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
  modified_base (389)..(389): a, c, t, g, unknown or other
  misc_feature (389)..(389): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtggggtccnccaagctccgaggggaagggctggtgtgggtctcacgtattaatgtgatgggagtagcacaagctacgcggactccgtgaacgggccattcaccatccnccagagacaacgccaaagaacacgctgtatctgacaaatagaacagtcngagagccgaggcacggctagtgtattacgtgtagacaaagngatagcgagcgagtctcggtaacgccggtaccgtacggtcggggacccgaacgggtacccgttcggtccgtacccgttccgtccctaccgacgtcccctacccgaaccggaaccgggtcccctaacgttccccggttacccgtttccccccgtgggccccgtccccgtcgtcccgtacccgacgggtaccgaccctacccggtaccgacgacgaccgaaccgccggcccggtccccgg

SEQ ID NO: 120007 - DNA, 637 bp, Homo sapiens
  misc_feature: GYAE6OF01AHR4Q.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtgggaggtccgggggaggtcttagttcaggccgtggggggtccctgagactctcctgtgcagcctcgtggtatcctaccttcgagtacgctacgtggatcgcacgtcgggtcccaccgaacgcgtccgaggggacggggcgtgggtggtcgggtctcgtacgttaattaagtagtgagtgggagtagacagaacgcgacggccggtaccgtcggtaggaacgggccgtattccacctatccgacaggacaccgaaccgacccgaaagaccgacgtctagttactcgtacgaactaagtacgaaacctagtcgaaggaacggaacggacccgggaaggtaacccgcggtaccgttaggttattaccgttacgttggtacgaacgaaaggtaagacgtaacgacgacgcgaacgttcggacgggtacccgcgtaccgtacggggg

SEQ ID NO: 120008 - DNA, 615 bp, Homo sapiens
  misc_feature: GYAE6OF01AXFVI.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggagcttagttcagccgtggggggtccctgagactctcctgtgcagcctctggattcaccttcagtagctactggatgcacgtgggtccacaagctccgaggggagggctggtgtggtctcacgtattaatagtgagtgggatagcaacaagctacggcggtactcggtaggaacgggcctattccacctatcctaccaagaacgaaccaaaccgaccaaagaaccacgtctagttactcgtagactaaatcgaaactgtactaggaacgacgaccggaaggaccacgggtcttaggttagttaactttacgtggtacgaacgtaaaggtagaactagacagccaaggtccgtacgggtaccgccggtaacgttacgggacgggggaccctaacggggtaacccccttgggtacccacccgttctcccgacgccgtaccccg

SEQ ID NO: 120009 - DNA, 560 bp, Homo sapiens
  misc_feature: GYAE6OF01BVW4U.2.38.D05.1.454.CMB.1.raw
  modified_base (422)..(422): a, c, t, g, unknown or other
  misc_feature (422)..(422): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattgaccaaagcaatatgcttattggtaccagcagaagccaggccacggcccctgtgctggtgatataataaagacagtagagacggccctacgagggactcccgtagacgcgtattctcgtggccttccgagctacgagggaacaacgtagtacacgttcgacctatcgagtggacgtccgaggacaaggaagntggagctagacttattactgtacaatcgaagtcagaacagactaggttcggtttagttttgggtcggttacgggcgggaagggaccaggtccgtaggtacccgtacggtacggttaccgacggtcccgaagggtcccg

SEQ ID NO: 120010 - DNA, 874 bp, Homo sapiens
  misc_feature: GYAE6OF01EX536.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtcccaggacagacgccaggatcacctgctctggagatgctattcgaccaaagcaatatgtcttagttggtaccagacagaagccaaggccgacggcccctggtcgcgtggtgaatactaaataaacgactaggtagaggacgcccgtagacgggtactcccgtaggacgacgttacttccgttcgtcggtcctccgacggcccttacggaacgggtaaccaaaccggtacggttaccgtaaccgggtttacgaaccccgttaaagttccggtaacgggttacggggtaaacccgttacccgaaaggggtacccgaaaaggggtaaacggtaacgtacgggggtaaacggttaccttaaccgggttaaacttttaaaccggttttacggtaacgtttaaccgtaaacggttaccgaaacggtaaccgaaacgggtaaacgtaacgggttacggtttaaacgggggttttcgggttttttaaccggtttttttacgggggggggtaccgtttttacccggggggggtaaacccggggttaaacgggggtaaacccccggtaaacggttcccccggggttaacccgggtttaaccccccggggtttaacccgggtttaaacccggggttaaacccccggtaaacccccgggggtttaaaccccccggtaaacggggggtttcccccccccgg

SEQ ID NO: 120011 - DNA, 754 bp, Homo sapiens
  misc_feature: GYAE6OF01CKT5L.2.38.D05.1.454.CMB.1.raw
  modified_base (223)..(223): a, c, t, g, unknown or other
  misc_feature (223)..(223): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggatccacctgctctgganatgacattcgaccaaagcaatatgtacttattggtaccagcaagaacgccgacggccacggcccctggtcgcgtggtagaatataataaagacagtagagacgccctagaggtactccgtgacgtcgtacttcgtcgtcggtcctaccgagtccgtacgacgggaactaaacgtacgtaccgtacgttacgaaccctagtacgtaaggtacgggtactaccggaaggacgaaggaagtagtacgggaacggtcttacggtaacttaacgtttaacgtacgttaaacctaacgttaccgaacggtaaccgtaacgtaaaccgtaacgggttacggtttaaacgggtttaacggggttttttacccgggtttttggggggtttaacccgggttttaccgggggaaaccgggggttaaaccggggtaaacccggtaaaaccgggttcccggtttaaccgggacccccgggttttaaccggtaaccgggttacccggaaaccccggtacccgggttaaacccggttccccccggg

SEQ ID NO: 120012 - DNA, 529 bp, Homo sapiens
  misc_feature: GYAE6OF01DDBV3.2.38.D05.1.454.CMB.1.raw
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
  modified_base (445)..(445): a, c, t, g, unknown or other
  misc_feature (445)..(445): n is a, c, g, or t
  modified_base (483)..(483): a, c, t, g, unknown or other
  misc_feature (483)..(483): n is a, c, g, or t
  modified_base (521)..(521): a, c, t, g, unknown or other
  misc_feature (521)..(521): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccgccaagctccgagggaagggctggtgtgggtctcacgtattaatagtgagtgggagtagcacaagctacgcggactcggtagaacgggcattcaccatctccagacgacaacgccaagacacgctgtatctgacaaatgaacngtcngagagaccgaggacacggntgtgtattacgngtagacaaganagtagcagnagcgtggtacgcgacgtacgtgggccgacgggacctggcaccgtctccncgacgcctaccgacgacggcctagtccgtccttcccgngccgccgtgcctacgaggcgccaccgcgagacgcacgngccggccg

SEQ ID NO: 120013 - DNA, 753 bp, Homo sapiens
  misc_feature: GYAE6OF01CWF1T.2.38.D05.1.454.CMB.1.raw
tcagacgctcgacacacgaccggtgctcgatttagtatctgatagctgggtttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccgccaagctccgaggggaaggggctggtgtgggtctcacgtattaatagtgagtgggagtagcacaagctacgcggactccgtagacgggctatcaccatctacagacgacaacgaccaagacacgctagtactcgtgaactaaatacgaaacagtcctagaacggacgacccggaaggaccgtacgggtcttaggttacgttaacgtttacgttaggtcgaacgaaaggtagtaagtacgacgaagtaccgaggtaccgttacggggtaacccggacccggtaaccggttaccgggtacgggggtaaccccgaaccgggggtaaccccgttacgggtaccccgtacccggttcccgttacccgtaaccgtacccgtaccccctaccccggaacccgggtaaacccggggtccccttaacccggttccccgggttccccgtttaccccccggtcgggccccgtacccccgttccggcccgtacccggacggtacccgaccccgtaacccgttaccggacggaaccgtcccgaaccggccggtccccggtaccccggg

SEQ ID NO: 120014 - DNA, 600 bp, Homo sapiens
  misc_feature: GYAE6OF01CKFLM.2.38.D05.1.454.CMB.1.raw
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (417)..(417): a, c, t, g, unknown or other
  misc_feature (417)..(417): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctctggattcacctttcagtacgctactggatgcacgtgggtcccgaccaagcctccgaggggaagggctggtgtgggtctcgacgttattaagtagtgagtgggagtagcacaagcgtacgcgactcggtaggaacggctatcacatccncaganacacgacaagaaccacgctagtatctagactaaatcgaaacngtctagaggacgccgaagacagtggtctgtagttattcgtggtacgacgtaaggagtaatacgacacggacgaggtaccggtacggtacccggacccggtacgtaccgggtacgggggaccctaaaccggggtaccccgttcggggtacccctacccggttcccttcccgtacccgtacccgg

SEQ ID NO: 120015 - DNA, 576 bp, Homo sapiens
  misc_feature: GYAE6OF01BGNJU.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctatggagatgcattcgaccaaagcaaatatgcttattggtaccagcagaagccaggccacggcccctgtgcgtggtgaatataataaagacaggtgagacggccctacgagggactccctggacgcgtacttctcgtcggcctccgagctacgaagggacaacgagtactacggttcgaacctagtcgaaggtggacgtaccgaggacaaggaagataggaggtctagtaactttaacttacgtagtactaatcagtacaagacaggactaggttggtttacgttttggggtacggttcgggcgggtaaggaccgtaggtctacggtaccgttcgtaggtccgaccgcccgaacggtcccg

SEQ ID NO: 120016 - DNA, 727 bp, Homo sapiens
  misc_feature: GYAE6OF01DG1BV.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccagtggagtttgggctgagtcgttgggttttccttgttgtacttaagttttaaaaggtgtccagtgtgaggtgcagcgtggtgggaggtccgggggagtcgttagttcgacggtccggtggggggtccctaggacgtactctccgtgtcgacgcgcctcgtcggtacttccgtaccgttacgtaggtacgtacttacgtggatcgcgtacggttcggggtacccaccgaacgccgtaccgggaaggggtacgggtcgtgggtcggtcgggtctacgtaacgttagttaagtgtagtaggtaggacgtagacgtacgaacgtcgaccggtacggacgtccggtaagggaacgggtccgtacttaccgaacctacgtcccgtaacgaaggaaccgtaaccgaaaccggaccgtaaaacgaaccacggttcgtaagtacttaacgacgtaacaaacgtacgtaaaccgtgtacgtacggaacgggtacggaacccggtacggaacgtaccggtcgttaagtgttaacgttgtaacggagtaaccgaaagtagaacggtcgaacgagaccgtagtaccgtaccggacgtccggtaacggtacccgggg

SEQ ID NO: 120017 - DNA, 680 bp, Homo sapiens
  misc_feature: GYAE6OF01CAMTE.2.38.D05.1.454.CMB.1.raw
  modified_base (510)..(510): a, c, t, g, unknown or other
  misc_feature (510)..(510): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctggtgtcagtcgtccccaggacagcggccaggatcgacctgctcgtggagatgcagttcgaccaaagcaaattatgtactttagtcggtaccagacaaggaacgccgacggaccgccggccccttggtgcgtggtagaatataacgtaaagacaggtagacggacgccctagagggtactcccgtaggacgcgtatcctacgtggccctacgacgcttacgaagggtaacaacgtacgtacgtacgttacgaacctagtaccgaggtacgacgtaccgaggaacaaggacgtagtaggacggtctaacggtacttaagttacctagttaacaacgttnaaaccggtccgaagacgtacggtacgttaaaggtttcgggtttttacgggttttcgggggacggtttaaccgggggacgggtaaccgggttaaacctacggggtaccgtaacccggggtaacccgtttacggtacggttacccgaacggtaccccggtcgggtacccccg

SEQ ID NO: 120018 - DNA, 708 bp, Homo sapiens
  misc_feature: GYAE6OF01DQV9C.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtcccaggacagacggccaggatcacctgctcgtggagatgacattcgaccaaagacaatatgtacttagttcggtaccacgacgaagaacgccgacggtaccgacggccccgtggtcgcgtagggtatataataaagtaaagacgtaggtagacgacggtccctagacgggtactaccgtgacggtcgtacgtttctcggtcggtcctccgaagtccgtaacggaaggggaaacctaacgtaggttaccgtacggttacgaacctaacgttacgaggttacgggactaccgaaggtacgaagtaacggatacgggagtacgtagtaacttaagttaccgtagttacaaattccgaagtccaaggtacgaacgtagttaacggtttcgggttttacgggttttacggggtacgggttacggggtaccggggtaacgggtaaccggtaacggtcccggttaaccgggtacccggtttacccgtaaacgggtcccgtaacccgggcccggtaacggttcccccggg

SEQ ID NO: 120019 - DNA, 566 bp, Homo sapiens
  misc_feature: GYAE6OF01EURN8.2.38.D05.1.454.CMB.1.raw
  modified_base (337)..(337): a, c, t, g, unknown or other
  misc_feature (337)..(337): n is a, c, g, or t
  modified_base (455)..(455): a, c, t, g, unknown or other
  misc_feature (455)..(455): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgaggggaggggctggtgtgggtctcacgtattaatagtgatgggagtagcacaagctacgcggactccgtagaagggccattcacatctcagagacaacgcaagaacacgctgtatctgacaaatgaacngtctagagagcgaggacacggctgtgtattactgtgacaagagatagcagcagctaggtacgccgacgtacgtcggggaccacgggaacccgtggtaccacccgtctcctcacgcccnccgaaccgacgggcccacgtccgtcccgttccccgcggcccgccctcgcccgtcccgacggccgcccgacccgtcccggaacgacgaccgaaccgcggcccgggtccccgg

SEQ ID NO: 120020 - DNA, 688 bp, Homo sapiens
  misc_feature: GYAE6OF01DK2PC.2.38.D05.1.454.CMB.1.raw
  modified_base (201)..(201): a, c, t, g, unknown or other
  misc_feature (201)..(201): n is a, c, g, or t
  modified_base (615)..(615): a, c, t, g, unknown or other
  misc_feature (615)..(615): n is a, c, g, or t
tcagacgctcgacacacgaccggtgctcgatttagtatctgatagctgggttttccttgttgctattttaaaaggtgtccagtgtgaggtgcagctggtggaggtccgggggaggcttagttcagccgtgggggtccctgagactctcctgtgcagcctcgtggattcaccttcagtagctactggatgcacgtgggtccnccaagcgtaccgaggggagggctggtgtggtctcacgttattaatagtgagtgggatagcaacgagctaacggcgtactccggtagaacgggcctattccactatcaccgaagacgaaccaaccgtaccaaagtaaccacggtctagtactctagactaaaatgaacgtagtcaggaagacgacgaaggtacacggtcgttagtagttaactacgtggtcgaaacgaagacgtagtacgacgacgacgacggtaccgtacgggtacccgaccggtacgtaaccggggtacgggacccgtaaccggtaaccgtccggtacccgtaaccgttcccgtaccgtccgaccctccccgtaacccgaacccggaccggtcccttaacgtcccggttcccttcccggccggcccgtacccncggttacccgacggtacgccgaccccgacccgttacggactaccgacctacccgggacggccccggttcccgg

SEQ ID NO: 120021 - DNA, 657 bp, Homo sapiens
  misc_feature: GYAE6OF01B0TYF.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaaagcaatatgcttattggtaccagcagaagccaggccacggcccctgtcgctggtgatataataaagacagtgagacgccctgagggactcccgtagacgcgtattctcgtggcctccgagctacgagggacaaactagtcacgttacgacctagtacgaggtacggacgtaccgaagggacctaaaggaaacgtagttacggaggtacgtagtaacttaatttaaccgtagttaaccaaattacgaacgacgtaacgaacgacgtacgtaagggtttacgggttttaacggttttttcgggggtacggtttaccgggggaaccggggtaacggggtaacccggaaggttcccggtaaccgggtaacccggtttacccggtaaggttacccggaaccggtacccggtaaaccgggtccccgg

SEQ ID NO: 120022 - DNA, 684 bp, Homo sapiens
  misc_feature: GYAE6OF01BA56E.2.38.D05.1.454.CMB.1.raw
  modified_base (281)..(281): a, c, t, g, unknown or other
  misc_feature (281)..(281): n is a, c, g, or t
  modified_base (477)..(477): a, c, t, g, unknown or other
  misc_feature (477)..(477): n is a, c, g, or t
  modified_base (534)..(534): a, c, t, g, unknown or other
  misc_feature (534)..(534): n is a, c, g, or t
  modified_base (569)..(569): a, c, t, g, unknown or other
  misc_feature (569)..(569): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgtcttattttaaaaggtgtccagtgtgaggtgcagctggtggaggtccgggggaggcttaggttcaggccgtgggggtccctgagactctcctgtgcagtcctcgtggattcacctttcagtanctacgtggatgcacgtcgggtccgccgaagccgtaccggaggggaagggtcgtgggtggtgggtcctacgtacgttaagttaagtaggtgtagtgggagtagacacgaagctacgcggtaccgtcggtaggaacgggtccgtatccacctatcccgtaccgaaggacaaccccgtaaacgacccgaaaacgaaccnccggtactagttaactaccgttaggaaacctaaaagtcgaaaacctggtttaaccgnggaacgggtacgacccgggaagggaaccgtccggnttttaggactttaagttacgttggaccgaaacgtagggacgaaggttaccgcggaaccgtacgtaccggtaccgggttacggaaccccggtcccggtaaggttaacccccggggg

SEQ ID NO: 120023 - DNA, 627 bp, Homo sapiens
  misc_feature: GYAE6OF01BXDR1.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgaccaaagcaatactgcttattggtacagcagacgcaggccaggcccctgtcgtctggtgatataataaagacagtagagacggtacctcgagggactcccgagacgacgtattctcgtggcctacgagtcctacgaacgggacctaaacgacgtacacggtttacgaaccctagtacgagggttaggacgttaccgaggacaaggaagtagtaggagtactaggtaacttattacgttcgtaacaacgttcgaacgtcaaacgacgaacgtacgtacggttacgttttaacggttttgggtacggtttcgggggacggtaacgggtaccgtaaacgggccgttacggtacccggttaccgttacgggtaccgtaccggaccggtaacggtacccccgg

SEQ ID NO: 120024 - DNA, 745 bp, Homo sapiens
  misc_feature: GYAE6OF01D58BD.2.38.D05.1.454.CMB.1.raw
  modified_base (271)..(271): a, c, t, g, unknown or other
  misc_feature (271)..(271): n is a, c, g, or t
  modified_base (503)..(503): a, c, t, g, unknown or other
  misc_feature (503)..(503): n is a, c, g, or t
tcagacgctcgacacacgaccggtgctcgatttagtatctgatagttgggtttgggggaagaggaagactgacggtcctgccacaggtggtgctgggcacggtggcactcgacacaacatttgcgctcaactgtcttgtccagtgtgaggtgcagctggtggagtccgggggagcttagttcagccgtgggggtccctgagactctcctgtgcacgcctctggattcacctttcagtagctacgtggatgcacgtcggtccgacaagtccnccgaggggaagggtctggtggtcgggtctacgtaacgttaatttaagtagtgaagtgggagagcaacaacgtctacgcgtactcggtaggaacggcctattccgaccctatccgtccaaggacgtaaccgaaaccgaccgaaagaacaccgcttacggttaatccgtacgaactaaaagttcgaaacgtacgttacgaggaacggaacgacccggaaaggaacccgtaccgngtttagttacgttaactttacggtagtaacggaacgtaaaggtaacggtaacgtacggaccggtaacggtaacctacgggtaccggtttaaccgggaaccccgtacccgggtaaccggtttaaccgggtaaccccgggggggacccccgttaaacgggggttaaacccccgtttcccgggtaaccccgtaacccccgggtttaccccttcccccgaacccggtaaaccccggtaaccccccg

SEQ ID NO: 120025 - DNA, 647 bp, Homo sapiens
  misc_feature: GYAE6OF01DG9B5.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacacgcccaccctcggtgtcagtcgtccccaggacaggacggccaggatccacctgctctggagatgcattcgaccaaaagcaatatgtctttagttggtaccagcaagaacgccgaggccacggcccctgtgcgtggtgataataagtaaagacgtagtggaagacggccctacggacgggactcccgtagacggtacgtactttcgtccgtaggtccctccgagccgtacgaacgggaacaacgtacgtaccgtacgttacgaacctatacgtaggtacgggacgtccgaagggcaagggaacgtagtaggacggtcgtaacgtaactttaacgtttacgtcgtaacctaagtaccgaaggaccgaagaccgtaggtcgtagggtttacggttttacggtttggggttacgggtcgggaacgggtaacgggtacgtaacgtccgtacggaccgttcggtacggcgaaccgccggtcgtcccg

SEQ ID NO: 120026 - DNA, 650 bp, Homo sapiens
  misc_feature: GYAE6OF01ECVBP.2.38.D05.1.454.CMB.1.raw
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
  modified_base (335)..(335): a, c, t, g, unknown or other
  misc_feature (335)..(335): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgcaagctccgaggggaagggctggtgtgggtctcacgtattaatagtgatgggagtagcanagctacgcgactcgngaggccatcaccatcacagacgacaacgccaaagacacgctgtatctgacaaatcgaacngtctgaagacgacgaggacacggctggttgtaattcgtggtnacaaagngatagaccagcagtcgtcgggtaaccgccgtacgtacggtcggggacccgaaccgggtaacccgtcgggtacccgtacccgttcccgtcccttcccgaaccggtcccctacccgaacccggtaaccggggtccccttaacggtcccggttacccccgtttccccccggtacgggtccccggtaccccgtcggtaccccgtacccggacggtccgaccccgtaacccgtcccggaacgacgaccgaccgaccggcccgggtccccgg

SEQ ID NO: 120027 - DNA, 715 bp, Homo sapiens
  misc_feature: GYAE6OF01BI385.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggactcacctgctcgtggagatgctattcgaccaaagcaatatgtctttagttcggtaccagacaagaacgccgaggccacgggtcccctggtcgcgtggtacgaatataaagtaaaagacgaggtaggagacggtccttacgaagggtactcccgtggagtcgtattcgtcgtggccttacgacgtccgtacgaacgggaacctaacgtacgtaccgtacgttacgaacctacgtacgaggtacgggtacgtaccgaaggacgaaaggaaggtagtaggaacggtacgttagtaaccgttaagtttaaccgttaggtaacctaaacgttcgaacgtaaccgaacggtaacgaacggtacggttaacgggtttacgggttttacggtttttaggggtccgggttttacggggacggggttaacggggaacccgtaagggtaccgttacccgggtaacccggttacggttaccgggtaaccgtacccggaacccggtacgggtaccccgg

SEQ ID NO: 120028 - DNA, 675 bp, Homo sapiens
  misc_feature: GYAE6OF01DP6EP.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctacgtggagatgcattgaccaaaagcaatatgacttattggtaccagcaagaacgccaggaccacggcccctgtcgctggtagataataataaaagacagtcgaagacggccctacgagggactccgtagagcgtatttcgcgtggctcaagctaccgagggaacaacgtacgtctaacgttcgaacctagtaccgaggttacggacgtacccgaaggtccgaaaggaagagtaggaacggtctacgtaacttaagttaacctaggtaacctaaacttacgacgtaactaaaccgacgtaacggactaacgggttacgggttttaccgggtttttttagggggtcggttaccggggggtacgggtaaaccggggtaaaccgtaaacggtaccgttaacggtacccggtttaacccgttaacgggttaccggaaccggtaaccccggaaggttaccccccgg

SEQ ID NO: 120029 - DNA, 628 bp, Homo sapiens
  misc_feature: GYAE6OF01B4DEP.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagccgtgggggtccctgagactctcctgtgcagcctctggattcacctttcagtagctacgtggatgcacgtcgggtcccgccaagctccgaggggagggctggtggtgggtcctcgacgttattaagtagtgagtgggagtagcaacaagcgtacggcggactccggtaggaacgggccgtattccacctatcctaccgaagacgaaccaaaccgaccaaagaaccaccgtcttacgtaatctagaacaaagtacgaactagtctaggaagacgcccggaaggaccgacggtcttagtagttaactttcgtggtacgaccgaaaggtagagtaacgcacggacgtacgtccgtagggtaacccgccggtaacgtaccgggtcggggacccgaacgggtaccccgttgggtacccaccccgttcctaccctccgcgtacccccg

SEQ ID NO: 120030 - DNA, 670 bp, Homo sapiens
  misc_feature: GYAE6OF01AO18E.2.38.D05.1.454.CMB.1.raw
  modified_base (348)..(348): a, c, t, g, unknown or other
  misc_feature (348)..(348): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagaccggccaggactccacctgcttcgtggagatgctattcgaccaaagcaatatgtactttagtcggtaacagacaagagccaggccacggtccctgtcgcgtggatatataagtaagactaggtgacgacgtcctagacgggtactccgnggacgcgtacttctcgacggtcctacgagtccgacgacgggaaccaagtacgtaccgtacggttacgaacctagtcggtacggtaggacgtaccgaaggacgtaaagggacgtagttaggacgtacgttaagttactttattaccgtacgttaacaacgttacgacgtaacgacgacgaccgtaaggtacgggttttaacggttttcgggttttaggggttccgggtaaccggggacgggtaaccggaacggtacggttaccgggtaccgtaaccggttcggtaaaccggtcccgaacggacccggttaacggtcccccggg

SEQ ID NO: 120031 - DNA, 687 bp, Homo sapiens
  misc_feature: GYAE6OF01EP3TO.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggatcacctgctcgtggagatgcattcgaccaaagacaattatcgtctttagttcggtaaccagacaaggaacgccgacggcccgtacggccccgtggtcgcgttgggtagtaattaataaagtaaaacgacgtaggtagaacggaccggtacccctacggaacgggtaccttcccgtaggacgtcgtactttccgtcgtcggtcctaccgagtcctaacggagggaacctaacgtacgtaccgtaacgttacgaacctacgtacgaggttacgggacgtaccgagggacaaaggaacgtgtaggagtctagtaactttagtacgtagtacaacgtacgagtacgaagtacgaggtacgttaaggtttgggtttttaccgttttggggtacggtttcgggggacgggtaacgggtaccgtaagggtccgttacggtacccggttacgtaccggaccgacccggtacccgtacggtccccgg

SEQ ID NO: 120032 - DNA, 1045 bp, Homo sapiens
  misc_feature: GYAE6OF01EC69E.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagcccaccctcggtgtcagtcgtcccaggacagaccggccaggatccacctgctcgtggagatgctattcgaccaaaagacaatagtgtactttagttcggtaaccagacaagaacgaccgacggtaccccgacggtccccctggtcgcgttaggtacgtaattaagttaaagtaaaacggaacgtaggtaggaacggtaccgggacccctacggaacgggtacctacccgtaggacgaccgttagtttcctcgttacggcccttaccgacgtccgtaccggaaacgggtaacccgaaaacgtacggttaccgtaaccgggtttacgaaacccgttaacgtaccggtaacggggtttacggggtaaacccggttaccccgggaaacggggtaacccggtaaaaagggtaaaccggggtaaaacgttcggggtaaacccggggtttacccgttaaccgggtttaaaaccgtttttaaaccggtttttaaaccggtaccggtttaaaacccgttaaaacgttacccggtaaaccggaaacccgttaaaaacggggtaaaccccgttaaaccgggtaacgggtttttaaacggggggttttaaccgggggttttttttaaacccgggggttttttttttccgggggggggtttaacccggggtttttaacccccggggggggttaaaacccgggggggttaaaacccggggggttaaacccccggtttaaaaccccgggggttaccgggttttaaacccccgggggttaaaacccccccggggttttttcccggggttaaaaaccccggggtttaaccccccgggtaaaaccccgggggttaaaacccccccggggttaaacccggggtttacccccccccggg

SEQ ID NO: 120033 - DNA, 586 bp, Homo sapiens
  misc_feature: GYAE6OF01BT9OO.2.38.D05.1.454.CMB.1.raw
  modified_base (529)..(529): a, c, t, g, unknown or other
  misc_feature (529)..(529): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctatttaaaggtgtcagtgtgaggtgcagctggtggagtccgggggagcttagtcagccgtgggggtccctgagactctcctgtgcagcctctggattcaccttcagtagctactggatgcacgtcgggtccgccaagcctccgaggggaaggggcgtgggtgtgggtctcgtacgtattaagtagtgagtggggagtagacagaacgctacggcggactccggtaggaacgggccattccacatctaccagacgacaacgccaaagacacgtctagtactcgtagactaaatcgaaactacgtctagaaggaccggaccgaagggaaccgtacgggcttggtacgttattccgtggacgacgtaaaaggngtaatcggactaggacctaggacgttacgggaccgtacccgtacggttaacccgggg

SEQ ID NO: 120034 - DNA, 689 bp, Homo sapiens
  misc_feature: GYAE6OF01BP6IJ.2.38.D05.1.454.CMB.1.raw
  modified_base (309)..(309): a, c, t, g, unknown or other
  misc_feature (309)..(309): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgccaagctccgaggggaagggctggtgtgggtctcgacgttattaatagtgagtgggagtagcaacaagctacggcggactccggtaggaacgggccattccaccatccnccgagacgacaacgaccaaagaacacgctgtatctagacaaatgaactgtctaggaagacggccggaaggaccgacggtcttaggttacgttaattacgtggtagaacgtaaaggagtaagtacgacgtacgacgtacggcgttacggggacccgacccgtaacgtaccgggtaccggggacccgtaaccggggtaacccgtcgggtacccgtaccgtccgtacccgtacgaccgtcccctacccgaacccggaaccgggccctacggttcccggttaccccttccccggtcgggccccgtaccccgtcggcccgttaccggacggtcccgacccgtacccgaccggacgacgacccgaaccgccgggcccggtcccggg

SEQ ID NO: 120035 - DNA, 653 bp, Homo sapiens
  misc_feature: GYAE6OF01AWC5X.2.38.D05.1.454.CMB.1.raw
  modified_base (286)..(286): a, c, t, g, unknown or other
  misc_feature (286)..(286): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctactgcacaggctctgaggcctcctatgagctgacacagccaccctcggtgtcagtgtccccaggacagacggccaggatcacctgctctggagatgcattgaccaaagcaatatgcttatggtaccagcagaagccaggccaggcccctgtgctggngatatataaagacagtagagacggccctacgagggtactcccgtaggacgcgtatttctcgtgggtcctccgaagtcctaccgaaggggaaccaaacgacgttacctaacggtttcaacctagtcgaggtacgggacgtacccgaagggtaccaaggaagagttacggagtcgtaggtaacttagttacgtgtacaatccgagacgaacgaacacggtacgtaagggtttacggttacggttttttcggggtcgggtttaccggggcggggtaacggggtaacccggtaaggtacccggttaccggtaaccccggttaccggttaacgggtacccgaaccgggtccccggtaaacgggtacccccgg

SEQ ID NO: 120036 - DNA, 680 bp, Homo sapiens
  misc_feature: GYAE6OF01C264Z.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggatcacctgctctggatatgctattgaccaaagcaattatgtactttattcggtaccagcaaggaacgccgaaggcccaggtccccctggtcgccgtggtgataatataaagacagtgagacgccctcgagggactccctagagtcgtaatttctcgtcggcttccgagtccgtacgaacgggaaccaaacgtacgtaccgtacggtttacgaaccctaacgttaccgaaggtcgggaacgttccgaagggaaccgtaaggaacggtagtacgggaacggtccgttacggtaacgttaacgtttaccgtacgttaactaacttaccgagacctaagaacacgggtactagggttacggtttttaccggtttggggttacgggttccggggtaacggggtaacgggtaacccgtaaggtccgttacggacccggttccggtaacggttccaaccggtcccggtaacggtcccccgg

SEQ ID NO: 120037 - DNA, 663 bp, Homo sapiens
  misc_feature: GYAE6OF01BBK7V.2.38.D05.1.454.CMB.1.raw
  modified_base (246)..(246): a, c, t, g, unknown or other
  misc_feature (246)..(246): n is a, c, g, or t
  modified_base (294)..(294): a, c, t, g, unknown or other
  misc_feature (294)..(294): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtgtccccagggacagaccggccaggactcacctgctctggagatgcattgaccaaagcaatntgcttattggtaccagcaagaagccaggccaggcccctgtgcgtggtnatataataaagacagtgagacgccctacgagggactcccgtggacgtcgtacttcctcgtggcctcctagcctacgacgggaacaacgagtaccgaacgttacgacctaagtccgaaggtcgggacgtacccgagggtaccaaggaacgtagtacggaacggtcgtaacgtactttacgttacgttcgtaactaacttacgaacgtaccgaacgacgtacggaccgttaaggggtttaccgggttttacggtttttgggggtccgggtttaccggggaccggggtaacggggaacccgtacggttccggtaaccgtacccgggttaccgtacgggtaccctaaccgggtaccccgtaacgggtccccgg

SEQ ID NO: 120038 - DNA, 607 bp, Homo sapiens
  misc_feature: GYAE6OF01AF2GB.2.38.D05.1.454.CMB.1.raw
  modified_base (359)..(359): a, c, t, g, unknown or other
  misc_feature (359)..(359): n is a, c, g, or t
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
  modified_base (493)..(493): a, c, t, g, unknown or other
  misc_feature (493)..(493): n is a, c, g, or t
tcagacgctcgacacacgaccggtgctcgatttagtatctgatagttgggtttggggggaagaggaagactgacggtcctgccacaggtggtgctgggcacggtgggcactcgacacaacattttgcgctcaactgtcttgtccagtgtgaggtgcagctggtggagtccgggggaggcttagttcagcctggggggtccctgagactctcctgtgcagcctctggattcaccttcagtagctactggatgcacgtgggtcccgccaagcctccgaggggaaggggctggtgtgggtctcacgtatttaatagtgagtgggagtagcacaagctacgcggactcgtgaaggcgatcacntctcagacacaacgcaaagacacgctagtancgtagactaaagtcgaaacngtcgagaaggacggacccgaaggaccgtacgggcttgggttattacgtttactgggtacgacgaaggtagacgtaagcgacgngaggtccgttacgggtaaccgacccggtaacgtacgggtccggggaacccggaaccggggtaaccccgttggggtaccccacccggttcccgtacctccggtacgtaccccccg

SEQ ID NO: 120039 - DNA, 699 bp, Homo sapiens
  misc_feature: GYAE6OF01D9RZS.2.38.D05.1.454.CMB.1.raw
  modified_base (138)..(138): a, c, t, g, unknown or other
  misc_feature (138)..(138): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacnggctctggaggcctcctatgagctgacacacgcccacccttcggtgtcagtcgtccccaaggaccagaccggccaggactccacctgctcgtggatatgactattcgaccaaagctaatatgtacttagttacggtaaccagacgaagaacgccgacggaccgaccggacccctggtcgtcgttggtagtataataaagtaaagacgtagtaggacgacggacccgtacgacggtacctcccgagacgtacgtacttctcgtcgtcctacgcgtctacgacggtaacaacgtacgtacgtacgttacgaacctatacgtaggtacggtacgtaccgaaggtacgaagaagtacgtaggtacgtacgtaacggtacttagttacgtacgtaacgaactacgacgtacgtaacgtacgaacggtacgttaaggtttaccgggtttaggttttacggggttacgggttaccggggtacggggtaaccgggaacgtaacgggttaccgtaccggtacccggttacggtaccggtacccggtaccgaacccggtacggtcccccgg

SEQ ID NO: 120040 - DNA, 539 bp, Homo sapiens
  misc_feature: GYAE6OF01B9DOK.2.38.D05.1.454.CMB.1.raw
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
  modified_base (450)..(450): a, c, t, g, unknown or other
  misc_feature (450)..(450): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctgganatgcattgaccaaagcaatangcttatgtacagcagagccaggccacggcccctgtgctggtgatataataagacagtgagacggccctagacggtactcccgtagacgcgtattcgtcgtcggtcctaccgacgtctccgagggaaccaacgacgtctacgttcgaacctatcgaggtggtacgtccgaggacaagaagagtgagctgacttatctagtactactanagacagacgagtatacggttgtttacgttttgggtcggttcggcggtaggacctagcgtacgacgtcgtacgtagacgtccgaggtccc

SEQ ID NO: 120041 - DNA, 555 bp, Homo sapiens
  misc_feature: GYAE6OF01BAU7E.2.38.D05.1.454.CMB.1.raw
  modified_base (260)..(260): a, c, t, g, unknown or other
  misc_feature (260)..(260): n is a, c, g, or t
  modified_base (404)..(404): a, c, t, g, unknown or other
  misc_feature (404)..(404): n is a, c, g, or t
  modified_base (479)..(479): a, c, t, g, unknown or other
  misc_feature (479)..(479): n is a, c, g, or t
  modified_base (542)..(542): a, c, t, g, unknown or other
  misc_feature (542)..(542): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccnccaagctccgagggaagggctggtgtgggtctcacgtattaatagtgagtgggatagcacagctacgcggtactccgtgaagggccattcacatctccagagacaacgcaaacgaacacgctagtaatctagacaaatgaaacngtctgagacaccggagacacggctgtagttactacgtgtacgacgaagagattacgcgagcaggtctagggaccnccggacgttacggtcgggggacccaacggggtaaccccttgggtacccaccgggttcctcccncgcccgtaccccg

SEQ ID NO: 120042 - DNA, 768 bp, Homo sapiens
  misc_feature: GYAE6OF01A5CC4.2.38.D05.1.454.CMB.1.raw
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (325)..(325): a, c, t, g, unknown or other
  misc_feature (325)..(325): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgccaagctccgaggggaaggggctggtgtgggtctcacgtattaanagtgagtgggagtagcacagctacgcggactcgngaacggccatcacatcncagagacaacgccaaagacacgctgtacncgtagactaaagtcgaactagtcgtaggacggacggcccggaaagggaccgaacgggtctaggttacgttaacgtttaaccgtggtacgaacgaaagggacgtaagtacggacgacggacgtacggtccggttacgggtacccgacccggtacgttaccgggtacgggggaacccggtaacggggtaaccccgttcgggtaccccgtacccggttacccgttcccgtaccgtaaccgtcccccgtaacccgaaccccgggtaaccgggtacccccgttaaccggttaccccgggtttaccccgttcccccccggtacggggtcccccggtaccccgtccggtccccggtaacccggaaccgggtaccctaccccggtaaccccgtacccgggaacggtaccggaacccgaacccggacccggggtcccccgggtaccccgggg

SEQ ID NO: 120043 - DNA, 598 bp, Homo sapiens
  misc_feature: GYAE6OF01CKIIM.2.38.D05.1.454.CMB.1.raw
  modified_base (337)..(337): a, c, t, g, unknown or other
  misc_feature (337)..(337): n is a, c, g, or t
  modified_base (362)..(362): a, c, t, g, unknown or other
  misc_feature (362)..(362): n is a, c, g, or t
  modified_base (387)..(387): a, c, t, g, unknown or other
  misc_feature (387)..(387): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtcgggtccgccaagcctccgaggggaaggggctggtgtcgggtctcacgttaattaagtagtgagtgggagtagcaacgaagctacggcggactccggtaggaacgggcctattccaccatcaccagagaccaacgccaaagaacncgctagtactcagacaaatgaaacngtcagagacgccggaagacacggtntggtagtacttacgnggtacgacaaagngaagtagacgagcagcgtacggacgaccgacgtacgtcgggaccgacgggacctcggtaccacccgtcctccgtcacgccctaccaccgacggccctacgtccgtccctccccgtggcccgtcctcgccgtacgacggcgacccgacccgtccgacgacgaccgacgccggtcccggtcccgg

SEQ ID NO: 120044 - DNA, 847 bp, Homo sapiens
  misc_feature: GYAE6OF01DVPS7.2.38.D05.1.454.CMB.1.raw
  modified_base (641)..(641): a, c, t, g, unknown or other
  misc_feature (641)..(641): n is a, c, g, or t
tcagacgctcgacacacgaccggtgctcgatttagtatctgatagttgggtttgggggagccccagccctgggattcccagctgtttctgcttgctgatcaggactgcacacagagaactcacatggtagtttgggctgagtcgttgggtttttccttgttgtacttaagttttaaaaggtgtccgagtggtggaggtgcaggtcgtgggtggtagggtccgggggtaggtcgttaggttcgaggtccggtcgggggttccctgacgtacctctccgtgtcgcacgtcctcgttggtactttccgtacccttcgaagttacgtctaacgtggacgtcgaccgtacggtccgggtacccgaccgaacgtccgtaccgggtaagggggaacggggtcgttggggttcgggtttcgggtaccgttacgtaaacgtttaagtttaaacgttaaggtaggtaaggtaggggtaagtaacgacgaaaccgtaacggaccgttaaccggacggtaaccgtacccgggtaggaacgggtaccgtaacgttaccgacctacgttaccaacccgaaaggaccgaaaccgaaccgggtaaaccaaacgaaccgcgttaaccgttgttaacctacggaactaacgtaaaacgnggtaaactacgggtaccgtaaggaaccggaaccggtacggggaaaccgtaccgggtacggttccgttaggttaacgttactttaacggcgggttaaagaaacccgtaaagggtagtaaacggtaccggaccgtaaaggtaccgtaaccggttaccccgggttaacgggaacccccggtaccgggtaaaccccggtttaacgggggg

SEQ ID NO: 120045 - DNA, 686 bp, Homo sapiens
  misc_feature: GYAE6OF01DSHK1.2.38.D05.1.454.CMB.1.raw
  modified_base (275)..(275): a, c, t, g, unknown or other
  misc_feature (275)..(275): n is a, c, g, or t
  modified_base (432)..(432): a, c, t, g, unknown or other
  misc_feature (432)..(432): n is a, c, g, or t
  modified_base (486)..(486): a, c, t, g, unknown or other
  misc_feature (486)..(486): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggaggctttagttcaggccgtggggggtccctgagactctcctgtgcagcctctggtacttccaccttcagtagcttactggatcgcacgttcggggtcccnccgaagccgtaccggaagggggaaggggcgttggggtcggtcgggtctcgtaacggttaattaagtagtaggagtgggagtacgacaacgaagcgtaacgcggactccggtaggaacggctacttcactatcacagacacacgacaagacacgtctnactcagaactaaatcgaatgtacgtaggacgacggaccggaggaccgtacggtntttgtaggtttacttacgttggaacgtaaccgaaaggtacgaagttaccgagacgacgtaacggtcgttaccgggtaaccgggacccgtaaacggttaccggggtaccgggggaccccgtaaacggggggttaaccccccttacggggtaccctaacccccggttcccttaaccctaaccggtccccggtaaccccccgg

SEQ ID NO: 120046 - DNA, 713 bp, Homo sapiens
  misc_feature: GYAE6OF01BTDKI.2.38.D05.1.454.CMB.1.raw
  modified_base (273)..(273): a, c, t, g, unknown or other
  misc_feature (273)..(273): n is a, c, g, or t
  modified_base (539)..(539): a, c, t, g, unknown or other
  misc_feature (539)..(539): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagtcttgggttttccttgttgtcttagtttaaaaggtgtccagtgtgaggtgcgagcgtggtggaggtccggggagtcgttagtcgacggccggtggggtccctgacgtacctcgtccgtgtcgcgacgtcctntacggtacttccacttcgagtacgtcgtacgtggtacgtcgtccgtacggtcgggtacccgaccgtaacggccgtacggaggggacggtcgtaggtcggtcggtactcgtacgttagttaagtagtacggtagtaggggtatacggaacctaacgaacgtccgtacgggtaccgtacgttacccggtaggaaccggtaccgtacttacccgacgtacgtccgtaccgaaggtacgaccctaacgtaccgaaaacgtccgaccggtntttaggtaacctcgtagaacctaagtcgaagtcgttgaacgaggttaccgaggccggtactcgacttggtacttacgttcgtacggtgaacgaaggtacgtaggtaacgccaaggggtccttaacggggtacggttaccccgggaacccgttcccggtaacgttccccgggggg

SEQ ID NO: 120047 - DNA, 635 bp, Homo sapiens
  misc_feature: GYAE6OF01E4MAX.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcacctttcagtagctactggatgcacgtgggcccgcaagctccgaggggaaggggctgggtgtgggtctcacgtattaatagtgagtgggagtagcacaagctacgcggactccggtagaacgggccattcaccatctcagacgaacaacgaccaaagaaccacgctagtactctagacaaaagtgaaacctagtccgtaggaacgacggacccggaagggaccgaaccgggtcttggttagttaacgtttacgtcggtagacgaaaggtaagagttacggactacggcgtagccgttagggacccgtacccggtaacttaaccggggtcggggaccccgaacggggtaaacccccttcgggtacccctacccgggttccctaccccgttacgacccggtacccccg

SEQ ID NO: 120048 - DNA, 777 bp, Homo sapiens
  misc_feature: GYAE6OF01DLPR5.2.38.D05.1.454.CMB.1.raw
tcagacgctcgacacacgaccggtgctcgatttagtatctgatagttggggtttggggggtgggtccaggacggcagaactctgggtgtctcaccatggcctgggactccctctacttcctcccctcgttccactctctgcacaggcctcctgacgcctcctatgagctcgactacacgccctacccgttcggtctcctacgttcgtccccgaggaccagtaccggtccaagggactcctacctggtcctacgtaggtacacgttcggaccgtagttaccggaaccaaaggacctaaagttcgtacggttaccttttaacggtttaccggttaacccgagttaccggaacggaaaccggccgaaccgggaaccccggaaccgggtccccggttcggtaccggtaccgtttagggtaagtaacttaacgtaaagtaaacggtacggtaggtacgaacggtacccggtaccgtacggtaacgggtacctaccggtaggggtaccggtacctacgttttccgacggttcggtacctcggacgtcgtacggaaacgtactaacggtacgtacgtacgtacgtacctacgttacgaggtacgtacgtaccgagacgtacgagtgtacgagtctagtaactatttacgacttacgtactcgtacacgtaacgtagtacgttacgttacgggtttaacggtttcgggttcggtacgggtacgggtacggaacggtacgacgttacgacgtaacccgtgtaacgtcgaccggcgtacggtccccg

SEQ ID NO: 120049 - DNA, 645 bp, Homo sapiens
  misc_feature: GYAE6OF01CEIKU.2.38.D05.1.454.CMB.1.raw
  modified_base (349)..(349): a, c, t, g, unknown or other
  misc_feature (349)..(349): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggactcacctgctatggagatgcattgaccaaagcaatatgtcttattcggtaccagcagaagccaggccacggcccctgtgctggtgtatataataaagacaggtagagacggccctgagggactcccgtggacgcgtattccncgttggaccttccaggcctacggaacgggaacctaacgacgtaccttacggttacgaacctataccggtaaggtacggtaacgtacccgaaggtaccgaaaggaaggtagttaggaacggtctacgtaacttagtttactgtaacaatacgagtacagaacaggtacgtaggttacgtttacgggtttttcgggtaggtttaccgggacggggtaacgggaaccggtaacggtaccgttaaccggacccggtttaaccgtacgggttaccaacccggtccggtaaaccggtcccgg

SEQ ID NO: 120050 - DNA, 697 bp, Homo sapiens
  misc_feature: GYAE6OF01CVIGS.2.38.D05.1.454.CMB.1.raw
  modified_base (314)..(314): a, c, t, g, unknown or other
  misc_feature (314)..(314): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatccacctgctcgtggagatgcagttcgaccaaagcaatatgtctttagttggtaaccagtacaagaacgccgacggccacggcccctgtcgcgtggtagatataanaaagacagtgagacggcctgagggactcccgtggacgcgtacttccgtcgtggccttccgagtccgtcgaacgggaactaacgtacgtaccgtacggttacgaaccctagttccgtaagggtcgggaacgttacccggaagggaaccgaaggaaaggtaggttacgggaacggtaccgttaaggtaaactttaactttaaccgttggttaaccctaagtacgtaacggcaacggtaacgacggtacgttaaagggtttcgggtttaacggtttttcggggtggtttaccggggacggggtaacgggaaccgtagggtacccgttacgggtaccccggttacgttacgggtacccaaccgggaccccgtaacgggttcccccgg

SEQ ID NO: 120051 - DNA, 700 bp, Homo sapiens
  misc_feature: GYAE6OF01EJL52.2.38.D05.1.454.CMB.1.raw
  modified_base (250)..(250): a, c, t, g, unknown or other
  misc_feature (250)..(250): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctcgtggagatgctattgaccaaagcaaatatgtnttattggtaccagcaagaacgccaggccacgggcccctgtcgcgtggtagaattaataagtaaaagacgaggttaggaagacggtacccctgaacgggtactcccgtgaacggacgtacttccgtcgtcggccttccgacgtccgtacgaacgggaaccaaaccgtaggtaccgtaaccgtttacggaaccctaagttacgaaggttcgggaaccgttacgaagggacgtaaaggaacgtaggtggaacggtacgttaggtaactttaacgtttaccgtacgttaacaaacgttccggagtaacccgtaaggaaccgaaggtacggtaggtttacgggtttacggtttttcggggtcggtttacgggacgggtaaacggggaaccctaaagggtcccgttaacgggtacccgttaccgaaggtaccaccgggtaaccgaacggtccccgg

SEQ ID NO: 120052 - DNA, 843 bp, Homo sapiens
  misc_feature: GYAE6OF01BPGAT.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagacctctcctgtgcagcctcgtggattccacctttcagtacgctacgtggatgactacgtcggggtacccgaccaagccgtaccggaaggggggaacggggtccgtggggtttggtcggggttccttacgtaacggtttaagtttaaagttaggttaggtaaggttggggggtaagttacggacctaacgaaacgtccgtaaccgggcggtaaccgttcccgggtacgggaaacggggtcccgtaactttaccccgaacccgtaacgttcccgtaacccgaacgggtaaccggaaaccccgaaaacccggacccgtaaaaacggaaacccgtaacccggtacttacgggttaaccttaccgtaacggaaacctaaaaacgtccgtaaaccgtaacggtttccggtaaggaacgggtaccgggaccccggaaagggaacccgacgggtccgtttaaggttgtttaaacgtttcgtaggtacggaacaaagggtacgagttacggacaacggtccgaggtccgttagggaacccggttacccggtaacgttaccgggggaacggggcccccggtaacggggtaacccccttcggggttacccctaccccggtttacctccccgtagaccccggtacccccg

SEQ ID NO: 120053 - DNA, 647 bp, Homo sapiens
  misc_feature: GYAE6OF01AWS0S.2.38.D05.1.454.CMB.1.raw
  modified_base (282)..(282): a, c, t, g, unknown or other
  misc_feature (282)..(282): n is a, c, g, or t
  modified_base (356)..(356): a, c, t, g, unknown or other
  misc_feature (356)..(356): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtcccgccaagctccgaggggaaggggctggtgtgggtctcacgtattaatagtgagtggagtagcacaagctacgcggactccggngaacgggcctattccacatcaccagacgaccaacgccaaagaacacgtctagtactctagactaaaatcgaacngttcaggagacgcccggaaggaccacggtctaggtgttaacttcgtaggtacgacgaagtagtagtagacagcgagtacgtggtaccgaccgtacgtacggacggggaccgacgggaaccctggtaccgaccgtcctccgtaccacgtacccgtacccgaaccggaccgggtcccctaacggtcccggtcccttccccgtcggccccgtccccgtcggccccgtaccgacggtaccgacccgtacccgttacccggaacgacgtacccgaacggccggcccggtccccggg

SEQ ID NO: 120054 - DNA, 731 bp, Homo sapiens
  misc_feature: GYAE6OF01DQ632.2.38.D05.1.454.CMB.1.raw
  modified_base (646)..(646): a, c, t, g, unknown or other
  misc_feature (646)..(646): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagtcttgggttttccttgttgcttaattttaaaaggtgtccagtgtgaggtgcagcgtgggtggaggtccgggggaggtcttagttcgagtccgtgggggtccctgagactctccgtgtcgcacgcctcgtgtacttcctaccttacgagtacgtcttaccggttggggtcgaccgtaccggttcggggtaccccgaccaaacggtcctacccgggaagggggtaacggggtcgtggggttcggtcggggttcctacgtaaacgtttaattaaagtggtagtaggtagggtagtacgcaacgaagtccgtaacggcggtaaccgtccggtaggaaccgggtcctaagttacccacgtaacttcccaacggaagaccgaaaccgaaccgaaccaaaacggaactaccgtattacggtatacgtacgaactaaaagttcgaaactgttaccagggaaagtccggaccggaaggtacccagggttcttaggtttacgttaactttaccgnggttacacgtaaaggaacgtagtacgacgaacggctaacgggtccgttaacggacccgaccggtaaccgtcggggtaacccgggg

SEQ ID NO: 120055 - DNA, 683 bp, Homo sapiens
  misc_feature: GYAE6OF01EMQVQ.2.38.D05.1.454.CMB.1.raw
  modified_base (559)..(559): a, c, t, g, unknown or other
  misc_feature (559)..(559): n is a, c, g, or t
  modified_base (633)..(633): a, c, t, g, unknown or other
  misc_feature (633)..(633): n is a, c, g, or t
tcagacgctcgacacacgaccggtgctcgatttagtatctgatagttgggtttggggagccccagccctgggattcccagctgtttctgcttgctgatcaggactgcacacagagaactcaccatggagtttgggctgagtcgttgggtttttccttgttgtcttaattttaaaaggtcgtcagtgtgaggtgcagtcgtgggtggacggtccggggagtcgtttagttccgaggtccggttgggggtcccttgagtaccttccgtccgtgtcgcacgtccttcgtggtacttcctacctttcgagttaacgctacgtggtatgcgtacgtcgggtacccgaccgaagccgtacggaggggaacgggtcttagggtgtcgggtctcgtaacgttagttaagtggtagtacgtggtagtagtacgaacgtaagccgtaacggccggtacgtaccggtacgggtaacggccgtattacccgacctagttcctaccgagtaacgacccgtaaacgaccctaaaggaacctaccgtcgtagtactacgttacgaataacgtanaaccggtgttacgagtacggaccggcgtaacgtacgacgtagtcgtagtacgtcgttacgtaggttaggtaagngtacggtcggtaggtgacgttctaggtagtaggtcgggtgggtaacccgg

SEQ ID NO: 120056 - DNA, 714 bp, Homo sapiens
  misc_feature: GYAE6OF01DGO47.2.38.D05.1.454.CMB.1.raw
  modified_base (420)..(420): a, c, t, g, unknown or other
  misc_feature (420)..(420): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
tcagacgctcgacacacgaccggtgctcgatttagtatctgatagttgggtttgggggaagaggaagactgacggtcctgccacaggtggtgctgggcacggtggcactcgacacaacatttgcgctcaactgtcttgtccagtgtgaggtgcagctggtggaggtccgggggagtcttagttcaggccgtgggggtccctgacgtactctcctgtgcagcctcgtggtacttccaccttcagtacgctacgtggatgaccacggttcggggtcccaccgaaacggtccgtacccgggaagggggtaacggggtcgttggggtcggttcgggtccttacgtaacgttaatttaaagtggtgagtgggaagtacgacaagaacgtcgtacggcgtacgtccggtaggacggctataccacntcacgagaacgaacacgaccaaagacncgtntagtatctagaactaaagtcaaacgtgtacgaggaacggacgaccggaaggacctacgggttcttaggttaacgtttattaccggttaggacgaaacgaaagggtagtaaccttaggaacccgtaggcgtaaggtccggttacgggaaccccgtaccgggttaaacgtacggggtaccggggggacccttaaacccggggtaccccgtttcgggtaacccttaaccccggttccgtacccctaacggacccgttaaccccccg

SEQ ID NO: 120057 - DNA, 628 bp, Homo sapiens
  misc_feature: GYAE6OF01BEOO0.2.38.D05.1.454.CMB.1.raw
  modified_base (508)..(508): a, c, t, g, unknown or other
  misc_feature (508)..(508): n is a, c, g, or t
  modified_base (605)..(605): a, c, t, g, unknown or other
  misc_feature (605)..(605): n is a, c, g, or t
tcagacgctcgacacacgaccggtgctcgatttagtatctgatagttgggtttgggggaagaggaagactgacggtcctgccacaggtggtgctgggcacggtgggcactcgacacaacattttgcgctcaactgtcttgtccagtgtgaggtgcagctggtggaggtccgggggagcttagttcagccgtgggggtccctgagactctcctgtgcagcctcgtggtattcaccttcagtacgctacgtggatgcacgtgggtcccgccaagcctccgaggggaagggtctggtgtcgggtctcgacgttattaatgtgagtgggagtacgcaacgaagcgtacggcggaacctccggtaggaacgggtccgattccgaactatcctaccgagaacgaccgaaacgaccaaacggaacacgctagtaactcgtagacaaatcgaacagtctagaacgaggaccggaagaccgacgctgtagttaattcgtgtacgacgaaggatagtnaacgagaccgtaggtccggtaacggtacccgaccggtaacgtacgggaccggggaaccgaacccgggttaccccgttcgtaccccgaacccccgttncccctaccggacccgtacccccg

SEQ ID NO: 120058 - DNA, 682 bp, Homo sapiens
  misc_feature: GYAE6OF01A3Q0J.2.38.D05.1.454.CMB.1.raw
  modified_base (244)..(244): a, c, t, g, unknown or other
  misc_feature (244)..(244): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgaccaaagcaatatgnttattgtaccagcagaacgccaggaccgacggcccctgtcgcttcggagtatataataaaagacagtgagacgtccctcgagggactcccgtgagcgtattctacgtggcctacgagctcgaacgggaacaacgacgtcctacggttaccgaacctacgtacgtaggtacgggtacgtaccggaacggaccgtaaaggaacgtacgttacgggacggtacgtaccggtaactttaactttacgttacgttaacgtaacgtacgaacgtacgtaaacgaacgtaacggtaccgttaacgggtttacggttttacggttttttacggggtacgggtttaccggggaccggggaaacgggtaccgtaacgggtcccgtacgggttaaccccggttaacgttacggtacccggtaccggaaccccggtaacgggttcccccg

SEQ ID NO: 120059 - DNA, 772 bp, Homo sapiens
  misc_feature: GYAE6OF01CIS3X.2.38.D05.1.454.CMB.1.raw
  modified_base (181)..(181): a, c, t, g, unknown or other
  misc_feature (181)..(181): n is a, c, g, or t
  modified_base (225)..(225): a, c, t, g, unknown or other
  misc_feature (225)..(225): n is a, c, g, or t
tcagacgctcgacacacgaccggtgctcgatttagtatctgatagttgggtttgggggtgggtccaggaggcagaactctgggtgtctcaccatggcctggatccctctacttcctcccctcttcactctctgcacaggctctgaggcctcctatgagctgacacacgcccaccctcggtntcagtcgtcccaggacagacggccaggatcactgctcgtagganatgactagttcgaaccaaaagactaatagtgtactttagttacggtaccagacaaggaacgccgacggccgaccggcccctggtcgtcgtggtagtataataaagtaaagaacgaggtaggaaggaccggcccgtaggacgggtacctcccgtggacgtcgtattccgtcgtgccgtaccgagtccgtacgaacgggaactaacgacgttaccgtacgttacgaacctagtaccggtagggtacgggaccgtaccggaacgggtaacgaaacgggaaaggtcgtaacgggtaacggtacgttacgtaacgtttaagtttaccgtacgttaactaacgtacgaaccgacgtaacgactaacggtacggttaacgggtttacgggtttttacgggttttagggggttacgggtaacccgggggtaccgggtaaacggggtaacccgttaacgggttaccccggtttaacccgggttaccccgttacccggggttaaccgggtaccccgtaacccggggtaaaccccggttaacccggggtaccccccgg

SEQ ID NO: 120060 - DNA, 663 bp, Homo sapiens
  misc_feature: GYAE6OF01BNT41.2.38.D05.1.454.CMB.1.raw
  modified_base (312)..(312): a, c, t, g, unknown or other
  misc_feature (312)..(312): n is a, c, g, or t
  modified_base (656)..(656): a, c, t, g, unknown or other
  misc_feature (656)..(656): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatccacctgctctggagatgctattcgaccaaagcaatagtgtactttagttcggtaaccagacaagaacgccgaggcccgacggtccccctgtcgcgttgggtntaactaataagtaaagactaggtagaaggtacggccctagaacgggtactcccgtaggacgtcgtacttcgtcgtcggtcctaccgacgtcgtacggaacgggaaccaaacgtacgtacgtaacgttacgaacctaagtaccgtaggtacgggtacgtacccggaggtacgaaggaaacgtagtacgggacgtacgtacgtaacgtttacttacgtagtaactaagtacgaacggtacgaagactacggacgttaggttacgggtttacggttttgggtacgggttcgggacgggtacggaacggtacgtccgtacgaccgttacgtacggtacgacgtaccgnggtcccg

SEQ ID NO: 120061 - DNA, 592 bp, Homo sapiens
  misc_feature: GYAE6OF01AO0UV.2.38.D05.1.454.CMB.1.raw
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggacgggctggtgtgggtctcacgtattaatgtgatgggatagcacaagctacgcgactccgngaggccatcacntctcagacgacaacgccaagacncgntgtatcngacaaatgaactagtctagagacgccgaacgacgacggctgtgtattacgtgtacgactaaggagagtacgacagcgagtcgtacgggtaccgaccgtacgtacggtacggggaccgtacgggtaccccgtcggtacccgaccgtcctccgtcgaccgccctacccaacccgacggccctacgttcccgtacccttccccgtcgcccgtcccgcgtcctccggacggcgcccgacccgtccggacgtacgaccgtacgacggtcccggtcccgg

SEQ ID NO: 120062 - DNA, 645 bp, Homo sapiens
  misc_feature: GYAE6OF01CVKGM.2.38.D05.1.454.CMB.1.raw
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
  modified_base (482)..(482): a, c, t, g, unknown or other
  misc_feature (482)..(482): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagtcgttgggttttccttgttgcttaattttaaaaggtgtccagtgtgaggtgcgagcgtgggtgggacggtccgggggaggtcttagtcaggtccgtcgggggtcccngagctctccgtgtgcngcctcgtgacttctaccttcagtagctacgtggatgccacgtcggtcccgacaacgccgtacggaggggagggcgtggtggtcggtctacgtaacgttattagtagtgtaggtaggtagtacgacacgaacgtcgtaccggacgtaccgtacggagggaacgggcctataccgacctgtaccaccgagaacgaaccgaaccgaaccaaagaccacgtntagtactcgtagaacgtaaagtcgaacgtgtacgagacgaccggacggacgacgtcgtacgttgtacgttaagttccgtaggcgaagaaaggagttagaacggacctaagggccccttaacgggtacgtaccgggtaacccggcccgtaagggttacccgggg

SEQ ID NO: 120063 - DNA, 620 bp, Homo sapiens
  misc_feature: GYAE6OF01ATQYG.2.38.D05.1.454.CMB.1.raw
  modified_base (263)..(263): a, c, t, g, unknown or other
  misc_feature (263)..(263): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcacgcctctggattcaccttcagtagctactggatgcacgtggtccnccaagctccgaggggaagggctggtgtggtctcacgtattaatagtgagtggatagacacgaagcgtacgacggactccgtagaacgggctatacacatctacagacgacaaacgccgaaagaacacgcttagtactcgtacgacaatagaacaagtactagaacgacgaccgcggaaaaaaaaaaacgcggacgtagtagttaacgttacgttacgtagaacgaaagaagtaacgtaacgtacgacgtacgacgtacgtacggtaaccggaccggtaaccgttacggtacggggacccggaaccgggaacccgttacggtacccgtacccgtaccgtaccctccgaccgtaccccg

SEQ ID NO: 120064 - DNA, 794 bp, Homo sapiens
  misc_feature: GYAE6OF01DSKGX.2.38.D05.1.454.CMB.1.raw
  modified_base (375)..(375): a, c, t, g, unknown or other
  misc_feature (375)..(375): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacacgccacccgtcggtgtcagtcgtccccgaggacagaccggccaggatcacctgctagtggagatgctatcgaccgaagacaatatgtacttagttacggtaccagacgaaggaacgccgacggacccgacgtccccgtggtcgtcggtggtagtattaaataagtaaagacgtaggtacggaggaccgccgtacggacggtacctccgngacgtcgtacgtttccgtacgtcggtcctaccgagtaccgtacgaacgggtaaccaaacgtcgtaaccgttagtaccgaaccgtacgtacggtagggtacggtaccgtacggaacggtaacgaagggtaacgtaaggttcggggacggttacgttaacggtttaacttaacggtttaccgttagttaacccgtaagtacccgtaggtacccgaaagtaaccggtacggttaacggttagggtttttacgggtttttaacgggttttcggggtttacccggggttaaccggggtaaccgggggttaaccgggtaaaccggtaacccgggttacgggttaccccgggttaaaccccgggtttaccgggtaacccgggttaaccgtaccccgggtaaccccggttaaccgggtccccccggg

SEQ ID NO: 120065 - DNA, 517 bp, Homo sapiens
  misc_feature: GYAE6OF01EL9AT.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtacagcagaagccaggccaggcccctgtgctggtgataatataaagacagtgagaggccctcgagggatccctgagcgattctcgtggctccagctcgagggacaacgagtacacgttgaccatcagtggagtccaggcaagaagacgtagagtctagacttaattactgtacaattcagcaagacagactagtggttacgtttttgggtgtttcgggcggaagggaccaagcgtgacccgtcgtaggtacacgcccgaaggtcccg

SEQ ID NO: 120066 - DNA, 594 bp, Homo sapiens
  misc_feature: GYAE6OF01CO9HU.2.38.D05.1.454.CMB.1.raw
  modified_base (585)..(585): a, c, t, g, unknown or other
  misc_feature (585)..(585): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattcgaccaaagcaatatgtcttattggtaccagcagaagccaggccacggcccctggtgacgttggtagatataataaagactagtgagacggccctagacgggactcccgtagacgcgtattctcgtggcctccgagtcctacgaacgggaacaacgtacgtctaacgttcgaaccctagtaccgtaggttacgggacgttacccgaggaccgtaacggaaagtgtaggaacggtctaagtacttagttactagtaccaatcgagtcaagtacagctaggttggtttacgttttgggcggttcgggcggtagggaccaggtcgtacggtaccggtacgtacgtcgaccgtacccgnggtaccccg

SEQ ID NO: 120067 - DNA, 797 bp, Homo sapiens
  misc_feature: GYAE6OF01EP1LR.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccacccctcggtgtcagtcgtccccaggacaggaccggccgaggactccacctgctcgtggagatgcattcgaccaaagcaaatatagtactttagttacggtaaccgagacgaaggaacgaccgaacggacccgaccgggtccccccgtggtcggtccgtgggttagtaattaataaagtaaaacgaacgtaggtagaacggaaccggtccccgtacggtaacgggtaccttccccgtaggacgtacggtactttcgttccgtcggtcctacccgacggtcgtaccggaacgggtaacaaacgtacgtaccgtacgttaccgaacctagtacgtacggtagggtaccgtaccgaacgggacgaaaggaaacggtaggtacgggaacgtacgttaacgttaaccgttttaaacgtttaccgacgttaaccttaaacggtaccgaacgtaacggtaaaccgaacgacggttaacgttacgggtttacgggttttaacgggttttttcgggggtacggggttaccgggggtaccggggtaacggggaaacccgtacgggtccgttaccgggaaccccgggtttcccggttaaccggtacccgacccggtaccccggtaaccgggtcccccgg

SEQ ID NO: 120068 - DNA, 847 bp, Homo sapiens
  misc_feature: GYAE6OF01CJXLB.2.38.D05.1.454.CMB.1.raw
  modified_base (225)..(225): a, c, t, g, unknown or other
  misc_feature (225)..(225): n is a, c, g, or t
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
tcagacgctcgacacacgaccggtgctcgatttagtatctgatagttgggtttgggggtgggtccaggaggcagaactctgggtgtctcaccatggcctggatccctctacttcctcccctcttcactctctgcacaggctctgacggcctctatgagctgacacacgcccaccctggtgtcagtcgtcccgaggacagacggcaggactcactgctaagtgganatgctattcgaccaaagacaaatagtgtactttagttcggtaacacgacaagaacgccacggccgaccggcccctgcggtcgtggtanattaacgttaaanaaaacgacgaacggttagaacgggtaacggccctacggaacggggtacctacccgttaggaacggtccgtagtttcccgtcggtacggtccctaccgtacggtccgtaacggaacggggtaaaaccgaaaccgtaacgggttacccttaacgggttaaccgtaaacccgtaacgttaccgggtaaggttaccgggaacggtaaccccggtaagggtaaccgaaaggtaaacgggtaatacggggtaaacgggtccttaaaggtttaaccctttaagttttaacccgtacgggttaaaccttaaaccgttcggaaacggttaccgtaaacggaccgtaaaggttccgggttaacgggttttacggggtttttaaaccgggtttttttcggggggtaccggtttaacccgggggtaaccggggaacgggggtaaacccctaaggggttaccccgtaacggttaccccgggttaacgttacggttaacgaccccgggaaaccgggttaacccgggttcccccgg

SEQ ID NO: 120069 - DNA, 651 bp, Homo sapiens
  misc_feature: GYAE6OF01BWJRV.2.38.D05.1.454.CMB.1.raw
  modified_base (322)..(322): a, c, t, g, unknown or other
  misc_feature (322)..(322): n is a, c, g, or t
  modified_base (617)..(617): a, c, t, g, unknown or other
  misc_feature (617)..(617): n is a, c, g, or t
  modified_base (634)..(634): a, c, t, g, unknown or other
  misc_feature (634)..(634): n is a, c, g, or t
tcagacgctcgacacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcactgggtccgccaagctccgagggaaggggctggtgtgggtctcgacgtattaatagtgagtgggagtagcacaagctacgcggactccgtggaggccgattcaccatctccagacgacaacgccaagaacncgctgtatctgacaaatgaacaggtctgagacgaccgaggacacggctggtagtatttactggtcgacgaaggagaagtacgacgagaccgaggtccgtacgggtaacccggacccggtaaccgtaccgggtccgggggacccggaaccggggtaaccccggttcgggtacccgtacccgttccctcccgtaccgacccggccccgtacccgaacccgaaccgggtccccacggttcccggttaccccgttcccccgtcggtccccgcccgtccgcccgtcccgacggccgaccncccgccgacgccgaccnccgccggcccggcccgg

SEQ ID NO: 120070 - DNA, 717 bp, Homo sapiens
  misc_feature: GYAE6OF01C6LRG.2.38.D05.1.454.CMB.1.raw
  modified_base (86)..(86): a, c, t, g, unknown or other
  misc_feature (86)..(86): n is a, c, g, or t
  modified_base (126)..(126): a, c, t, g, unknown or other
  misc_feature (126)..(126): n is a, c, g, or t
  modified_base (136)..(136): a, c, t, g, unknown or other
  misc_feature (136)..(136): n is a, c, g, or t
  modified_base (146)..(146): a, c, t, g, unknown or other
  misc_feature (146)..(146): n is a, c, g, or t
  modified_base (164)..(164): a, c, t, g, unknown or other
  misc_feature (164)..(164): n is a, c, g, or t
  modified_base (478)..(478): a, c, t, g, unknown or other
  misc_feature (478)..(478): n is a, c, g, or t
tcagacgctcgacacacgaccggtgctcgatttagtatctgataggttgggtttgggggtgggtccaggaggcagaactgtgggtntctcaccagtggcctggactccctctacttccctcccctnttcactctcngcagagctcngacgcctactatgagtcngaacacacgccctacccgttcggtgtactagtccgacccgaaggacgacggaccggcgaaggtctaccaccgtgaccttcgtaggaagatgactatacgaaccaaaagctaatatgtacttagtacggacagaacgaagacgaccgacggaccgtaccggtccttggtcgtacgttagggataattaaagtaaagtaaaagagtaggtacgacggaccgtccgacggaacggtactccgtaggaccgtctctttaccgcgtacggtccctaacgacgacgaacgaaggaacctaaaggtcctaacgtaccgtanaaccgtatacggacggacgggtacacggaaggtaaacgaaggtaagtacgacgggtaacgtacttacggttaacttaagtccggtaatacgtaacgtcgaaagccaaacgagtacgggtagttacgggtttagggttttacggtttacggggtacggtcggggaaaccgggtaactacggaacggtccggtaacccgtaagggttcctaacggaccacggaacccggttggaacccccg

SEQ ID NO: 120071 - DNA, 789 bp, Homo sapiens
  misc_feature: GYAE6OF01BHB8Q.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccacctcggtgtcagtcgtcccaggacagaccggccgaggatcacctgctcgtggagatgctattcgaccaaaagcaaattatgtactttagttcggtaaccagacgaagaacgccgacggaccgaccggtccccgtaggtcggtcgttagggtagtaataagtaaagtaaaacggaacgtaggtaaggacggtaccggtaccccgtacggaacgggtaccttcccggtaggaacggtacgtacgtttccgtacgtcggtaccctccgaacggtcccgtaacggaacggggaaaccaaacggtaccgttaccgttaaccggtttaccgaaccttacgttaccggtaagggttaccggggtaaccgtaaccgggaacgggtaaccgaaagggtaacggtaacggtacgggtaacgtaccgttaacgttaaccgttttaacgtttaccgttacggtaacctaaacgtaccggaacggtaaccgtaacgaaccggtaggtaaccgttagggttttacgggttttacgggttttggggtacgggttaccggggacggggtaaccggaaccgtacggtcgtaccggtaccgtcggtacggtacgccggtaccggtacgtcccccgg

SEQ ID NO: 120072 - DNA, 653 bp, Homo sapiens
  misc_feature: GYAE6OF01BKPJZ.2.38.D05.1.454.CMB.1.raw
  modified_base (172)..(172): a, c, t, g, unknown or other
  misc_feature (172)..(172): n is a, c, g, or t
  modified_base (185)..(185): a, c, t, g, unknown or other
  misc_feature (185)..(185): n is a, c, g, or t
  modified_base (279)..(279): a, c, t, g, unknown or other
  misc_feature (279)..(279): n is a, c, g, or t
  modified_base (404)..(404): a, c, t, g, unknown or other
  misc_feature (404)..(404): n is a, c, g, or t
  modified_base (507)..(507): a, c, t, g, unknown or other
  misc_feature (507)..(507): n is a, c, g, or t
  modified_base (544)..(544): a, c, t, g, unknown or other
  misc_feature (544)..(544): n is a, c, g, or t
  modified_base (568)..(568): a, c, t, g, unknown or other
  misc_feature (568)..(568): n is a, c, g, or t
  modified_base (600)..(600): a, c, t, g, unknown or other
  misc_feature (600)..(600): n is a, c, g, or t
tcagacgctcgacacacgaccggtgctcgatttagtatctgatagttggggtttgggggagcccagccctgggattcccagctgtttctgcttgcctgatcaggactgcacacagagaacctcacccatggagtttgggctgagcgtggtttcgtgtagctatttaaaggtntcagtgtgaggtncgagtcgtgggtggaggtccgggggagtcttagtcacgccgtgggggtccctgacgcctctccgtagtgcagtccgtcgtggtacttcaccttnagttacgctacgtggatgctacgtcggccgcaagccgtaccgaggggtacgggcttgggtgttgggtcctacgtagttaattagtacgtcgtaggtcgggtatacgcacgtagcgtacgcgtacncgtaggaaggccgtaattccgacctacgtcccacgaagtacgtaccaacccggaccaaaggaacccctgctttagggaacttccgaagaactaaggcgtaacncggtacaggaggtaccgaccggtaaggtccacggttnttagtaacggttatccggttaggnttaaacgagggtaagtacgccgggaccttaanccgggttaccggtacgttaacccgggacctccgggtacccgttaacccggggg

SEQ ID NO: 120073 - DNA, 794 bp, Homo sapiens
  misc_feature: GYAE6OF01ER4BB.2.38.D05.1.454.CMB.1.raw
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
tcagacgctcgacacacgaccggtgctcgatttagtatctgatagctgggttttccttgttgcttattttaaaaggtgtccagtgtgaggtgcagctggtggaggtccgggggaggcttagttcagccgtggggggtccctgagactctcctgtgcagcctctggtattccacctttcagtagcttacgtggatcgcctacgtcgggtcccgaccgaacgcctaccggaagggggacggggtcttgggtggttcggggtctacgtaacgttaatttaagttaggtgagtaggggagtagaccaacaacggtccgtaaccggcggtacctcggtaggacgggtccctattccacctactcctaccgaaggaacgaccgaaccgaccaaacgaaccncgctagtactcgtanaacgtaaatacggaaactcgtagtacggacggaaccggaccggaagaccgtaacggtcgttagttagtttaacgttacgtaggtacgaacgaaaggtagtaacgtacgtaccgagaccgtagggtcccggtacggtacccggaccggtaacggttcccgggacggggacccgtaaaccgggtacccgttcggtaccctacccggttccctccgaccgacccgtccccgtaacccgaacccggtaaccggtccctaccgggttccccgttcccccttcccggcggacccccgttcccgtaccggtccctaaccgggacggaccctaccccggtacccgaccgggaactaccggacccgaccggcccggggccccggttacccggg

SEQ ID NO: 120074 - DNA, 713 bp, Homo sapiens
  misc_feature: GYAE6OF01D2NNE.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacacgcccacccgttcggtgtcagtcgtccccaggacagacggccaggatccacctgctcgtggagtatgcctattcgaaccgaaaagactaaattatgtactttagttacgtaaccagacaaggaacgccgacggccacggtccccgtggtcgtcgtggtagtaataacgtaaaagtaaaggacgaggtaggaacggtaccggaccccgttacggaacgggtaccttcccgtaggacgtcgttaactttcgtccggttacggcctaccgacgtctaacgggaacggtaacaacgtacgtccgtaacgttcgaactagtacgaggtggaaccgtcgaggacaaggaacgtagtaggacgtcgtaagtaccttaatttacggtactactaactacgacgtaacgtaagaccgtaggtaccggtttaggtttacgggtttttacgggttttacggggtcgggttaccggggacgggtaaccggtaaccgacgggttccgtaaccggtacccggttacgtacggtaccgacccggaccggtaccggtccccgg

SEQ ID NO: 120075 - DNA, 662 bp, Homo sapiens
  misc_feature: GYAE6OF01D52OX.2.38.D05.1.454.CMB.1.raw
  modified_base (236)..(236): a, c, t, g, unknown or other
  misc_feature (236)..(236): n is a, c, g, or t
  modified_base (501)..(501): a, c, t, g, unknown or other
  misc_feature (501)..(501): n is a, c, g, or t
  modified_base (508)..(508): a, c, t, g, unknown or other
  misc_feature (508)..(508): n is a, c, g, or t
  modified_base (559)..(559): a, c, t, g, unknown or other
  misc_feature (559)..(559): n is a, c, g, or t
  modified_base (620)..(620): a, c, t, g, unknown or other
  misc_feature (620)..(620): n is a, c, g, or t
tcagacgctcgacacacgaccggtgctcgatttagtatctgatagttgggtttgggggtgggtccaggaggcagaactctgggtgtctcaccatggcctggactccctctacttcctccccctcttcactctctgcacgaggctctggacggccctcctatgagctgacacacgcccacccgtggtgtcagtccgtcccaggacaggacggccaggactccacctgcctcgtgganattgactagttcgaaccaaagactaaagtatcgtactttagttacggtaccaggacaaggacgccgacggacccgacggtccccgtaggtcggcgttagggtagtaataagtaaacgttaaaacggacgtaaggtacggaacgtaccggcccgtaggacgggtaacctcccggtagacgacttcgttcctcgtacggccctacgacgtacgtacggacggaacctaagtacgtctacgttacgaacacgttacggagtacggtanacgaagngaaacgagagtaggagtaccgtataactttagtactagtaacaatcgaacncgaactgagtacgtagggttgttttaacgggttggtaggtaccgggacggtagtaacccgnggtcgtacgtaccctaggttcgtacgaccgtcgacgttcccg

SEQ ID NO: 120076 - DNA, 658 bp, Homo sapiens
  misc_feature: GYAE6OF01AFUHW.2.38.D05.1.454.CMB.1.raw
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacacgacggccaggactcacctgctcgtggagatgctattcgaccaaagctaattatcgtacttagtcggtaccagacaagacgcgacggccacggtccctgtcgctggtnatataataagacagtgagacgcctaggacggtactcccgtaggacgtactacgttcncgtcggtcctccaggtcctacgggaacggaacctacgaccgttaccgtaacgttacgacctacgtcgtaacggtacggacgtaccggtacggacgtaacggaagtaacgtaggacgtacgtagtaacgttattaccgtagtaacactagactacggggaactagaacgtacgttaggtttacggtttacgggttttaggggtacggttacgggtacgggtacgggtaccggtacggtaccggtacggtaccggttaccggtacggtaccgccgtacccggtaccggttaccccggg

SEQ ID NO: 120077 - DNA, 715 bp, Homo sapiens
  misc_feature: GYAE6OF01ENI9N.2.38.D05.1.454.CMB.1.raw
  modified_base (233)..(233): a, c, t, g, unknown or other
  misc_feature (233)..(233): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgacggcctcctatgagctgacacacgcccacccgtcggtgtcagtcgtacccgaggacaggacggccaggactccacctgctcgtgganatgctattcgaccaaagctaatagtgtctttagtacggtaccagacaagaacgccgacggaccgaccggtccccttggtcgcgttggtagtaattaaataagtaaaacgacgtaggtaggaacgaccggtcccctacggaacgggtacctcccggtaggacgtacgtacgttccgtcgtccggtaccctaccggacgtccgtaccgggaaacggtaaccaaacgtacgttaccgtacggttacaacccgtagtacgaggttacggacgtaccgaaggacaaggaagtgtagggtacgtacttagtaactttacttacgtacgtaacaagacgtaagacgaacgacgacgtacggttaggtttaggttttacggttttcgggtacgggtacgggaacgggtacgggtaaccgtaagggtcccgttaaacgggaccccgttacggtaaccgggtaccgaacccggtacccggtacggtccccgg

SEQ ID NO: 120078 - DNA, 713 bp, Homo sapiens
  misc_feature: GYAE6OF01D0TYV.2.38.D05.1.454.CMB.1.raw
  modified_base (221)..(221): a, c, t, g, unknown or other
  misc_feature (221)..(221): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctgganatgcattgaccaaagcaatatgcttattggtaccagcaagaagccaggccaggcccctgtgctggtgatatataaagcagtgagacggccctgagggactcccgtgacgcgtactttcgtcgtgggaccttccgaagtcctacgaacgggtaccaaacgtacgtaccgtaaccggtttacggaaccctaagttaccgaacgggtttacgggtaaaccgttacccgaagggtaccgtaaagggaaacggtaacgtacgggaggtaccttaggtaacctttaaggtttaacctggtaactaacgttcccgaagtaccgaaggaaccgtaggtaccgtaagggtttacgggttttaaccggttttttggggggttaccggttttaccggggggtaccggtaaacggggggtaacccgtaacgggtacccgttacgggtaaccccggttaccggttaacgggtacccgacccggtaccccgtaaaggggtcccccg

SEQ ID NO: 120079 - DNA, 693 bp, Homo sapiens
  misc_feature: GYAE6OF01BZK9T.2.38.D05.1.454.CMB.1.raw
  modified_base (558)..(558): a, c, t, g, unknown or other
  misc_feature (558)..(558): n is a, c, g, or t
tcagacgctcgacacacgaccggtgctcgatttagtatctgatagttgggtttgggggaagaggaagactgacggtcctgccacaggtggtgctgggcacgggtgggcactcgacacaacatttgcgctcaactgtcttgtccagtgtgaggtgcagctggtggaggtccgggggagtcttagttcaggccgtgggggtccctggagactctccgtgtgcagcctgtggtacttcctaccttcagtagctacgtggatcgcgaccgttcgggtacccaccgaagccgtaccggaagggggaacggggtcttaggggtggtcggggttcctacgtacgttaattaagtggtgagtagggagtagacaacgaagccgtaacggccgtacgtccggtaggaacgggcctacttaccgactactcctacgagaaccgaacaaccgacaaaacgaacgctacgttacgtacttcgtacgaacgtaaagtacgaaactagtacgtaggaacggaccggtaaccggaagggaccgtcggtacgttacggtttaagtacgtttacncggttaagaaccgtaaggaacgtagtacgacgacgtacgacgtacgtaccgggtaccgaccgtacgtacggtcggggaacccgtaaccgggtacctacgtaccgtacccgttccgtaccgtcgcccgtaaccccg

SEQ ID NO: 120080 - DNA, 720 bp, Homo sapiens
  misc_feature: GYAE6OF01D8KGK.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgctattgaccaaagacaatatgtacttattcggtacctagcaacgaacgaccgacggacccgacggcccctggtcgcgtggtagtataataagtaaacgacgtaggtaggaaggacggcccctacggacgggtacctcccgtggacggacgttaacttcctcgtcggtcctaccgacgcctaccggacgggaaccaaccgtacgtaccgtaacggttccgaacctacgtcgtaacggtacgggtacgtaccggaacggacgaaggaagaggtacggagggtcttacggtaactttacgttaaccgtcgttaactaactcgaagtaccgacgaaacgagtaccgggttaaggtttcggggtttttaacggtttttggggttaccggggttcggggaaacccggggtacgggtaaccggtaacgggtcccgttaacggtacccccggttaccgggttacggtacccggtacccggaacccggtacccgggtacccccgg

SEQ ID NO: 120081 - DNA, 765 bp, Homo sapiens
  misc_feature: GYAE6OF01DC092.2.38.D05.1.454.CMB.1.raw
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (403)..(403): a, c, t, g, unknown or other
  misc_feature (403)..(403): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccgccaagctccgaggggagggctggtgtggtctcacgtattaatagtgagtgggatagcacaagctacggcggactcgtagaagggccattcaccntcnccagacgacaacgccaaagacacgctagtactacgtgaactaaatacgaaactgtcgtgaacgacggaccggaaggaccgacggtctaggttagttaactttacgnggttagaaccgaaaggacgtaagtacggacgaaggccgaacgggtcgttacgggtacccgtacccggaacgttaccgggtcgggggaccccgtaaaccggggtaaccccgttcgggtaccctaccccggttcccttacccgtacccgtaaccgtcccccgttaaccccgaaacccggtaacccggggtacccccttaaccgggtttcccccgggtttacccccctttcccccccgggtcgggtacccccgtccccgttaccggtccccgttaaccccgggaacgggtacccgacccccggtaacccgtacccgggaaacgaccggaccccaaaccggtcccggggcccccggtaccccgggg

SEQ ID NO: 120082 - DNA, 644 bp, Homo sapiens
  misc_feature: GYAE6OF01DELO2.2.38.D05.1.454.CMB.1.raw
  modified_base (275)..(275): a, c, t, g, unknown or other
  misc_feature (275)..(275): n is a, c, g, or t
  modified_base (498)..(498): a, c, t, g, unknown or other
  misc_feature (498)..(498): n is a, c, g, or t
  modified_base (510)..(510): a, c, t, g, unknown or other
  misc_feature (510)..(510): n is a, c, g, or t
  modified_base (588)..(588): a, c, t, g, unknown or other
  misc_feature (588)..(588): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagtcttgggttttccttgttgtcttaattttaaaaggtgtcctagtgtgaggtgcagcgtgggtgggacgggtccggggggaggtcgttagttcgacggccgtcgggggtccctgagactctcctgtgtcagcctntggtacttccacctttacagtagtcctacgtggatcgctacgtcgggtcccgaccgaacggtccgtaccggaaggggagggtcggtgggtggtcggtctcgtaacgttagttaatagtgtagtgggagtacgacaagaacgacgtaacggtcggacctcggtacggacggcctagtaccactaacgtccaccaaggacaaccaaccgaccaaagacccacgtntagtactacganaactaagtcgaactgtcgaaggacgaccggacgaggacgtacgtagttagtacgttaatcggagagaacgtaaggtanaacgtcgacgacgtacgtacggtaccgttaggaacccgtaccgtaccggtacgggg

SEQ ID NO: 120083 - DNA, 710 bp, Homo sapiens
  misc_feature: GYAE6OF01CQ8KZ.2.38.D05.1.454.CMB.1.raw
  modified_base (332)..(332): a, c, t, g, unknown or other
  misc_feature (332)..(332): n is a, c, g, or t
  modified_base (504)..(504): a, c, t, g, unknown or other
  misc_feature (504)..(504): n is a, c, g, or t
tcagacgctcgacacacgaccggtgctcgatttagtatctgatagttgggtttgggggtgggtccaggaggcagaactctgggtgtctcaccatggcctggatccctctacttcctcccctcttcactctctgcacaggctctgacggcctcctatgagctgacacacgcccacccgtcggtgtcagtcgtccccgaggacaggacggccaggactcacctgctgtggagtatgtatcgaaccaaagcctaatatgtactttagttacggaaccagacgaaagaacggcccgaacgggcccgaacggtcccccgttggtcgtcgtagggtanaattaagtaagtaaaagacgtaggagacggaccggccctaggacgggtactcccgtagacgtactacttcgtctcggcctaccgaggcctacggaacggaacaaacggtacgtaccgtaacggttaccgactacgtacgacgggtaggacgtaccgaggaacgaaggtaagngtaggacgtactagtaactttattaccgtagtaactaatacgagaactacggaacgtacggtacgttagggtttacggttttaggttttcggggacggtttaccggggacggggttaacgggaaccacgggttccgttacccgggtaacccgttacggttaccggaccgtacccgggaacccgtacgggtccccgttacccccggg

SEQ ID NO: 120084 - DNA, 605 bp, Homo sapiens
  misc_feature: GYAE6OF01D7UI3.2.38.D05.1.454.CMB.1.raw
  modified_base (332)..(332): a, c, t, g, unknown or other
  misc_feature (332)..(332): n is a, c, g, or t
  modified_base (363)..(363): a, c, t, g, unknown or other
  misc_feature (363)..(363): n is a, c, g, or t
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
  modified_base (585)..(585): a, c, t, g, unknown or other
  misc_feature (585)..(585): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagtcagccgtggggggtccctgagactctcctgtgcagcctctggacttcaccttcagtagctactggatgcacgtcgggtcccgacaagcctaccgaggggaagggctggtgtcggtctcgacgttattaagtagtgagtgggagtagcaanacgctacggcgactcgaggacggctatcacntcncagacacaacgcaagacacgctagtactntacgacaatagaaactagtacgtaggaaggacgaccgggaagaccgtacggtcgttaggttataacgtttacgtggtacgtacgaaagtacgaagtagaccgaggaccgaggtaccgtacgggtaaccgacccggtacgttaccgggcgggggacccaacggggtaccctcgggtaccctacccgttccncccgtaccgaccgtaccccg

SEQ ID NO: 120085 - DNA, 563 bp, Homo sapiens
  misc_feature: GYAE6OF01ALXVD.2.38.D05.1.454.CMB.1.raw
  modified_base (292)..(292): a, c, t, g, unknown or other
  misc_feature (292)..(292): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaaagcaatatgcttattggtaccagcaagaagccacggccacggcccctgtgcgtggtnatatataaagacagtgagacggcctgagggactcccgtgacgcgattctcgtcggctccgagtcctacgacgggacaacgagtacaccgttgaacctagtaccgaggtcggacgtccgaggactaagaagtagtggacgctagaacttattacgtagtacaactcgaagtcgaagacacgtcgtaggttggttacggtttttgggtggttaccggcgggtacgggacacggtcgtacgtaccgtccgtagtaccgacgtcccgaggtcccg

SEQ ID NO: 120086 - DNA, 798 bp, Homo sapiens
  misc_feature: GYAE6OF01DZQBG.2.38.D05.1.454.CMB.1.raw
  modified_base (483)..(483): a, c, t, g, unknown or other
  misc_feature (483)..(483): n is a, c, g, or t
  modified_base (674)..(674): a, c, t, g, unknown or other
  misc_feature (674)..(674): n is a, c, g, or t
tcagacgctcgacacacgaccggtgctcgatttagtatctgatagctgggttttccttgttgctattttaaaaggtgtccagtgtgaggtgcagctggtggaggtccggggaggcttagttcagccgtgggggtccctgagactctctgtgcagcctcgtggattccaccttcagtagctacgtggatcgacacgtcggtccgaccaagcctaccggagggaggggtctgggtggtcgggtctacgtacgttattaagtaggtaggagttagggagtacggaccaagaacggtccgttaaccggcggtaacgtccggtaagggaacgggtcctaacttccaaccgtactcccgtaacgaaggacaaaccgtaacccgaccgaaaacggaacctacggtcgtagtactacgtacgaacctaaaagtcgaaacgtgttacgaggacggacgtaccgggagggactacggtctagtacgttatcgngacgtaagagaagtatacggactaggactacggacgttaccggtaccgaccgtaaccggtacgggtacgggaacccgtaaccgggtaacccgttcgtacccggtacccgttcccgaccctaccggtaccctacccccggttaccggaacccggaacccgggtacccgttccccggtccggttttacccccncccggttccggtaccccgcccgtaaaccccggtccgtacccggggtaagaccccggttaccccgaacccgggttacgtaccggaaccggttccggaaaccggttccgggaccccggggttcccg

SEQ ID NO: 120087 - DNA, 738 bp, Homo sapiens
  misc_feature: GYAE6OF01COL9L.2.38.D05.1.454.CMB.1.raw
  modified_base (226)..(226): a, c, t, g, unknown or other
  misc_feature (226)..(226): n is a, c, g, or t
tcagacgctcgacacacgaccggtgctcgatttagtatctgatagttgggtttgggggaagaggaagactgacggtcctgccacaggtggtgctgggcacggtgggcactcgacaacaacatttgcgctcaactgtcttgtccagtgtgaggtgcagctgggtggaggtccgggggaggtcttagttcagccgtgggggtccctgacgactctcctgtgcagcctntggtattccaccttcgagtacgcctacgtggatcgccacgtcgggtcccgaccgaagtcctaccggaaggggaaggggtccttgggtggtcgggtctacgtaacgttaatttaagtaggtacgtaggtgggtaactacggacaacgaaacgtccgttaaccggccggtaaccgttaccgggaaggtaaccgggtccgttactaaccgacctacgtacctaacgagaaccgaacaaccgaaactaaaccgacctacgtacttacgtacgttcgaacgaaacgtaaagtacgaaacgttcgtacgtaacggacggtaccggaaccgggtaaccgtacgggtacgttagtttaacggttattaaccgtttacgtacggtacgtaaaagtaacgtagtaacggtacgacctacggacgtaaccggtcgaaccgggtccaacccgggttacgtcgggaccggtacggaaacccgttccgtcgtaccccgtacctccggtaccaccgtccgaaccccg

SEQ ID NO: 120088 - DNA, 831 bp, Homo sapiens
  misc_feature: GYAE6OF01CHKCP.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccagtggtaggttgggctgagtcgttgggtttttccttgttgtacttaaagttttaaaaggtgtcctaggtgtggaggtgcagtcgtgggtgggacgggtccgggggtaggtcgttaggttcgacggtccgggttcggggggtccctggacgtaccttccgttccgtggtcgccgacggtcccttacgtacggtactttccctacccgtttacgaggttaacgcgttaacggtgggtatcggaccgtaccgggttccgggtaccccgaaccgtaacggcccggtaaccgggaagggggtaacgggtccgtttggggtcggttcggtaccttaccggtaagttaaagtttaagtagtaggtaggttaggggaagtacgaccgtaaacgtaacggtcgtaaccgggccggtaaccgttaccgggagggaaaccgggtcttaaccgttaccaacccgtaagtccctaacggaaacgaccgaaacccgaaccgaaacccgaaaacgaacctacggtacttacgtaactcgaaagaaacctaaagtacgaagtacgtacgaggaacggaccgggtaaccgaacggtaccggtagggttacgtttaggttaacgttaatttccgggaggtaacgaaacggtaaaggattacggactaccggagacgttcgggacccggttaccgggacccgtacccgggtaaccggtaccggggg

SEQ ID NO: 120089 - DNA, 762 bp, Homo sapiens
  misc_feature: GYAE6OF01EMXOW.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattcgaccaaagctaatatgtctttattcggtaccagacagaacgccaggccgacggcccctggtcgcgtggtgatataagtaaagacaggtagagacggccctagacgggactcccgtgacggtcgtatttcctcgtcggtccctacccgagtccgtacggaacggggaaaccaaccgtacgttaccgaacgggttttcgaacccgtagttaccgagggttacgggtaaccgttacccgaacgggtaccgtaaagggaaacggtaggttacgggaacggtaccgttagtaacctttaacgtttaccgtacggtaaccttaaacgtccgaaggtaccgtaacgtaaccgacggtacgttaaggggtttccgggttttttaacgggtttttagggggttaccgggtttaccgggggtaaccgggggtaacggggttacccgtaaacgggttcccggttacccgggtaaccccgggtttacccgggttacgggtaacccgtaacccgggtaacccccggtaaacggggttccccccgg

SEQ ID NO: 120090 - DNA, 778 bp, Homo sapiens
  misc_feature: GYAE6OF01EHZ8V.2.38.D05.1.454.CMB.1.raw
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctcctatgagctgacacagcccacccgtcggtgtcagtcgtccccaggacagacggccaggactccacctgctcgtgganatgctattcgaccaaagcaaatntgtacttagttcggtaaccagacaagaacgccgacggcccgacggtccccctggtcgtcgtgggtataattaagtaaagtaaaacgacgtagggtaggaacggaccggtacccgtacggaacgggtacctacccgtaggacggacgttactttccgttccggtacgggcccttaccgacggtccgtaaccggaacgggtaaaccaacgtacggtaccgtaaccggttacgaaccgtacgtacgtacgggtaggtaccgtaccgaagggacgtaaaggtaacgtagtacgggacgtcgttaacgtaactttacgttaacgtcgtaactaacgttaccgaacgtacgaacgtaacgtacggtacgttaaggtttacggtttttacgggtttttccggggtacggttaccgggggtaacgggtaaccgggtaacccggtaacggtcccggtttaaccgggtaaccccggtttacccggttaacgggtaccccgaacccgggttaacccccggtagggttacccccccgg

SEQ ID NO: 120091 - DNA, 816 bp, Homo sapiens
  misc_feature: GYAE6OF01BINJI.2.38.D05.1.454.CMB.1.raw
  modified_base (310)..(310): a, c, t, g, unknown or other
  misc_feature (310)..(310): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctcctatgagctgacacagcccaccctcggtgtcagtcgtccccaggacagacggccaggatcactgctcgtggagatgctattcgaccaaagacaaatatgtacttagttcggtaaccagacaagaacgccacggaccgacggcccctgtcgcgtggtanaataataagtaaagacgaggtacgaggaccggtacccgtacgacgggtactcccgtaggacgtacgttacttccgtacgttggtcccttaccgacgtaccgtacggaaacgggtaaccaaacgtacgtaccgtaacgttacggaacctagtacgtacgggtacgggttaaccaccggaaggtaacaaagggtaacgtaggttaacggaggtacccgtaagttaacctttaagtttaaccgtaggttaaaaccaaggttaccgaaacggtaccgtaaacgggtaacgtaaccggttaacggtttaaccggggttttaccggggttttttaaacgggttttttccggggggttaccggggtttaaaccggggggaacccggggggtttaaaccggggtaaaccccgtaagggttaccccggttaaccgggttaacccgggttaccccgggtttaaacgggtaacccgtaacccccggggtaaaccgggtacccgggggttaccccccg

SEQ ID NO: 120092 - DNA, 843 bp, Homo sapiens
  misc_feature: GYAE6OF01CC8DJ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggatcacctgctctggagatcgctattcgaccaaagacaatatgtctttagttcggtaaccagacaagaacgccgacggccgaccggtccccctggtcgtaccgtgggtagtaacttaataaacgtaaaacggaacgtaaggtacggaacggaaccgggccccgttacggaacgggtaccgtaccccggttaggaacggtcggttaacgtttcccgttccggttcggtaccccttacccggacggtccgtaaccgggaaacgggtaaccaaaccggtacgttacccgtaacggtttacggaacccttaacgtaccgtaagggttacgggtaaccggtacccgaagggtaacgaaagggtaacggtaagtacgggaagggtaccgtacgttaaaccgtttaacgtttaaccgtacgttaaccgtaaagttccggaaacggtaccgtaaacgaacccgtaaggtaccggttaaggggtttttacgggttttacgggtttttttacggggggtaccgggttaccgggggtaacgggggtaaccggggtaaacccgtaggggttaccccgtacgggttaacccccgggttaccggtacggggttaaccccgaccgggtaaaccccggtaccgggtaccccccg

SEQ ID NO: 120093 - DNA, 786 bp, Homo sapiens
  misc_feature: GYAE6OF01BEKQD.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctcgtggagatgcattcgaccaaagacaattatgtctttagttcggtaaccagacaaggaacgaccgacggacccaccgggccccctaggtgtccgtgggtacgtaattaattaaagtaaacgacgaaggtaggaacgacgggtcccctacggacgggtacctaccccgtaggacgacgtactttccgtccgtacggtcccttccgaaggtccttaccggaaacgggaactaaaccgtacggtaccgtaaccgttacgacctagtaccgaggtacgggtacgtacccggaagggtaccgaaaggtaacgtaaggtacgggtaacggtaccgtaacggtaaccgttttaagtttacccggttagtaacctaaacgttacgaacgtaaccgaccggtaaacgtacggtacggtacgggttttacggtttttaacggggttttttcgggggtacgggtttaccgggggaaccgggggttaacgggtaacccggtaacggtaccgggttaccggtaaccccgggttacggttaacgggtaccgaacccgggtacccgtaaccggggttccccccg

SEQ ID NO: 120094 - DNA, 686 bp, Homo sapiens
  misc_feature: GYAE6OF01CNDAQ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacacgccacccgtcggtgtcagtcgtccccaggacaggacggccaggactcacctgctcgtggatatgacattcgaccaaagcaaattatgtactttagttacggtaaccgagacgaaggaacgaccgacggaccgaccggtcccccttggcgtccgtggttacgattaagtaaagttaaagaacgtaaggtacgacggaccgcccgtacggaacgggacctccggtagacgacgtattcgtacgtcggcctacgacgtcgtacgacgggaaacacgtacgtaccgacgttcgaacctagtcgtaggtacgggacgtaccgaagggacaagggaagtacgtaggaggtactagtaaccttagtttaccgagtacaactcgaacgactaacgactggtaaccttagggttaggttttccggttaggggttcggttacgggaaccggggttacggaaccggtaccggtaccggtacccggtccgttaaccgggtacgaacccggacgaccccgggtacggtccccg

SEQ ID NO: 120095 - DNA, 1002 bp, Homo sapiens
  misc_feature: GYAE6OF01ENAXP.2.38.D05.1.454.CMB.1.raw
  modified_base (278)..(278): a, c, t, g, unknown or other
  misc_feature (278)..(278): n is a, c, g, or t
tcagacgctcgacacacgaccggtgctcgatttagtatctgatagttgggtttgggggagccccagccctgggattcccagctgtttctgcttgttgatcaggactgcacacagagaactcaccatggagtttgggctgagtcgttgggttttccttgttgtacttaagttttaaaaggtgtccagtgtggaggtgcagcgtgggtgggagggtccgggggaggtcgttagttcgaggtccggtcggggggtccctggacgtctccgtccgtgtcgcncgtcctcgtggtacttcctaccttacgagttacgtactacgtggtactcgaccgtacggtccgggtaccccgaccgtaacggcccggtaccgggaaggggggaacgggggtcggttggggttcgggttcgggttaccttacgtaaacggtttaatttaaacggtaggttagggtaaggttagggtaacggtaacggacaacggtaaacggtcccggtaaccggggaccgggtaacccggttaccgggtaacggggtaaaccggggtaccccgttaacgttacccgaacccgttaccgttacccgtaaccggaaagggtaaaccccgaaaacccggaaaccccggtaaccccgtaaaaaggaaccccgtacgggttaccgtttaaggttaaccgttccgtaaacgggtaaacctaaaaacggttccggtaaaacgtaccgggtttaccgggtaagggaaacccgggtaaccgggaaaccccggggtaggggtaaaccccggttaccgggggttattttacggggttaacgtttaaacggttttaccggtaggggttaacccgaaaacgggttaaaaggggtaacgttacggggtaaacccgggaacgttaacgggtaccccgggtaaacggggtttccccgggggtttaaaaacccccggggcccccgggtaaaccccccggggtttaaagggttacccccgggggggttaaacccccggggggg

SEQ ID NO: 120096 - DNA, 683 bp, Homo sapiens
  misc_feature: GYAE6OF01AV4LW.2.38.D05.1.454.CMB.1.raw
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (377)..(377): a, c, t, g, unknown or other
  misc_feature (377)..(377): n is a, c, g, or t
tcagacgctcgacacacgaccggtgctcgatttagtatctgatagttgggtttagggggtgggtccaggagcagaactctgggtgtctcaccgatcggcctggatccctctacttctcccctcttcactctctgcacaggctctgaggcctctaatgagctgacacacgcccacccgtcggtcgtccagtcgtccccaggacacggacggcaggactccgacctgctcgtagggagatcggctatttacgaccaaaagctaaactntacgtcttaagttcggtaaccnggacagaacgccaggccacggtcccctgtgtcgtggtnaattanaacgtaacgacgtaggtacgagaccgcctagaacgggtctaccgngacgtcgtacttctcggcggcctaccgacgtcgtacgacggaacctacagtaccaggttcacctagactagggtcggaacggtaccgaggtaccgaagtaaacgtgttaacggagtcgtaacggttacttaacggttacttaacgggttacaaaccgttcgaaccggtacgaaaccggtcgtaaccggtaggtacggttttagggttaacggtttttacgggacggttacgggacgggtaacggtcgttaacggccttacgggtccttaacggttaccgaccggaccgtaccggttccggaccccg

SEQ ID NO: 120097 - DNA, 839 bp, Homo sapiens
  misc_feature: GYAE6OF01C2Q6G.2.38.D05.1.454.CMB.1.raw
  modified_base (201)..(201): a, c, t, g, unknown or other
  misc_feature (201)..(201): n is a, c, g, or t
  modified_base (470)..(470): a, c, t, g, unknown or other
  misc_feature (470)..(470): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtcgggtccnccaagctccgaggggagggctgggtgtgggtctcgtacgttaattaagtagtgagtgggagtacgcaacgaagctacggacgtacctcggtaggaacgggtccgtaattccaaccgtctcctacccgaggaaccgaaccaaaccgaccgtaaagaacctacggccttaggtactacgttacgaacaaagtacgaaacctaggttaccgaggaacggtacggacccggaaggacggtaaccggtcttaggttacgttaacgttttaacgnggtagtaaccgtaaagggacgtaagttaacggacgtaacggtacgaacgggttacggttacccggtaacccggtaacccggttaaaccggttaccggggtccgggggaaacccggtaacccggggtaaaccccggttcggttacccccgtaaccggtttccccgttaccgtaacccgaccgtaccccccgtacccggtaaacccggtaaccgggtaccccttaccggttcccgggttacccccttcccccgggtccggccccgttccccgtacggaccccggttacccggacggtaacccgccccggttaacccgtacgggaacccgaaccggtacccgaaaccggtccgggtaccccgggtccccggg

SEQ ID NO: 120098 - DNA, 734 bp, Homo sapiens
  misc_feature: GYAE6OF01BSTE3.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgagcctcctatgagctagacacacgccaccctcggtgtcaggtcgtccccagggacaggaccggccagggactccacctgcctcgtggaagctgactattcgaccaaaagctaaacgtatgtactttaagttacggtaccagcaagaacgccgaggccgacggccctggtcgcgtgggtacgaattaacgtaaagtaaaacgacgtaaggtacggaacggaccggtaccccgttacggacggggtactacccggttaggaacgtccgttaatttcccgtacggtcggtccttacccgaggtacccgtacgacgggtaaaccaaacgtacggttaccgtaacggttacgaacccgtaagttaccgtaagggttacgggttaacggtacccggacggaagaacggaaacggtagtacgggagtaccgttagtaaccttaacgttaacttacggttaaacaacgttacgaacgtcgtaaacgacgtacgtacggttaggttacggttttacggttttggggtacggtacgggtaggaaccggtcgaaacgtcgtaccgtaccggttaccgagtaccgacgtacccggtagtcccg

SEQ ID NO: 120099 - DNA, 690 bp, Homo sapiens
  misc_feature: GYAE6OF01C1TF3.2.38.D05.1.454.CMB.1.raw
  modified_base (484)..(484): a, c, t, g, unknown or other
  misc_feature (484)..(484): n is a, c, g, or t
  modified_base (528)..(528): a, c, t, g, unknown or other
  misc_feature (528)..(528): n is a, c, g, or t
  modified_base (606)..(606): a, c, t, g, unknown or other
  misc_feature (606)..(606): n is a, c, g, or t
tcagacgctcgacacacgaccggtgctcgatttagtatctgatagttggggtttgggggagccccagccctgggattcccagctgtttctgcttgctgatcaggactgcacacagagaactcaccatggtagtttgggctgagtcgttgggtttttccttgttgtacttaagtttttaaaaggtgtccgagttggtggaggtgcaggtcgtgggtgggacgggtccggggggaggtcgttagtcgacgggccggtcggggggtccctggacgtccttcctcctgtgcacgtcctcgtcggtacttcctaccttcagtacgtcgtacgtgatcgaccgtacggtcgggtcccaccaaggccgtacggaggggtagggtcgtgggtggtgggtctacgtagtaattagtaggtgaggtggtagacgacaacgacgtcgtacggacggtacgtcggaggaacggtctacgttaccacctacgtaccncgaagaacgaaccaacgacaaacgacacgtgtacgtactcgaanaacgtaagtcgaaacgttcgtagacggaacggacggacgggaacgtaccgcggttacttaggttacgttacttacggnggtaacgaacgtaaagtaggtacgtaacgacacgggacgtacgggacgttaccggggaacccgtacccggtcggtacccggggg

SEQ ID NO: 120100 - DNA, 890 bp, Homo sapiens
  misc_feature: GYAE6OF01DDG92.2.38.D05.1.454.CMB.1.raw
  modified_base (178)..(178): a, c, t, g, unknown or other
  misc_feature (178)..(178): n is a, c, g, or t
  modified_base (225)..(225): a, c, t, g, unknown or other
  misc_feature (225)..(225): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgagcctcctatgagctgacacacgcccaccgtggtntcagtcgtcccaggacaggacggccaggactcacctgctctggaatntgntattcgaccaagcatntgtactttagtacggtaaccagacgtaaggaaccgccgaagggccccgaacgggtcccccttggggtaccgacggtttacggggttactaaacgttaacgttaaaaaggttaaaaccggacggttaaagggttcggaaacggggtacccggtacccccgtttacgggaaaccggggttcccttccccggttaaggacgtaacccgggtttatttttaccccggtcccgggtttcggtaacccccttcccggtaaacggttcccgtttaccggggaaaacgggggtaaaccctaaacggtttaacggttaacccggtaacgggttttaaccggaaccccgtttaacggttaacccggtaagggttacccggggtaacccggttaccggaacgggtaaaccggaaacgggtaacgggtaacgttacggggtaacggtaccgttaacgggtaactttaccgttaacgttcgttaacgtaacgtacctaacggtacaacggtactacggtacgttagggtttaccggtttacgggttttcggtagggttacccgggtaacgggtaaccgggtaacgtaacgggtaccgttaacgggtaaccccgttcgggttaaccggtacgtaaccccggtccgggtaaggtcccccgg

SEQ ID NO: 120101 - DNA, 571 bp, Homo sapiens
  misc_feature: GYAE6OF01A16BE.2.38.D05.1.454.CMB.1.raw
  modified_base (298)..(298): a, c, t, g, unknown or other
  misc_feature (298)..(298): n is a, c, g, or t
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
  modified_base (440)..(440): a, c, t, g, unknown or other
  misc_feature (440)..(440): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcaggccgtggggggtccctgagactctcctgtgcagcctctggattcaccttcagtacgctactggatgcacgtgggtccnccaagctaccgaggggaagggctgggtgtgggtctcgacgtattaatagtgagtgggagtagcacaagctacgcgactcgagaggccatcacatcncagacacaacgcaaagacncgtctagtactcgagacaaagtcgaanacgtctaggaacgagtacccggaggaccgtacgggcttaggtagttaattacgtggtacgacgaaaggaagtagtacggaacaggacctaaggcccgttacgggaacccggtcccggtaacgtaccggggg

SEQ ID NO: 120102 - DNA, 752 bp, Homo sapiens
  misc_feature: GYAE6OF01BUD6E.2.38.D05.1.454.CMB.1.raw
  modified_base (236)..(236): a, c, t, g, unknown or other
  misc_feature (236)..(236): n is a, c, g, or t
tcagacgctcgacacacgaccggtgctcgatttagtatctgatagttgggtttgggggtgggtccaggaggcagaactctgggtgtctcaccatggcctggatccctctacttcctcccctcttcactctctgcacaggctctgacgcctcctatgagctagacacacgcccaccctcggtgtcagtcgccccaggacacggaccggccgaggactccacctggcctgtggaagtntgctattcgaaccaaagtctaaatagtcgtacttagttacggacagcaagacgccgaggccgacggtccccgtgtcgtcgttggatagttaacaagtaaagacgtaaggtacggacggacggtacccctaaggtacgggaccttacccggtaggacgtacgtacgtttccgtacggttccggacttacgaccgtaccgtacggaacgggaacctaaccgacgttaccggtaaccgttacgaccttaagtacggtagggtacggaaccgttacggaagtaccgaaggtaagtacggtagacgggttaactaggttaacttaacgttacgtacgaattaacgacgtacgaacgacgttacgagtacggtttaggtttacgggtttacggttttacggggtcgggtaaccggggtcgggaaaccggttaccgtaacccgggtccggttaaccggttaacccggggtttccgtaaccgggttacccgacccgggtaaaccccggtccgggtttaccccgg

SEQ ID NO: 120103 - DNA, 726 bp, Homo sapiens
  misc_feature: GYAE6OF01AT99S.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctctggattcacctttcagtacgcttactggatgcacgtcggggtcccgaccaagcctccgaggggaaggggctgggtggtcgggtctcgtacgttatttaagtagtgagtgggagtagacaacagtcgtacggccggtacgtccgtaggaacgggccgtattccacctatcctaccgaagacgaaccaaccgaccaaagaaccacgctagtactccgtagaactaaagtcggtaaaccctaggtttccgaaggtaacggaccgggtaacccggaagggaaccccgtacgggtcttgggtttaagtaacttttacggtcgggttaacgaacgaaaaggtgtaaacgtacggaccgtagaccgtacgggtaccgtttaacggggaccccgtacccggtaaccggttaacccgggacgggggggtacccccaaaccgggggttaaacccccgttcgggtaacccccgtaccccgttacccgtaccccgttccggaacccggtccccccg

SEQ ID NO: 120104 - DNA, 580 bp, Homo sapiens
  misc_feature: GYAE6OF01E1VZG.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggatcacctgctctggagatgcattgaccaaagcaatatgtcttattggtaccagcagaagccaggccacggcccctgtgctggtgataataataaagacagtgagacggccctacgacgggactcccgtggacgcgtattctcgtcggcctccgagctacggaagggaaccaacgacgttaccaacggtttcgaaccctatcgtaggtcggacgtccgaaggacgaagaagatggagtctagtacttactactagtacaatcgagacagacgagtagtacggttggtttacggtttttgggcggtttacggggacggtagggacctaggcgtacggtacccgtacgtaggaccgaccggtcccgaggtccccg

SEQ ID NO: 120105 - DNA, 686 bp, Homo sapiens
  misc_feature: GYAE6OF01DC95X.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctcctatgagctgacacagccaccctcggtgtcagtcgtccccaggacagacggccaggatcacctgctcgtggagatgcattcgaccaaaagcaatatgtacttattaggtaccagcagaaacgccgaggcccaggtcccctggtcgccgttggtagaataataataaagacgtagtagagtacggccctagagggactcccgtgacgcgtattcgtcgtggcctccgagtctacgagggaaccaacgtagtccgtaacgttacggaaccctagtaccgtaggttacgggacgttacccgaagggtaccgaaggaaagacgttaggaacgggtctaagggtaacttacgtttaacgtggttaacaaagttccgaaggaccaaaggtacctaacggtacgttaagggtttaacggttttacggtttttcggggacggtttaccggggacgggtaacggtaaacccggtaagtcccggtacggtaaccccggttcgtaaacggtacccgaaaccggtccccgtaaacgggtcccccgg

SEQ ID NO: 120106 - DNA, 707 bp, Homo sapiens
  misc_feature: GYAE6OF01D1CN4.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccacctcggtgtcagtcgtcccaggaccaggaccggccaggactccacctgctcgtaggagatgactagttcgaccaaagctaatatcgtacttagttacggtaccagaccaagaacgcacggccacgcccctggtcgcgtggtagaattaacgtaagtaaaggactaggtaggacggtacgtcccgtacggaacgggtactcccgtagacggtacgtacgtttcctcgtacggtcctaccgcgtaccgtacgaacgggtaaccaacgtacgttaccgtacgttacgaacctagtacgaggtacggtaacgtccggaacggacgaaacggaggtaagtagggacggtaccgtaagtaacgttaagtttaccgtagtaactaacgttacgaacgtacgaagtaccgtagtacgttagggtttacggttttggttttacggggtaggtttaccgggggacgggttaacgggacgtacgggttacggtccggttaaccccgttcggtacgggtaaccgaacccggtacggaacccggtccccg

SEQ ID NO: 120107 - DNA, 936 bp, Homo sapiens
  misc_feature: GYAE6OF01BVVTE.2.38.D05.1.454.CMB.1.raw
  modified_base (679)..(679): a, c, t, g, unknown or other
  misc_feature (679)..(679): n is a, c, g, or t
tcagacgctcgacacacgaccggtgctcgatttagtatctgatagttgggtttgggggtgggtccaggaggcagaactctgggtgtctcaccatggcctggactccctctacttcctcccctcttcactctctgcacgaggctctgacggcctcctatgagctagacacacgccacccgtggtctcagttccgaccccgaaggaccgacggaccggccaagggacttccaaccgtgtccgttacgtagggacgtacgttcgacgtaacggttacaaaacccgaaaaggtcttaaaagttagttcgtttaaccggttttacgttaccggggtaacctaagtaaccggaaaggaacccggacccgggttaaaccgggcccccgtaacccgggttccccccgttaagggttacgtccggtttaaggggtaacttaaattaaccgttaaaaggtaaaacgttaccgggaaggttacgggaacggttaacccggtccccgtaagggaaacgggtcccttacggttacggaaccggttcgttacctcggtcgtaacggtcccgtaccgacgtacccggtaggaaacccggtaaataaccggtcgttaaccctaacgtcggaacttaggacggtaggtacggcgtacgggacgaactaaggtaacgggacgtcgggtaacggttanaaccggttaacgtttaagtaccggtttaacgaaccttaaggacggaaccctaggtaaacccggtagtttaaccggtacggggttttaacggtttttacggggtttaaccgggtttttacggggtaccgggttacggggaaaccccgggggtaagtaaaccccggtaccggggttttaccggaacccgttttacccgggaaccggtttaccgggtaaccccgaaacccgggttacccgggaccggtttacccccccgg

SEQ ID NO: 120108 - DNA, 908 bp, Homo sapiens
  misc_feature: GYAE6OF01D4VS9.2.38.D05.1.454.CMB.1.raw
  modified_base (122)..(122): a, c, t, g, unknown or other
  misc_feature (122)..(122): n is a, c, g, or t
  modified_base (182)..(182): a, c, t, g, unknown or other
  misc_feature (182)..(182): n is a, c, g, or t
  modified_base (236)..(236): a, c, t, g, unknown or other
  misc_feature (236)..(236): n is a, c, g, or t
tcagacgctcgacacacgaccggtgctcgatttagtatctgatagttgggtttgggggtgggtccaggaggcagaactctgggtgtctcaccatggcctggatccctctacttctccccctnttcactctctgcacaggctctgacggcctctatgagctgacacacgcctacccgtgggtntcagtccgtccccgaaggacaggaccggccaggactccaccgtgcctcgtgganattgctagttcgaaccaaagactaatgtcgtactttagttacggaccagacgaagaacgccgaacggccgaccggtcccgtgtcgtcgttggtataataagtaaacgtaaagacgtaggacggaacggtacggtccccgtaggaacggggtccttcccgtagacggtacgttacgttccttacggccgtccttaccgaacgtccgtaacgggaaaccgggtaaacctaaacgtacggttaacccgtaagggttacccgtaacccttacggttaaccggtaacgggttaccggggttaaaccggaccgggtaaaacgggttaaccgggaaaggttaaaaccgggtagggttaacccggggtaaacccggttaggtttaacccggtttaaaccgtttttaacgtttaacccgggtacccttaaaccgtaaccggttaaaccgaaccgggtacgaaacgggttaaccctaaggggtttaccgttttacggggttttaaacggggttttttacgggtttttaccgggggttaccgggtttacccgggggtaaacgggggtaacccggaaccggtttaaaccggtaccgggttaccccgggttaaacccccggttcgggttttaacccccgggagtttaaacccccggggccgtttaaccccgggggttcccccccg

SEQ ID NO: 120109 - DNA, 887 bp, Homo sapiens
  misc_feature: GYAE6OF01CG1HP.2.38.D05.1.454.CMB.1.raw
  modified_base (715)..(715): a, c, t, g, unknown or other
  misc_feature (715)..(715): n is a, c, g, or t
tcagacgctcgacacacgaccggtgctcgatttagtatctgatagttgggtttgggggaagaggaagactgacggtcctgccacaggtggtgctgggcacggtggcactcgacacaacatttgcgctcaactgtcttgtccagtgtgaggtgcagctgggtggaggtccgggggagtcttagttcgaggtccggtggggggtccctggacgtacctcgtcctgtcgcacgcctcgtaggtacttacctaccttgagtacgtccgttacgtggattcgccgtacgttccgggtacccgaccgtaacgtccgtaccggaagggggtaacggggtcggttgggttaggtcgggtctacgttaacggttaagttaagttaggtagtaggtacgggtagtacggactaaccgtaacgtaccgaccggaccgtaaccggtaccggtaacgggtaaccggtaccgtacttaacccgaaccgttacgttacccgaaccgaacggaaccgaaaccgaaacccgaacccgtaaaaggtaccctaaacggtccgtttaacgtatccgtaaagtaaccgtaaaacgtcggtaaacggtacgtttacggaacgggaaacggacccggtaacccgggaaaggaacccggttacccggtggtttacggtttacgtttaaaaccgtttcggtagggtaaccgaacggtaaacgggttacgtaaaccgggtnaaccggtaaggcccggtaacggttccccgggtaagggtacccccgaaccggggtttaaacccggttacgggggaccccggggaaaccccggttaccggggtaaacccccgtttcgggtaaacccccgttccgttaacccctccccgggttacgaaacccccgtccccccggg

SEQ ID NO: 120110 - DNA, 896 bp, Homo sapiens
  misc_feature: GYAE6OF01BEPB9.2.38.D05.1.454.CMB.1.raw
  modified_base (272)..(272): a, c, t, g, unknown or other
  misc_feature (272)..(272): n is a, c, g, or t
tcagacgctcgacacacgaccggtgctcgatttagtatctgatagttgggtttgggggagccccagccctgggattcccagcttgtttctgcttgctgatcaggactgcacacagagactcaccagtggtagtttgggctggagtcgtttcgggttttccttgttgtactttaaagttttaaaggtcgtaccgtaggtggtggtaggtgcgaggtcggtgggtgggacgggtccgggggagtcgttagttcgacggtccgggtcggggtccngacgtctccgtccgtgtacgcgtacgtccgttcgtacggtaccttcccgtaccttacgtaacggttacgtaccgttacggtaggtactcggtccgtaccggttaccgggaccccgaccgtaacggccggtaaccggggaagggggtacgggtcggttgggtacggttccgggtactaccgttaagtttaaagttaacgtagggttacggtagggtacggtaagtacgaaccgtacgaacggtccgtaaccgggcgttaccggtccggacgggaacggtccgtactaccgaccgtacgttaccgacgtaacggaaccgtaaaccgaacccgtaaacggaaacccgtaaccggtacgttaccgttacgttacgttacccgtaagtaaacgtaaacgttacgtaaacccgttagtacggaacggtaacggtaacccggggtaccggaacccggttaacggtacggttcgttacggtttaaaccgttggttaaccggtacggtaacgtaaaggaaaccggttaaggtaaccgggttaacgaccggttaagacccgggttaaccggttacccggttaaccggggtaacccccgtaccgggggtaaacccggttaaccccccgggggggg

SEQ ID NO: 120111 - DNA, 570 bp, Homo sapiens
  misc_feature: GYAE6OF01BMZXU.2.38.D05.1.454.CMB.1.raw
  modified_base (386)..(386): a, c, t, g, unknown or other
  misc_feature (386)..(386): n is a, c, g, or t
  modified_base (404)..(404): a, c, t, g, unknown or other
  misc_feature (404)..(404): n is a, c, g, or t
  modified_base (427)..(427): a, c, t, g, unknown or other
  misc_feature (427)..(427): n is a, c, g, or t
tcagacgctcgacacacgaccggtgctcgatttagtatctgatagttgggtttggggggaagaggaagactgacggtcctgccacaggtggtgctgggcacggtggcactcgacacaacatttgcgctcaactgtcttgtccagtgtgaggtgcagctggtggagtccgggggagcttagttcagccgtggggggtccctgagactctcctgtgcagcctctggattcaccttcagtagctactggatgcacgtcgggtccgccaagctccgaggggaagggctggtgtgggtctcgacgtattaatagtgagtgggatagcacaagcgtacgcggactcggtaggaacggccattcacatcacagagacacgacaagacacgctntatctagacaatcgaacngtcagagacgcgagacgacggtntgtagtattacgtgtagacgaagagtatacgacgagcgacggtcgtagggtacccgccgtaacgtacgggtcggggaccccgtaacgggtaacccccgttgggtacccctaacccggttccctcccgtcgacccggtaccccc

SEQ ID NO: 120112 - DNA, 895 bp, Homo sapiens
  misc_feature: GYAE6OF01CD2SJ.2.38.D05.1.454.CMB.1.raw
  modified_base (219)..(219): a, c, t, g, unknown or other
  misc_feature (219)..(219): n is a, c, g, or t
tcagacgctcgacacacgaccggtgctcgatttagtatctgatagttgggtttgggggaagaggaagactgacggtcctgccacaggtggtgctgggcacggtggcactcgacacaacatttgcgctcaactgtcttgtccagtgtgaggtgcagctgggtggagtccgggggagtcttagttcaggccgtgggggtccctgagacctctcctgtgacngcctcgtgtattcgtaccttcaagtagcctaagtggatcgaccacgtcgggtaccgacaagcgtaccgaggggaagggcttggtgtggtacctacgagttaattagtagtgaagtcggagtacgacaacgaacgccgtacggacggtaccgtacggagggaaacggtccgtacgttacccacgtacgtaccgtacgaacggaacgaacgaaacccgtaaccgaaaacgaaaccgtccgtacgttaacgttaaccgtaccgttaacgaaaaccttaaacggtacccgaaaaagttcgttacggttaaacggaaacggtaaccccgggaacccggtaaagggaccccgttaaagggttcccgtttaaggtttaaccctttaaaaggttttaccccggtttggtaaaccgaaccggtaaaaaagggggtccgtaaaagttaaagggaccccggtaaagtaccgtaaacccgggtttcgggttaaaccgggggaaaacccccgtacccccggggtttaaaacgggtttcccccgggggtaaaccggggggtaaaccccccggtaaaacccggggtttaaaccccccccggttaccggtttaacccccggttaaaacccccccggtttccccggttttaaaaccctccccgggtaaacccccggttaaaccccccccccgg

SEQ ID NO: 120113 - DNA, 671 bp, Homo sapiens
  misc_feature: GYAE6OF01AQQDU.2.38.D05.1.454.CMB.1.raw
  modified_base (221)..(221): a, c, t, g, unknown or other
  misc_feature (221)..(221): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatcgagctgacacagccacctcggtgtcagtcgtcccaggcaggacggccaggatcacctgctctgganatgctattcgaccaaagctaatatgtctttagttcggtaccagtcgaagaacgccgaggcccacggtcccctgtgcgtggtagataataagaagacagtgaagtcggcctagaacgggtctcccgtgacgtcgtattcgtacgtcgtcctaccgagccgtacgaacggtaaccaacgtacgtcctacgttacgacctacgtacgacggttcggacgtaccgaggactaaggaacgtagtaggacgtcgtagtaacgttacgttacgtagtaacctaagtaccggacgtaacgacgaacgtacgttacgttacgggtttcgggtttacggttttacggggtacgggttacggggtaaccgggtaacgggtaaccggtaacggttccgggtaaccggttaacccgggttacggtacgggtacccgtaaccggtcccggtaaccggtccccgg

SEQ ID NO: 120114 - DNA, 517 bp, Homo sapiens
  misc_feature: GYAE6OF01BBKMJ.2.38.D05.1.454.CMB.1.raw
  modified_base (306)..(306): a, c, t, g, unknown or other
  misc_feature (306)..(306): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctctggattcaccttcagtagctactggatgcactgggtccgccaagctccagggaaggggctgggtgtgggtctcacgtattaanagtgatgggagtagcacaagctacgcggactccgtgaaggccgattcacatctcagagacaacgccaaagaacacgctgtactctagcaaatgaacagtctgagagcgaggacacggctgtgtattacngtgcaagagatagnagcagctggtacgccgtactacggngggcccgagggtaaccccgtgtccaccgtctccctcgacgccc

SEQ ID NO: 120115 - DNA, 673 bp, Homo sapiens
  misc_feature: GYAE6OF01EC361.2.38.D05.1.454.CMB.1.raw
tcagacgctcgacacacgaccggtgctcgatttagtatctgatagttgggtttgggggtgggtccaggaggcagaactctgggtgtctcaccatggcctggatcctctacttctccccctcttcactctctgcacaggctctgaggcctcctatgagatgacacagcccaccctcggtgtcagtcgtccccaggacagaccggccaggatcacctgctctggagatgcattgaccaaagactaagtaatgtctttaattggtaacccagcagaagccaggccacggcccctgtcgcgtggtgatataataaagcagtagagcgcctcgaggtactcccgtagacgcgtattctcgtcggctccgagctacgacggtaacaactaggtaccacggttcgactactcgaggtggacgtccgaagggcaacggaagaggttagaggtaccgttagtaacctttaacttacgtacgtaactaagtacagggaacctaacgaacgtacgacggttaacgggtttacgggttttaacgggttttttcggggtacggggtttccggggtacgggggtaacgggtacccggtaaacgggtccggttacccgggttaacccccgggttaccggtttacgggtaaccgtaaccgggtaccccgtaaaggggttcccccccggg

SEQ ID NO: 120116 - DNA, 663 bp, Homo sapiens
  misc_feature: GYAE6OF01E46IK.2.38.D05.1.454.CMB.1.raw
  modified_base (320)..(320): a, c, t, g, unknown or other
  misc_feature (320)..(320): n is a, c, g, or t
  modified_base (351)..(351): a, c, t, g, unknown or other
  misc_feature (351)..(351): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattccaccttcagtagctactggatgcactgggtcccgccaagcctccgaggggaaggggctgggtgtgggtctcagtattaagtagtgagttggggagtagcaacaaggtctaacggcggtaacctccggtaggaacgggcctattccaccatccnccagagaccaacgccaagacacgctgtatcngacaaatgaactagtcaggaacgacgacccggaggtaccgcggtcttggttatttacttaaccgtggtagacgaaagggtcgaatacggacgagacgtacggtcggttacggtaccggaccgtaacgtaccggtcggggacccgacgggtaaccccgtggtacccgaccgttccctccgtcacgtccctacccgaaccgaccgggccctacgttcccggtcccttccccgtcgggcccgtccccgtccgccgtcccgaggaccgacccgacccgtacccggagaccgaccaccggccgggcccggtcccggg

SEQ ID NO: 120117 - DNA, 746 bp, Homo sapiens
  misc_feature: GYAE6OF01B88E8.2.38.D05.1.454.CMB.1.raw
  modified_base (538)..(538): a, c, t, g, unknown or other
  misc_feature (538)..(538): n is a, c, g, or t
tcagacgctcgacacacgaccggtgctcgatttagtatctgatagttgggtttgggggtgggtccaggaggcagaactctgggtgtctcaccatggcctggactccctctacttcctcccctcttcactctctgcagaggctctggacggcctcctatgagctgacacacgcccaccgtcggtgtcacgtccgacccgagacgacgacggccgaggactcaccgtgcgtcgtaggatagtgactacgtacgaaccgaagactaattagtgttactttacgtacggtaaccagaacgaagaaccggaccgacggaccgtaccggtcccgttggtcgacgttaggtagtaattaaactaagtaaagacgtaggtacgacggaccggtaccgtacggaacggtacctccggtagacgttccgtacgttccgtacgtcggtaccctacgacggtaccgaacggaacggtaacctaacggtaccgtacgtaaccggttacaaccgttagtaccggtaggtcgaaacccgttacgacgggtaanaaggttagagtagggactacggttatactttaaggtcctacgtaacactacggaactaccggaaattcggacggttaggttacggtttacgggttttcggtgggggttaacccggtcgggaaaccggtaagggtaacgtcccggtttaccgtaaccgggttaccctgggttaaccccgacgggtacccgtaacggccccgttacccgg

SEQ ID NO: 120118 - DNA, 711 bp, Homo sapiens
  misc_feature: GYAE6OF01CPGK9.2.38.D05.1.454.CMB.1.raw
  modified_base (226)..(226): a, c, t, g, unknown or other
  misc_feature (226)..(226): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccacccgtggtgtcagtcgtccccaggacagacggccaggactcacctgctcgtgganatcgacagttacgaccaaaagcaattactgtactttagttacggtaacccagaccaaggaaccgcccgaacgggcccgtaccggtcccccgtggtcggcggttaggtagaattaataaacgtaaagacgtaaggtaggaacggaccggtccccgtaggacggggtacctcccgtaggacgtaccgttactttccgtacgtcgggtaccctaccgacggtaccgtacggaaacgggtaaccaaaccgtacgtaccgtaacggttaccgaaccctagtaccggtagggtacggtaccgtaccgaagggtaacaagggtaagagtacggacggtcttaacgtactttagtacgtacgtacaacgtcgaagtcgaagactggtacgttgggtttacggtttggtttgggcggttcgggacgggaacgggtaaccaggtccggtaaccggtaccgtaccgtacgtaccgacccgaccggtacgtccccgg

SEQ ID NO: 120119 - DNA, 649 bp, Homo sapiens
  misc_feature: GYAE6OF01ADX69.2.38.D05.1.454.CMB.1.raw
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcataggctctgaggcctcctatgagctgacacagccaccgtcggtgtcagtcgcccaggacagacggccaggatcacctgctcgtggagatgctattcgaccaaagcaatatgactttatggtacagcaagacgccaggccgacggtcccctgtcgcgtgggtcataataagaaaggacaggtaggagacggccctaggaaggtcctcccgtagacggcgtaacttctcgtggcctaccaggctacgaggaacaacgacgtactacggttacgaaccgtatacgaggtaggacgtaccggaggacgaacggtaagnggttaggnggtactagtaacttattacgtacttacaagtcgacgacgtaacgacgacgtacgtacgggtttaggtttacggtttttgggggtacggttacgggggtaccgggtaacgggtaacgtacgggtaccggtacccggtaaccggttaccggttacgggacccgaccgggtaccccgtaacgggttacccccgg

SEQ ID NO: 120120 - DNA, 679 bp, Homo sapiens
  misc_feature: GYAE6OF01D7YUT.2.38.D05.1.454.CMB.1.raw
  modified_base (174)..(174): a, c, t, g, unknown or other
  misc_feature (174)..(174): n is a, c, g, or t
  modified_base (183)..(183): a, c, t, g, unknown or other
  misc_feature (183)..(183): n is a, c, g, or t
  modified_base (215)..(215): a, c, t, g, unknown or other
  misc_feature (215)..(215): n is a, c, g, or t
  modified_base (330)..(330): a, c, t, g, unknown or other
  misc_feature (330)..(330): n is a, c, g, or t
  modified_base (574)..(574): a, c, t, g, unknown or other
  misc_feature (574)..(574): n is a, c, g, or t
tcagacgctcgacacacgaccggtgctcgatttagtatctgatagttgggtttgggggagccccagccctgggattcccagctgtttctgcttgctgatcaggactgcacacagagaactcaccatgggtagtttgggctggagcggtggtttcgtgtagctagttaaagtgcngtgtgagtncagtgtggtggaggtcggggagtcttagtcgnggtccgtggggggtccctagacgtctcttccgtgtcgactcggcctacgtgtaacttccgtacccttcgaacgttagccttagtggacttggacctacgggttccgggtaccccnccgaaaggtcccgacggggaacggggggtagggtcggtggtgggttccggtattaacgtaacggtttaataagttaaggttgaaggttccggggatacccgaaggaaccttaacggccgtaacggtcggtaaccttccggggtagaaccgggtcctattacccgaacttcctcgaaccgagaaccgaacccgaaccgagtaaacccgattagcttaagtcctagtgaaacccaggttaaacccngttacgcgagacgacggacggacgacgtacgtacgtagttgttagtagtagtagagacgtagagacgacgagacgtcggtacgtacggtaccgtacgtcggtcgg

SEQ ID NO: 120121 - DNA, 725 bp, Homo sapiens
  misc_feature: GYAE6OF01DQG3A.2.38.D05.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
  modified_base (392)..(392): a, c, t, g, unknown or other
  misc_feature (392)..(392): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtcgggtccnccaagctaccgaggggaaggggctggtgtgggtctcacgtattaatagtgatgggagtagcacaagctacgcgactccgtagacggccatcaccntctcagacacacgccaagacncgctagtatcgagactaaatgaacagtctggaacgacgacccgaggaccgaacggtcttaggtattactttacgnggttacgacgaaaggtagtaagtacgacgtaacgacgtaacggtccggttacgggtaacccggtacccggtaaccgtacggggttaccgggggacccggtaaaccggggtacccgtaccgggttaccgtaaccccgttcccgttccccgtacgtaaccccgtaccccgttaaccccggaacccggtaacccgggtaccccgtaacccggtttccccgggttaaccccgttcccccggtacggtcccccggtcccgtccgtacccgtacccgacgggcctacccgacccggtacccgacggtaaccgaccggaccgccggtcccggtcccgggg

SEQ ID NO: 120122 - DNA, 726 bp, Homo sapiens
  misc_feature: GYAE6OF01BLIJI.2.38.D05.1.454.CMB.1.raw
tcagacgctcgacacacgaccggtgctcgatttagtatctgatagttgggtttgggggagccccagccctgggattcccagcgtgtttctgcttgctgatcaggactgcacacagagaactcaccatggagtttggctgagctgggttttccttgttgctaattttaaaaggtgtccagtgtgaggtgcagctggtggaggtccgggggaggtcttagttcgaggccggtggggggtccctggagactctcctgtgcagcctgtggtacttccaccttcagtagctacgtggatgcacgtcgggtccaccgaacgccgtaccggaaggggaacggggtcgtggggttggtcgggtctacgtaacggttaatttaaagtaggtggacgttaggggaagttacgacgtaacgaacgccgttacggacggtaccgttccgggaagggtaacgggtacccgtaacgttaccgaacctaacgttccgaacccgaaggaccgaaaacccaaccggaacccaaaaggtaacccacgtacgttagtaactccggtaagaacaaacgttacgaaccgttaggttacaaggggaccgaacggggaacccggttaagggacccgaacggggttcttagggttaagttaccgttacgttaggacggaaccgtaaaggaacttaaggacgacctaaggccgtaaggttacggtaacggcccgaacgtacggtaccgggg

SEQ ID NO: 120123 - DNA, 722 bp, Homo sapiens
  misc_feature: GYAE6OF01ENJVL.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggagcttagtcagccgtgggggtccctgagactctcctgtgcagtcctctggtacttcctaccttcagtacgctacgtggatcgctacggtcgggtccaccgaagtcctaccggaaggggaacggggtcgttggggttggtacgggttcctacgtacgttaattaagtaggtgaggtggggagtacgcaacgacgtacgtacggacggtaccgtccggtaaggacgggtctacttaccgaacctactacgtacgaacgaacgaacctaaccgaaccgaaacgaaccgtacgtacgttagtactcgtacaaactaaagtacgaacgtacgtacgtaaggaacggaccgacggaacgtaccgacggtcgttagttacgttacgttacgtggtaacgaacgtaaggtaagtagtacgacgaacgcgtacggttacggtaccggtaaccggtaccggtaaccgtacggggaccgggaaccccggtaaccggggtaaccccttaccgggtacccttaacccccgtccgttacccgtaccgccccgtaaccccgg

SEQ ID NO: 120124 - DNA, 689 bp, Homo sapiens
  misc_feature: GYAE6OF01BSN4R.2.38.D05.1.454.CMB.1.raw
  modified_base (200)..(200): a, c, t, g, unknown or other
  misc_feature (200)..(200): n is a, c, g, or t
  modified_base (385)..(385): a, c, t, g, unknown or other
  misc_feature (385)..(385): n is a, c, g, or t
  modified_base (387)..(387): a, c, t, g, unknown or other
  misc_feature (387)..(387): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctacgtggatgcacgtgggtccnccaagctccgagggagggctggtgtgggtctcacgtattaatagtgagtgggagtagcaacaagtctacggtggactccgtaggaacgggccattcaccatcctaccagagaccaacgccaaagaacacgctgtatctgacaaatcgaacagtctgagagccgagacacggctagtcgtattacngngacaaggagagtagcagcagtcgtacggaccgtacgaccgttacgggtacggggacccgaacggggtaccccgtcggtacccgtaccgttcccgttcccggtccggtaccccgtacccgaacccggtaacccgggtacccgttaaccgttccccggttacccttaccccccggtcgggtacccccgtcccgttacccggcccgttacccgggaacgggtacccggtacccgtacccccgtaacccggacggtacccggtaccccgaaccggaacccgggtcccggggcccccggttccgggg

SEQ ID NO: 120125 - DNA, 720 bp, Homo sapiens
  misc_feature: GYAE6OF01AR0IM.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggactccacctgctcgtggagactgcattcgaccaaagcaatatgacttatggtaccagacagaacgccaggccacggcccctgtgcgtggtagataataataaagacagtagacgacggccctaggagggtactcccgtaggacgtccgactttctcgtcggcctccgagcctacgaacgggaaccaacgacgttaccgacgttacgaacctagtccgtaaggtacgggtactaccgaggacaaaggaagtcgtagggacgtacctaggtaacctttaacgttaccgttacggtaactaacgttaccggacgtaaccgaggacgttaacgccggttaagggtttaccgggttttaaccggttttttggggggtaccgggtttacccgggggtaccgggtaacgggggtaaccccgtaacggttacccgggtaaccggttacccccgggtttaaacccggttaccggggttaacccgaaccccgggttaaaccccgggtacccgggttacccccgg

SEQ ID NO: 120126 - DNA, 776 bp, Homo sapiens
  misc_feature: GYAE6OF01D0BUZ.2.38.D05.1.454.CMB.1.raw
  modified_base (309)..(309): a, c, t, g, unknown or other
  misc_feature (309)..(309): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtcccaggacagacggccaggatcacctgctctggagatgcattcgaccaaagctaatatgtacctttagttaggtaacccagcgaagaagccgaggccacggcccctgtgcgtggtgatatanaaagacaggtgagacggccgtcgaagggactcccgtagacgcgtaattctcgtggccttaccgagtcctacggaacgggtaacctaaaccgtacggttaccgtaaccgggtttacgaaaccccgttagtaaccggtagggtaacggggtaaccgttacccggaacgggaaccgtaaagggtaaacgggtagttacggggaacggtaccgttaggttaaacccttttaacgtttaccgtaggttaaaccctaagttacccggaagtccgaaacgtacgaacggtaccggttaagggtttccgggttttaaagggttttttcgggggttacgggtttaccgggggtaaccggggttaaaccggggtaaccgtaaacgggtacccggtttaaccgggtaaccccgggtttaccggttaaaccgggttcccgaaacccggggttacccccggaacgggttaaccccccggg

SEQ ID NO: 120127 - DNA, 652 bp, Homo sapiens
  misc_feature: GYAE6OF01EMU6E.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtcccaggacagacggccaggatcacctgctcgtggagatgcattgaccaaagcaaatatgcttattggtaccagacagaagccaggccacggcccctgtgctggtgattatataaagacaggtgagacggccctgacgggactcccgtgagcgtattctcgtggcctcagctacgacgggaacaaacgtacgtacctacggttcgaacctatcgagtacgggtagtacccgaggacgaagggaaacgtagtacgggaacggtacgttaggtaacttttaacgtttaacgtacggttaactaaagttaccgacggtaaccaaggaacctagtacggtaaggggtttaggtttacggttttttggggtacgggtttacggggacgggggtacgggaaacccggtacgggacgttaccggtaccccggttcgtaacgggtcccgaaccggttcccgaacgggttccccgg

SEQ ID NO: 120128 - DNA, 804 bp, Homo sapiens
  misc_feature: GYAE6OF01CS88P.2.38.D05.1.454.CMB.1.raw
  modified_base (414)..(414): a, c, t, g, unknown or other
  misc_feature (414)..(414): n is a, c, g, or t
  modified_base (493)..(493): a, c, t, g, unknown or other
  misc_feature (493)..(493): n is a, c, g, or t
tcagacgctcgacacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcacgcctcgtggtacttccaccttcagtacgtctacgtggatgccacgtcgggtacccgaccaacgtccgtaccggaagggggaacggggtccgttggggttggtcgggttcctacgtaacgtttaaagtttaagtaggtagtaggtagggtagtacgacaacgaagtaccgtacggacggtactccggtaggaaacggtcccgtaattccaacctagtccaacgaaggtaacgaaccaacgaaccgaaagaaccacgtntacgtactacgtacgaactaagtaacgtaacgtagtacgtaagaacgggaccggaaccgggaacggacgtacccgggtnttaacggttagttaaacctcggtaaggtacgaaacgaaggtagtacgaaggacaacggcgtaacggccgttaacgggtacccggaccgtaaccggtaccgggtaccggggtaacccgaaccgggtacccggtcggtaacccgtacccgttaccgtacccgtacgacccgtaccccgtaaccggacccggtaacccgggtcccttaaccggttcccggtaccccgttccccggtaccgcccgtacccgtcgtacccgacggtacgacccgtccgaccgacgtacgaccgaccgaccggccggtcccggtcgg

SEQ ID NO: 120129 - DNA, 837 bp, Homo sapiens
  misc_feature: GYAE6OF01E2M7R.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtgggaggtccgggggaggtcttagttcagccgtgggggtccctgagactctcctgtgcacgcctctggtacttccaccttcagtacgtctacgtggagtcgtccgacgtcggggtacccaccgaacggcccgtaccggaagggggaacgggggtcttaggggttcgggttcggggttccttacgtaaacggtttaatttaaaggttaggttaggtaaggtacgggggtaagttaacggaccaaaaccgtaaacggtcccgttaaccgggacccgggttaaccgttacccggggtaagggaaaccgggggtacccgtaaccgtttacccgaaaccctacgttcccgtaaaccccgaaggtaaaccgaacccgaaaacccggaacccgaaaaacggaaccctaccggtacctttaggttaactacccgtaagacctaaaaagtacgaaacgtacggttactagggaaacggaccggaccggaaaggacccgtacggtcgtttaggtaacgtttacttaggtcgtacggaaacgtaaggtaaagtacgtaacgcgaaggtcgaacggttcggttaccggaaccggcccgtaaacggtccggggtaccggggaaccgtaacccgggttaacccttccgggtaccctacccgttccctaaccggtccgaacccgtcccccg

SEQ ID NO: 120130 - DNA, 756 bp, Homo sapiens
  misc_feature: GYAE6OF01C5HF9.2.38.D05.1.454.CMB.1.raw
  modified_base (547)..(547): a, c, t, g, unknown or other
  misc_feature (547)..(547): n is a, c, g, or t
  modified_base (640)..(640): a, c, t, g, unknown or other
  misc_feature (640)..(640): n is a, c, g, or t
  modified_base (663)..(663): a, c, t, g, unknown or other
  misc_feature (663)..(663): n is a, c, g, or t
tcagacgctcgacacacgaccggtgctcgatttagtatctgatagttgggtttgggggagcccagccctgggattccagctgtttctgcttgctgatcaggactgcacacagagaactcaccatggagtttgggctgagcgttgggttttccttgttgcttaagttttaaaaggtgtccagtgtgaggtgcagcgtgggtggacggtccggggagtcttagtcagccgtgggggtccctggagtcttctcctgtcgcacgcctcgtcggtattccctacccttcgtaacgtaacgtccttaacgtgggtacttcggcctacggttcggggtaccccgaccgtaacggcccgttaccgggaagggggtaacgggggtccgttggggtcggttcggtccgtacctaaggttaattaagtaggtgtaggtaggggagtacgactaacgaacgtccgtaccggcggtaaccgtcccggtagggaaccgggtcctaattacccgacctaattcccgaaccgaaaggaacgtaacccaaccgtaacccgaaanaacccgtcgtcttaacggtactacgtacgaaacaaagtccgtaacggtattcggtaagacgggaaccggtaccggaagggaccaaccgggttnttttggaccttttaagtaaccgnggtagaaaccgaaagggataacgtacggaccgtaaggtccggaacgttcgggttaacccgggtaaaccccgccggttttaacccggaaggggg

SEQ ID NO: 120131 - DNA, 699 bp, Homo sapiens
  misc_feature: GYAE6OF01DUY9I.2.38.D05.1.454.CMB.1.raw
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
tcagacgctcgacacacgaccggtgctcgatttagtatctgatagttggggtttgggggtgggtccaggaggcagaactctgggtgtctcaccatggcctggatccctctacttctcccctcttcactctctgcacaggctctgaggtcccttctatgagctgacacgagcccacccgttcggtgtcagtcgtccccgaggacaggacgggccaggatccaccgtgccttcgtagggagatgctagttcgaccaaagcaatatgacttagttggtaccaggcaagaacgccgacgccacggcccctggtagcgtgagtatagtaagaaagcagtagagacgcctagaggtctccgngacgngtacttcgtacgtcggctacgacgtcctacgaggtaccaaagtacgtctacgttacgaacctacgtacgtaggtaacggtacgtaccgaacggaacgtaaggaaggtacgtaaggggacgtaccgttaagtaacgtttaacgtttaacgtacgtaaccttaacgtacccgaaaggtacgtaaacgggaaccgtagggttaccgtaggggtttttaaccggttttacgggttttacgggggttcggtttaccggggacgggttaacgggtaccgtaacggttccgtacggtaccccgtacgggttacggtacccgaccggtacccgtaacgggtccccg

SEQ ID NO: 120132 - DNA, 901 bp, Homo sapiens
  misc_feature: GYAE6OF01D897F.2.38.D05.1.454.CMB.1.raw
  modified_base (219)..(219): a, c, t, g, unknown or other
  misc_feature (219)..(219): n is a, c, g, or t
  modified_base (241)..(241): a, c, t, g, unknown or other
  misc_feature (241)..(241): n is a, c, g, or t
tcagacgctcgacacacgaccggtgctcgatttagtatctgatagttgggtttgggggtgggtccaggaggcagaactctgggtgtctcaccatggcctggatccctctacttcctcccctcttcactctctgcacaggctctgaggcctctatgacgcgtgacacacgccaccgtgtgtcagtcgtcccaggacaggacgcaggactcaccgtgctgnggagatgctagttcgaccaaanactaatagtgtactttagtcggtaaccagcaagaagccgaacggccacggccccgtggtcgtcgttaggtagtaattaactaaaggtaaacgacgtagggtaggaaacggcccgggtaccccgtaggtaaccggggtaccttccccggtagggtaccgtacgtttacgttttcccttcgggtaccggtaccccttacccggaacggttcccgtaaaccgggacggggtaaaaacccctaaggttacccgggtttaccgtaacgggttaccgaaacccgttacgtaccgggtaagggttacccggggtaacgttacccgggaaggtaaaccggaaagggaacgtaacggtacgggtaaccgggttacttaaccggttaactttttaacggttccgttaacggtaaactaacccgttaacgaacggtaccgaaacgttaccgggtaaaggtaccggttttaagggtttaccggggttttttaacgggtttttcgggggttaccgggtttaacccggggggaacggggttaaaacccggggtttaaccgaaaaccgggttcccgttaaccccggggtttaaaccccgggttttaaccccggggaaaccgggttaccccgggaacccccgggttaaaccccgggtaaccggttccccccccggg

SEQ ID NO: 120133 - DNA, 851 bp, Homo sapiens
  misc_feature: GYAE6OF01ALWHZ.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagcgtggtggaggtccgggggagtcttagttcgagccgtgggggtccctgacgtacctctccgtgtcgcacgcctcgtgtacttcctaccttcgagtacgtctacgtggactcgactaccggttcgggtccccgaccgaaacggtcccgtaccgggaagggggtaacggggtcgttggggttcggttcgggttcctaccgtaacggtttaagtttaaggtaggtggtaaggttaggggtaacgtacgaccgaacgtaaacggtcccgtacgggtaccggtaccgttaccgggtaagggaaaccgggtccgttaacttacccgaacctaacgttcccgtaaccgaacggaacgaacccgaaacccgaaccgaaaacgaaccgtaccgtcgttaacgtcgtacgtaagaacctaaaagtccgaaatcggtagtacggaacggaccggaccggaacggtaccgtaacgtcgttagtaacgtttaacgttgtacggtagaaccggtaaagtagtaacgttacggacctaaggtacccgtaaccgggttcgtaacccgggggtaaccccggaccggttttacccgggaacccgggggttaacccggggaacccggttaaaccccgggtaaccccggtttcgggtaaaccccgttccccccgtttacggaacccccgtacccgaaccccggttaccccccggg

SEQ ID NO: 120134 - DNA, 777 bp, Homo sapiens
  misc_feature: GYAE6OF01AWGRM.2.38.D05.1.454.CMB.1.raw
  modified_base (122)..(122): a, c, t, g, unknown or other
  misc_feature (122)..(122): n is a, c, g, or t
  modified_base (136)..(136): a, c, t, g, unknown or other
  misc_feature (136)..(136): n is a, c, g, or t
  modified_base (500)..(500): a, c, t, g, unknown or other
  misc_feature (500)..(500): n is a, c, g, or t
  modified_base (636)..(636): a, c, t, g, unknown or other
  misc_feature (636)..(636): n is a, c, g, or t
tcagacgctcgacacacgaccggtgctcgatttagtatctgatagttgggtttgggggtgggtccaggaggcagaactctgggtgtctcaccatggcctggatccctctacttctccccctnttcactctctgcanaggctctgagcctcctatgagctgacacgacgccctacccgttcggtgtccacggttccgtacccccgaagggaccgaacggaccggacccgaaggtactacccgacccttcggaccttacgtagggaagtacgttcggacctacttacggaaaccctaaaagtacctaaagttacgttcgtactttaacgtttacggttacccgaacggaccgaaggaacgacccggaacggaccccgaaccggtcccccgtaggttcgccggttaggtataacgtaataaagtaaacgacgaggtacggacggaccggtaccccacggtacgggtacctcccgtaggacgacgttattccgttagcgtaccnccgtcgtactacggaacggaaccacgtaacgtccgtaacggttcgaacctacgttacgacggtggttacccgaccgagggaccgtaaaggagtaacggtaggtacggtacgtaacgtaaccgtttaagtttaaccncggttaactaagtaccggataccggaagtagacgtacgttacggtttaggtttacgggtttacgggtaggttccggggacggacgggtacgacggtacctacgggtacctacggtacgacgacccgacgtccggtccccgg

SEQ ID NO: 120135 - DNA, 779 bp, Homo sapiens
  misc_feature: GYAE6OF01A7R52.2.38.D05.1.454.CMB.1.raw
  modified_base (198)..(198): a, c, t, g, unknown or other
  misc_feature (198)..(198): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccnccaagctccgagggagggctggtgtgggtctcacgtattaatagtgagtgggagtagcacaagctaccggcggtactcccggtagaacggggcccaatttccgaaccatcctccgaagacgtaacaacgcccaaagaaccacggctagtatccgtaggacaaagtggaacctgtccgtaggaacggacgccccgggtaaaggacccacggggtccttagggttattaaacgtttaccgtggtacggaccgaaaaggtagaagttacgaccgaagacgtaggtacccgttacgggtaacccggtacccggttaaccgtaccgggttaccgggggacccgtaaccgggggtaaccccgttccggggtacccgtaccccggttccctacccgtacccgaccggtacccccgtacccgtaaccccgaaccgggtcccccgtaacggttccccggttacccgtttcccccccgggttacgggtcccccgtcccccgttacgggtacccgttacccggtaccgggaccgtaccccgtacccgtacccggacggtacgacccgtaccgaccgggccccggtccccggg

SEQ ID NO: 120136 - DNA, 599 bp, Homo sapiens
  misc_feature: GYAE6OF01CU72S.2.38.D05.1.454.CMB.1.raw
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggatcacctgctcgtggagatgacattgaccaaagcaatatgctttattggtaccagcagaagccaggccaggcccctggtgcgtggtgaatataactaaagacaggtgaagtacgggcccctagacgggactccccgtggacgtccgtaatttcgtctggtccttccagtcctgaagggaccaaacngtaccagttcgaacctntaccgagtggacgtcgaagacaagaacgtatggaggctaggaacttattactgtaactatcctaagcaagtaccaggtaccttagggttaaggtttccggtttttggggtacggttccgggtacgggaacgggtaacccgaaaggtcctaacggtaccttaccgtaggtccgaacgtcccgaggtacccg

SEQ ID NO: 120137 - DNA, 710 bp, Homo sapiens
  misc_feature: GYAE6OF01DE5YC.2.38.D05.1.454.CMB.1.raw
  modified_base (166)..(166): a, c, t, g, unknown or other
  misc_feature (166)..(166): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacngcccacccgtcggtgtcagtcgtccccaggacagacggccaggatccacctgctctggatatgctattcgaccaaaggactaatatgtacttagttcggtaccagacaagaacgccgacggccacggtcccctgtgtcgtggtagattaataacgtaaagacgtaggtagaaggaaccgggtccctacggaacggtctcccgtagacggtcgtactttccgtcgtggtacctccgagtcctacggaacggaaccaacgtcgtaccgtacggtagtaaccctagtacggtaggtacggtacggtaccgaaggcgaaacggaagtagtaacgggacgtagttacggttaaccttacgtttacttcgtaaccgaacgttacgacgacgtacggaacgtacgtccgggtaaggttttaccgggttttcggttttttacggggtcgggttacccgggggtacgggtaaccgggtaccggttaacggcccgttacgggtacccgttacggttaccgggtccgaaaccggccccggtaaccgggtccccgg

SEQ ID NO: 120138 - DNA, 737 bp, Homo sapiens
  misc_feature: GYAE6OF01C2NNT.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggtagtttgggctgagtcgttgggttttccttgttgtacttaagttttaaaaggtgtccagtgtgaggtgcaggcgtgggtgggacggtccgggggagtcgttagttcgacggtcccggtcgggggtccctagacgtactcctccgtgtgcctacgcctcgtagtacttcctaccttgacgtagtacctacgtaggtacgtacgtaccgtacggtccgggacccgaaccgtaacgtccggaaccggggaaggggtacggggtcggttggggttcggtacggtcctaacgtttaagttaagttaaggtaggtgtaggtaggtagtacgaacaacgacgcggtacggacccggtacggtaccggtacgggacggtaccgtaccctaacgacgtacctaccgacgaaacgtaaccgaacccgaacccgaacctaacgaaactaccgtactacggttactacggtacaaacgtaactacgtacgtacgacggtaacgaacgggtaccggacggaaggtaccgtcgtgttacgtagttacggtactggaacgaagtaagaagtaagcagacgacgtacggttacggcggaaccccggtcgtaacggggtacccggg

SEQ ID NO: 120139 - DNA, 554 bp, Homo sapiens
  misc_feature: GYAE6OF01DQ6Q0.2.38.D05.1.454.CMB.1.raw
  modified_base (401)..(401): a, c, t, g, unknown or other
  misc_feature (401)..(401): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctctggattccacctttcagtagctacgtggatgcacgtcgggtcccgccaagcctaccgaggggaaggggctgggtgtgggtctcacgttaattaagtagtgagtgggagtagcacaagctacggcgactcgtagaacggcattcacatctcagacgacaacgcaaagacacgctgtatcngaacaatgaactagtctagagacgcgaggaccacggtcttgtattattacgngtanacgaagngatagctagctagcgtacggtaccgccgtaacgtcggtcggggacctaacggggaccctgggtcctacccgtcctccgccgacgtccccg

SEQ ID NO: 120140 - DNA, 666 bp, Homo sapiens
  misc_feature: GYAE6OF01EEYJ0.2.38.D05.1.454.CMB.1.raw
  modified_base (373)..(373): a, c, t, g, unknown or other
  misc_feature (373)..(373): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacacgccacccgtcggtgtcagtcgtcccaggacagacggccagatcacctgctcgtggagatgctattcgaccaaagacaatatgtactttagttacggtaaccgagacgaagaacgaccgacggaccgacggccccgtggtcgcgttaggtagtaatagtaaagtaaagacgaggtagacgacggtcccgtacgacgggtactacccgngacgcgtacttctcgtcgtcctcgacgcgtacgaacggacaacgtacgtaccgtagtacactactacgacgtacgggaactacggaacggacaaggaagagtaggagtacgtagtaacttaattacgtatacgtaactcgaactacgaagaacacggtacgttagggtttacggttttacggtttttgggtacggggttaccgggtaaccggggtaacgggtaacccgtaacggaccgttccggtaacccggttacggtaacccggtacgacccgtacccggtacgtccccgg

SEQ ID NO: 120141 - DNA, 862 bp, Homo sapiens
  misc_feature: GYAE6OF01C2LNI.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctcctatgagctgacacagccacccgtcggtgtcagtcgtccccaggacagacggccaggatccacctgctcgtggacgatgctagttcgaacccgaaagactaattatgtactttaagttcggtaaccaggacaaggaaacgccgacggacccgtaaccggtccccgtggtcgtccggttgggtagtaaagttaattaaacgtaaaaacggtacgtaaaggttacggaaacgggtacccgggaaccccgttacggaaacggggtacccttcccgtaaggaccgtacggttactttccgtccgttcggcccttccgacggtccgtacggaacgggaacctaaacgtacgttaccgtaccggtttaacgaacccgtaacgttacggtaagggtacgggtaaccggttaccgaacgggtaccgaaacggaagtaaacggttacgggaacggttaccgtaacggtttaaactttaacgtttaacgttaacggtttaaaccgtaaagttaccgaacgggtacgaacgtaaccgaacgggttacgtttaacggggttttaccgggttttttaaacggggtttttcgggggtttacggggttacccgggggtaaccgggggtaaccggggtaacccgtaaagggtacccggttaaccgggtaaacccggtttacccgggtaacgttaccgggaacctaccccgggtaacgggtcccccg

SEQ ID NO: 120142 - DNA, 990 bp, Homo sapiens
  misc_feature: GYAE6OF01C5S1P.2.38.D05.1.454.CMB.1.raw
tcagacgctcgacacacgaccggtgctcgatttagtatctgatagttgggtttgggggaagaggaagactgacggtcctgccacaggtggtgcgtgggcacggtgggcactcgacacaacatttgcgctcaactgtcttgtccagtgtgaggtgcagcgtggtggacggtccgggggaggtctttagttcgacggtccgggtcgggggtccctaggacgtaccttccgtccgtgtcgacgacgtccgttcgtacggtacttacctaccgttacgtaacgttacgtacgttacgtaggtagttacgaccgtacgggttccgggtaccccgaacgaacggtcccggtacggggaaagggggtacgggttcgttaggggtcggttacgggttacctaacggttaaacgttaaagtttaagtggtaagtacggttagggaacgtacgaaccgtaaacggtaacgtaccggtaaccgggtaccggtaaccggttaccggggaaacgggtaaccgggttaacccgtttactaaaccccgaacccgttaccggtacccgtaaaccggaaaggtaacccgaaacccggaaaacccgaaccggaaaaacgtaaccgtacgttaccgttaacgtacgtaaccgtaaacgtaaaaccgtaaagtaaccggtaaaacttgggtaaccggtaagggaaccgggacccgggtaaacgggtaacccgggaacgttcgggttacgtttaggttaagtttaacccgttagggtaacgaagaaaccggtaaagtaccgtaagtaccggacgtacggtccggtaaaccggttccgggtaacccccggggttaaaccgtaaccccggggttaaaaccggggttccccgggggttaacccggggaaaccccgggttaaaccccgggttacccccggtttaacgggtacccccccggttaaacctttcccccggtaacccggtaaccccggccccggttaaaacccccccgg

SEQ ID NO: 120143 - DNA, 781 bp, Homo sapiens
  misc_feature: GYAE6OF01EU7S4.2.38.D05.1.454.CMB.1.raw
tcagacgctcgacacacgaccggtgctcgatttagtatctgatagttgggtttggggggaagaggaagactgacggtcctgccacaggtggtgctgggcacggtggcactcgacacaacatttgcgctcaactgtcttgtccagtgtgaggtgcagctggtggaggtccgggggagtcttagttcagccgtgggggtccctgagactctcctgtgcacgcctgtgacttcaccttcagtagctacgtggatgcacgtcgggtcccaccaaggcctaccggaagggggaaggggtcgttgggttggtcgggttcctacgtaacggttaatttaacgtaggttaggtaggtaggggaggtacgacgaacgaacgtcgtaccggaccggtaccgtaccggtagggaaccgggtacccgtacttaccgaacctactcctaccgaaaggaacgaaacccgaaaccgaacccgaaaacggaaaccctaccggtaccttaggttaacttcgtaacggaactaaaacgtacgtaaaccgtacgttacgaaggaaaccggacggacccgggaaaggtacccgtaacgttgttaggttaccgtttaattacggtcggtaacgaacgaaagggtaagtaacgttaccggacgtaacgggtacctaaggggttcccgttaacgggtaccccggaaacccgggttacggttacccgggggtaccgggtaaccccgggaacgggtacccttcgggtaccctaccccggttcctacccggtcgaccccgttacccg

SEQ ID NO: 120144 - DNA, 859 bp, Homo sapiens
  misc_feature: GYAE6OF01E5SZC.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctcccctcttcactctctgcacgaggtctcgtggacggtcccttcgttatgtagtcgtacgaacctaacgacgccctacccgttggtgtcgacggtccgtacccgaaggacgacggaccggaccggtaaggaccttaccgaccgtcggtcttccggtagggaacgtacgtacgtccttaaggttaccgaacccgaaaagaaccttaaagttgttccgttactttaacggttaccggtaaaccaaggaccgaaaagggaccgacccggacgggtaccccggtacccggggtccccgttgtaccgggtccgggttagggtataaacgtaagtaaaacgttaacggaacgtagggtaacgggtaacgggtacccggttaccccgaagggtaacgggtacccttaccgtaggaaccggttaccgtactttccggtccgtcggtacccttaccgcggtacgtacgggaacggaacctaaacggtcgttaccgtacgttaccgaacctacgtacgagggtacgggacgtaaccggacggtaagaacggtaagacgtacggtaacgtcgtaacgttaacttacgttcgagttactaagaccgacgaacctaagtccgaacggtcgttagggtttcgggtttacgggttttcgggtacgggtaccgggtaaacggcggtaaaaccggtggttacccggtaacgttacccgtacggttaacgtacccggacccgttaacccggcgttcccccgg

SEQ ID NO: 120145 - DNA, 703 bp, Homo sapiens
  misc_feature: GYAE6OF01BZYLZ.2.38.D05.1.454.CMB.1.raw
  modified_base (177)..(177): a, c, t, g, unknown or other
  misc_feature (177)..(177): n is a, c, g, or t
  modified_base (518)..(518): a, c, t, g, unknown or other
  misc_feature (518)..(518): n is a, c, g, or t
  modified_base (594)..(594): a, c, t, g, unknown or other
  misc_feature (594)..(594): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttggctgagtcttgggttttccttgttgcttaagttttaaaaggtntccagtgtgaggtgcagcgtgggtgggacgggtccgggggtaggtctttaggttcacggtccggttcggggggtccctggacgtacctctccgtgtcgctagtcctctaggtacttcctacctttcgaagtcgacttacgtggatcgcgtacgtcggtcccgacaacgccgtaccggaaggggtacggtcgtgggtcggttgggtacctacgtaacgttatttaacgtgtaggagttaggggactagacacgagtccgtaacggccggtactccgggtagacggcgttactaccgactactccgtaccgaaggtcgaaccgaaccgtaccgaaaacgaccnccggttaactagtaactcgagtaaacaacttcgaaactaggtcgtgaaccggacggtaacccggagggtaaccccnggttagttacggttagtttaacgtaccgttggaataaccggtaagtacgaatacgacgaaggcccgtaagggtacccgtaaggacccggtccccgtaaggttaccgggg

SEQ ID NO: 120146 - DNA, 861 bp, Homo sapiens
  misc_feature: GYAE6OF01DKK59.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacattttgcgctcaactgtcttgtccagtgtgaggtgcagctgggtggaggtccgggggagtcttagttcagccgtggggggtccctgacgactctcctgtgcagcctcgtggacttccacctttcagtagctacgtggatgcacgtcgggtcccgaccgaacgccgtaccggaagggggaacggggtcgttggggtggttcggggttcctccgtaacgttaatttaacgtaggtaggtaaggtagggaagtacgaccaacgaaacgtccgtaaccggccggtaaccgttccggtaagggaaaccggggtaccgtaacttacccgtaacccgtaccttaccgtaaccgaacggaaccgaaaccgaaaacccggaacccgaaaaacggaaaccgtaaccggttacgtttaagttaacgttacccgaaggtaaacctaaaaggtaccgtaaaacgtcggtttaaccgaagggaaccggaccgggtaacggaaaccggggaaacccgtcgggtacgtttacggtttaacgtttaacgttttccggaagttaccgggaaacgtaaaggggtaacgttaagtaacgggaacccagggtaaccgtaacgttcccgggaacgggttaaccccggacccgggtaaaacccgttttaccgggggacccgggggaaacccgtaacccgggggtaaccccttcggggttaacccctaccccggttccctaccggtaccaccccggtaccccccg

SEQ ID NO: 120147 - DNA, 668 bp, Homo sapiens
  misc_feature: GYAE6OF01AXMP3.2.38.D05.1.454.CMB.1.raw
  modified_base (375)..(375): a, c, t, g, unknown or other
  misc_feature (375)..(375): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacacgcccaccctcggtgtcagtcgtcccaggacagacggccaggatcacctgctcgtggagatgcattcgaccaaaagcaatatgtctttagttgtaccagcaagacgccacggccacggccccgtgtgcgtggtgattataagtaaagacaggtagagacggtccctacgagggactcccgtggacgcgtacttctcgtcggtcctaccncgtcctacgaacgggaaccaaacgtcgtaccgtacgttcgacctacgtcgaggtcgggacgtaccgagggacaacggaagagtgggacgtctagtacgtttaattacgtacgtaactaagtaccacgacaacgtaacgacggtacgttaacggggttacggttttacggttttttgggggtaggttaccgggggtacggggtaaccggggtaaccgtacgggttacccgttacccgggtaacccgttccggttaaccggtcccggtaaccggaccccggtaagggtcccccgg

SEQ ID NO: 120148 - DNA, 708 bp, Homo sapiens
  misc_feature: GYAE6OF01B0LSD.2.38.D05.1.454.CMB.1.raw
  modified_base (524)..(524): a, c, t, g, unknown or other
  misc_feature (524)..(524): n is a, c, g, or t
tcagacgctcgacacacgaccggtgctcgatttagtatctgatagttggggtttgggggtgggtccaggaggcagaactcgtgggtgtctcaccatggcctggatcccgtctacttcctccccctcttcactctctgcacaggctctgaggccctcctatgagctgacacgacgcccacccgtcggtgtacacgttcgtcccccgaggaccaggaccggccgaggactccaccgtgcctacgtggagtatgactagttcgaccaaagcaattagtcgttactttagttcgggtacccagcgaaaggacggacccgagggaccccgaccgggtccccctggtcgtccgttagggtataattaataagtaaacggacgtaggtcgaacggtcccggacccgttacggacgggtacctcccgagacgtcgtacttccgtcgtcggtcctaccgacgccgtacggaacggaaccacgtacgtcgtaacgtcgactagtccgagacggtacctacgaggtacaagacgngtagacgtctacgttaattagttaacgtgactaacgtcgaacgtacgacgacgtacgggtacgttggttttaacgggttttcggtttacggggtaccgggttacggggaccggggtacaaccgggtcgtacccggtccgttaccggtaccgcggtaccggaccgtaccggtcggtaccccccgg

SEQ ID NO: 120149 - DNA, 588 bp, Homo sapiens
  misc_feature: GYAE6OF01AM6CN.2.38.D05.1.454.CMB.1.raw
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccgccaagctcgagggaggggctggtgtgggtctcacgtattaatagtgagtgggagtagcaacaagctacggtggactcgtagaagggccattcatcatcncaganacaacgcaagacacgctgtatctgacaaatgaacngtcagagacgccggagacgcggcttggtagttattacgtgtcgacgaaagagatacgcagcgagtcgtacggtccgaccgacgtacgtcggggaccaacgggaccctggtaccaccgtcctacccgcacgccctaccgaccgtaacggcccctacgtcccggtcccttccccggcggaccccgtcccgtcggccctacccgcggtcccgacccgtacccgtaccggacgaccgccaccgcggaccccggg

SEQ ID NO: 120150 - DNA, 674 bp, Homo sapiens
  misc_feature: GYAE6OF01C2Q9P.2.38.D05.1.454.CMB.1.raw
  modified_base (213)..(213): a, c, t, g, unknown or other
  misc_feature (213)..(213): n is a, c, g, or t
  modified_base (520)..(520): a, c, t, g, unknown or other
  misc_feature (520)..(520): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgccagtgtgaggtgcagctggtggagtccgggggagcttagttcagccgtgggggtccctgagactctctgtgcngcctcgtgattccacttcagtgctacgtggatgcacgtcggtccaccaagctaccgaggggacgggtctggtggtcggtctacgaacggttaattaagtaggtgaggttgggaagtacggcaacgaaggtccttaacggaccggtaactcccgggtaaggaaccggggcctaagttcccgaaacctacgttccgtaaccaaggaacgaacccgaaaccgaccgaaaacggaaacctacggtacttgtaacctacgtacgaataaaacgtgaaacctgttacgagaacggacgtacggaacggaaccnggtctgtacgttacgttacgacgtagaacgaaggatacgtagacgtacgagtaccgtcgtacggtacggcccgtaaggtacggtccggggaacccgaaccggggttaccctcggtacccgaacccgtttccgtacccgcgtaacccgtaccccg

SEQ ID NO: 120151 - DNA, 871 bp, Homo sapiens
  misc_feature: GYAE6OF01BP0S4.2.38.D05.1.454.CMB.1.raw
  modified_base (182)..(182): a, c, t, g, unknown or other
  misc_feature (182)..(182): n is a, c, g, or t
tcagacgctcgacacacgaccggtgctcgatttagtatctgatagttgggtttgggggtgggtccaggaggcagaactctgggtgtctcaccatggcctggatccctctacttcctcccctcttcactctctgcacgaggctctgaggcctctatgagctagacacacgccacccgtcggtntacagtcgcccaggacaggaccgcctaaggactccaccgtgcttcgaggaagtatacgctaattacgaacccaaaaagcctaaaattagtcgttacttttaacggttacggtaaacccgaagaccgaaaacggtaaaacggccccgaaacggggccccgtaacccggtcccccgtttaggtccggtacggtaaggggttaataaaacttaaattaaaaagtaaaacggacgtaaggtacggaacggttaaccgggtaccctagggtaaccgggaacttccccgaaggggaacgtccgtttaacttcccgtagtaccggtacccttacccgaggtaccccggtaaggaaaccgggtaaaacctaaacggtaccgtccgtaaccgttacgaacctaacgtaccgagggttaacgaacgtacccggaagtaacggaagtaaacgagtacggacgtctaacgttataacgttactagttaacgaacttacgaaccgtacgaaacgaccgtaaagtaccggttaacggtttacgggtttttaaccgggtttaggggttaaccgggtttaacgggggaacccggggtaaacggttaaacccgggtaacgtacccggttaacccgggttacccgggtttaaaccgtaacggggtaacccctaaccgggttaaccccggaaacgggtttcccccccg

SEQ ID NO: 120152 - DNA, 676 bp, Homo sapiens
  misc_feature: GYAE6OF01A84BL.2.38.D05.1.454.CMB.1.raw
  modified_base (479)..(479): a, c, t, g, unknown or other
  misc_feature (479)..(479): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgcaagctccgagggaagggcgtggtgtgggtctcacgtattaatagtgagtgggagtagcacgaagctacggcggactccggtggaacgggccgtaacttcgaacctactccgtaccgagacgaaccaaccgaccaaagaaccgacgctacgtactcgtagaactaaatacgaactagtcgtaggacggacgaccggaaggaccgacggtcgttaggtacgttaatttacgtcggtcgaacgaagaagagtacgacgtagacgacgttcggtacggtaccnccggtaacgtacgggtaccggggaccgaaccgggtaccccgttgggcccgtaccgtcctaccgtcgaccggtccctaccgaccggaaccgtccctaggttcccgttcccttcccggagggtccctcccgtcggccccagggtaccggcctaccgacccggacgtacgacgacccggacggccgggccccggtccggg

SEQ ID NO: 120153 - DNA, 676 bp, Homo sapiens
  misc_feature: GYAE6OF01BFRIR.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagcccaccctcggtgtcagtcgtcccaggacagacggccaggatccgacctgctagtggagatgctagttcgaccaaagcaaattatgtactttagttcggtaaccaggacaagaacgccgaggccacggtcccctgtcgcgtaggtacgtatataacgtaaagacgtaggtacggagacgtcccgtagacgggtactcccgagacgtcgtacttcgtcgtggcctaccacgtccgtacgaacggaactaaaccgtagttaccgtaacgtttcgaaccttaagtcgtaagggtacggtaacgtccgaaggtacgaaacggtaagtagtacggtaacggtcttaacggtaactttaacgtaccgtagtaactaactacgacgacgagtaacgcgtacgtaggttacggtttacggttttgggtacgttcggggaaccggtagggtaacccgtggtaccgttaccgtaacccggttacgtacggtaccgtaccgtacccggaggttacccccgg

SEQ ID NO: 120154 - DNA, 669 bp, Homo sapiens
  misc_feature: GYAE6OF01AZ5XF.2.38.D05.1.454.CMB.1.raw
  modified_base (169)..(169): a, c, t, g, unknown or other
  misc_feature (169)..(169): n is a, c, g, or t
  modified_base (180)..(180): a, c, t, g, unknown or other
  misc_feature (180)..(180): n is a, c, g, or t
  modified_base (238)..(238): a, c, t, g, unknown or other
  misc_feature (238)..(238): n is a, c, g, or t
  modified_base (533)..(533): a, c, t, g, unknown or other
  misc_feature (533)..(533): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcgtggtttctgtgctatttaaagtgtcngtgtgagtgcngcgtggtggaggtcggggagcttagtcagccgtgggggtcctgagactctcctgtgcncgcctcgtcggtacttccgtaccttcgagttagtctagtacggatcggaccgtaccggtccgggtccccgaccgtaacggtccgtaccgggaagggggtaacggggtcggttggggtcggtacgggtccgtacgtaacggttaattaaggtacgtaggaaggtacgggtaacgtacgtacaacgtaacgtcgtaacggccgggtacgttaccggggtacgggtaaccgggtccgtaacttaccgacctacgtttccccgaggaaaccacgaaaccgtaaacccgcgaaaaccgtnaccggtattcgaacttccgagtaaactacgtcgaatcgtgtacggacgacgggcaagggacgttctgttgagttactgcgaaggacaaggtgatcggcaacgctagggacgttggacccctgggtaaccctcgggg

SEQ ID NO: 120155 - DNA, 617 bp, Homo sapiens
  misc_feature: GYAE6OF01BHG2K.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggaggcttagttcagccgtgggggtccctgagactctcctgtgcagcctctggattcaccttcagtagctactggatgcacgtcgggtccgaccaagctaccgaggggagggcgtggtggtgggtctcacgttattaagtagtgagtgggagtagcaacaagctacggcggacctccggtagaacgggcattcaccatctcagacgaacaacgaccaaagaacacgctagtactcgtagactaaagtgaaacagttcaggaacggaacggccggaaagggtaccacgggtcttaggttagttactttacgtggtacgaacgtaaaggagtaagtacgagacgacgaggtccgtacgggaacccgaccggtaaccgttacggcggggacccgaaacgggtaccccgtggtaccccgacccgttacctccctccgccgtacccccg

SEQ ID NO: 120156 - DNA, 845 bp, Homo sapiens
  misc_feature: GYAE6OF01CV1CC.2.38.D05.1.454.CMB.1.raw
  modified_base (431)..(431): a, c, t, g, unknown or other
  misc_feature (431)..(431): n is a, c, g, or t
tcagacgctcgacacacgaccggtgctcgatttagtatctgatagctgggttttccttgttgctattttaaaaggtgtccagtgtgaggtgcagctggtggaggtccgggggaggcttagttcagccgtgggggtccctgagactctcctgtgcagcctcgtggtacttccaccttcagtagcttacgtggatgctacgtcggggtcccgaccgaacgccgtaccggaagggggaacggggtcgttggggttggttcggggtcttaccgtaacggttaatttaagtagtggagtagggagtagcaacgagccgtacggcggtacgtcggtaggaacggcctacttccacctactcctaccgaagaacgaaccaaaccgaccaaaagaaccgacgtacgttagttactacgtgaaactaaagtacgtaaacngttactaggaacggacggaaccggaacgggtaaccggacggtcgttaggtttaacggtttaacgttttaacgtcggtacggtaaaacgaaacggttaacgtaacggtagaaccgaacggacggtacggtacccgttaaccggggtaacccggacccggttaaccggtaccggggttaccggggaacccggtaacccggggtacccggttccgggtacccgtaccccgttacccgtcccgtacccgacccgtaccccgtaaccccgaacccggggtaacccgtcccgttaccggttcccggttaccccttcccccgggtccgccccgtcccgtcggtcccgtaccggaccggtacccgaccccgtaccgtaccggtaacgcccgtaaccgacccgggccgcccggggtccccggg

SEQ ID NO: 120157 - DNA, 672 bp, Homo sapiens
  misc_feature: GYAE6OF01AS7LT.2.38.D05.1.454.CMB.1.raw
  modified_base (201)..(201): a, c, t, g, unknown or other
  misc_feature (201)..(201): n is a, c, g, or t
  modified_base (529)..(529): a, c, t, g, unknown or other
  misc_feature (529)..(529): n is a, c, g, or t
tcagacgctcgacacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcgactgggtccncgaagctccgaggggagggcgtggtgtggtctcacgtattagtagtgagtgggagtagcacaagctacgcgacgtcgagaaggccatccacatctaccagacgaacacgaccaaagacacgctagtactcgtagactaaatacgaactacgtcgtaggaacgaacggacggaacggaacaccggtgttgtacgttaacttacgttggtagaacgtaaggaacgtatacggacgacggcgtaaagtcgtacgggtaccgaccggtacgtaccggggtcgggaccgaccgggtacccgtcggtacccgcccgttaccgcctaccgtaccncccgtacccgacccggaaccggtacccctaccgtcccggttcccttcccccgggaccgtccccgtacccgtccggccctaccgggaacggtccgacccgtacccgaccgacggaccgacgacccgccgggccgggtccccggg

SEQ ID NO: 120158 - DNA, 815 bp, Homo sapiens
  misc_feature: GYAE6OF01EODPE.2.38.D05.1.454.CMB.1.raw
  modified_base (242)..(242): a, c, t, g, unknown or other
  misc_feature (242)..(242): n is a, c, g, or t
tcagacgctcgacacacgaccggtgctcgatttagtatctgatagttgggtttgggggaagaggaagactgacggtcctgccacaggtggtgctgggcacgggtgggcactcgacacaacattttgcgctcaactgtcttgtccagtgtgaggtgcagctggtggaggtccgggggagcttagttcagccgtggggtccctgacgactctcctgtgcagcctctggacttcaccttcagtanctacgtggatcgctacgtcgggtcccgaccaagccgtaccggaggggaacggggtctgggtggtggtctacgtaacgttatttaaagtaggttaggagtaggggactagacaacgaaagtccgtaaccgggccgtaaccgttacgggacggtaaacggggtcccgtaattcccgaacctacgttccgtacccgaaaggaacgtaaccctaaaaacccggcccgtaaaaacggaaacccgtacccggtaacgttacggttaaaccttaccggttaacggtaaacctaaaacgggtttaaccggaaaaccttagggttaacccgtaaggaaaccgggtaccgggaaccccggtaagggaaacccgtaccggggtaactttacgggttaacgtttaaccgtttacggtaggtaacggtaccgaaaagggttccaaaagttcgaacgaccgtgtaacgtacggttaccggtaaccgtccgggtaaaccgttaccggggaccggggacccgtaaccggggtaaaccccgttcgggtaccctaacccgttaccgtccccgttaacgccgtaaccccccg

SEQ ID NO: 120159 - DNA, 869 bp, Homo sapiens
  misc_feature: GYAE6OF01DVOH6.2.38.D05.1.454.CMB.1.raw
tcagacgctcgacacacgaccggtgctcgatttagtatctgatagttgggttgggggagccccagccctgggattcccagctgtttctgcttgctgatcaggactgcacacagagaactcaccatggagtttgggctgagcttgggttttccttgttgcttattttaaaaggtgtccagtgtgaggtgcagctggtggaggtccgggggagtcttagtcagccgtgggggtcctgagactctctgtgcacgtcctcgtggtacttccaccttcaagtacgtcttaacgtggaacttgacgaacggttcggggtaccccgaccgtaacggtccgtaccgggaaggggggaacgggggtccgttggggtcggttcggggttacctacggtaaccggtttaaatttaaggttacggttaggtaacggtagggggtaagttacgggaaccaaacggaaacggtaccgtttaaccgggaccgggttaaccgttcccggggtaaacgggaaccggggtaccccggttaaactttaacccgaaacccttaacgtttaccccgtaacccgtaaaggtaaaccgaacccgtaaaacccggaacccgaaaacgaaacccgaccgtaccggtttacggtaacttacgtaacgtaaacgtaaaacggttacgaaaccggttacgtacggttaacggaacggtaaccggaacccggggtacggaacccggtacgggtcgtttacgggttacgttaaaaccgtttggtcgggttaacgaaaccggtaaaaggtacggtttaagaaccgggtaacgacggaacgttaccggacggggtttaacccgggtaaccccgtaaccgggtaacggttaaccccgggggg

SEQ ID NO: 120160 - DNA, 850 bp, Homo sapiens
  misc_feature: GYAE6OF01DQKFU.2.38.D05.1.454.CMB.1.raw
tcagacgctcgacacacgaccggtgctcgatttagtatctgataggttgggtttggggggaagaggaagactgacggtcctgccacaggtggtgctgggcacggtgggcactcgacacaacatttgcgctcaactgtcttgtccagtgtgaggtgcagctggtggaggtccgggggagtcttagttcagccgtgggggtcctgacgctctcctgtgcacgcctcgtggtacttccaccttcagtacgtactacgtggatcgcctacgtcgggtcccgaccaacgtccgtaccggaagggggaacggggtcgttaggggttcggttcggggtccttacgtaaccggtttaaagtttaaacgttaggttagggtaaggttagggggaacggttacgaccgtaacgtaaacggtaccgtaaccgggccggtaaccgttccgggtaagggaaaccggggtacccgtaacgtttacccgaaacctacgttaccgtacccgaaacggaaccggtaaacccgaaaccccgaacccgtaaaaacggaaacccgtaccggtacgtttacggttaaccttccgtaacggtaaaaccgttaaattaaccgggaaaacgttacggttaacgaacgggtaacggtaaccggtaaccgggaacggtaacccgtacggggttactttagggttaacgtttaacgtttaaccgtggtacgaacgtaaggtagtaagttacgacgtagacgaggtaccgtacgggtacccgtaccggtacgtaaccgggggcgggaacccggtaaccgggtaacccggtcggtaacccgtacccgtttacccgtacccgtcggtacccgtacccccg

SEQ ID NO: 120161 - DNA, 630 bp, Homo sapiens
  misc_feature: GYAE6OF01EQ6B9.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctcgtggagatgcattcgaccaaagcaaatatgacttattcggtacctagcagaagccaggccacggcccctgtcgcgtggtgatatataagacagtgagcgtccctagagggactccgtggacgcgtacttctccgtcgtcctacgacgtcgtacggacggaaccaacgtacgtacgtacgttacgaacctagtacggtaggtacggtacgtaccggaggtaacgaagaacgtgtaaggacgttacgtaacgtaactttacgtacgtcgtaacaacgtcgacgaacgaagtacgagtacggttaacggtttggtttacgggttttgggacgggttacggggacgggtacgggaaccgtaggtccggtacgtacccggttacgtacggtaccggacccggtaccgcgtacccccgg

SEQ ID NO: 120162 - DNA, 799 bp, Homo sapiens
  misc_feature: GYAE6OF01D3IP4.2.38.D05.1.454.CMB.1.raw
  modified_base (760)..(760): a, c, t, g, unknown or other
  misc_feature (760)..(760): n is a, c, g, or t
  modified_base (764)..(764): a, c, t, g, unknown or other
  misc_feature (764)..(764): n is a, c, g, or t
tcagacgctcgacacacgaccggtgctcgatttagtatctgatagttgggtttgggggagccccagccctgggattcccagctgtttctgcttgctgatcaggactgcacacagagaactcacagtgggtagtttgggctgagtcgttggttttccttgttgtacttaagttttaaaggtcgtacctagttggtggaggtgacgtaggtcggttagggtagggtacgggtccggggggtagttacgtttacggttacgacgggttcccgggtccgggggttccctaggtaacgtccttccgtccggtggtcgtaccgacgtccgttcgtacggttaccttcctaccgttagaacgttacgtaccgttacgttaggactccggtaccgtaccgggtccggtaacccggacgaacggtccggaacggggtacgggggtacggggtcggttaggggttccgggttacggtttaccgtaccgtttaaagttaaggtttaagtacgggtagtacgggtagggtaacgtaaccgaacgtaacggaacggtaccgtaaccgggtaccgtaccgggtacggtaaacgggaccggtaccgttaccttaccgaccgtacgttaccgaaccgtaacggaaccgaaccgtaaccgaacgaacgaacgtacgtacgtagtactacaacgtaacgtaagtacgactacggtgaacgtacgacggtacgacgggtactggtacgtagtacttagtcgagtcgaagagtgaacgtnacgngtacgtgtaccggacgtaccgtggaaacgtccggg

SEQ ID NO: 120163 - DNA, 864 bp, Homo sapiens
  misc_feature: GYAE6OF01ATVFO.2.38.D05.1.454.CMB.1.raw
  modified_base (794)..(794): a, c, t, g, unknown or other
  misc_feature (794)..(794): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagtcgttggttttccttgttgtcttaagttttaaaaggtgtacctagtgtggaggtgcgagtcgtgggtagggacgggtccgggggaggtctttagtcgacggtccggtcgggggtcctggaacgtccgtctccgtgtcgtcgacgtccgtcgtaggtacttcctaccttcggaagttagccttacgtcggagttcgaccgtcgggttccgggcccgaaccgaacggtccgttaccgggaggggtaaccggggtcggttgggtacgggttcgggtaccttacggtaacgttaagtttaaacgtgggtaggtacgggttaggggacgttacgaccgtacggaaacggttccgtaccgggaccggtaacgttacccgggtaacgggaaccgggtccccgtaagtacccgtaaccgtacttaccgggacccgaaaggtaaccgaacccgtaaacccgacccgaaaacggtaaaccgtaccggtacgtttaacgaccttaccggtaacgaaaccctaagtaacgggttaaccagggttaaccggacggaaccgggtaaccggaccgggaaggttaaccccggacggtttcgtaacggtttacggtttaaaccttggaccggttacgaaacggggtaaactaccggaagttaacccgggnaaaaccgggtggtaacccggttaaccgggttacccggaacccggttccccgtaaacgggggttccccggg

SEQ ID NO: 120164 - DNA, 630 bp, Homo sapiens
  misc_feature: GYAE6OF01AR3V6.2.38.D05.1.454.CMB.1.raw
  modified_base (286)..(286): a, c, t, g, unknown or other
  misc_feature (286)..(286): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttatcggtaccagacagaacgccacggccacggtcccctgngcgtggttgattataataagacagtaggagacggaccctcgagggtacctccgtgagcgtattcgtcgtcggccttaccgagtccgtacgaacgggtaacaacgtacgtcgtaacgttacgacctatacgtaggtacggagaccgaggacaaggaagtcgtaggacgtactgtaacttagttacgtacgtagaacctacgacgtacgaagacgtagtacgtaggtttacggtttacggttttggggtacgggttccgggtaacgggaaccggggttaccaaacgggtcctaaccggttaccggtaccgttacgggaacctaccgggacccgtaccgggtcccgg

SEQ ID NO: 120165 - DNA, 728 bp, Homo sapiens
  misc_feature: GYAE6OF01ENDZ6.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacacgcccaccctcggtgtcagtcgtccccaggacaggacggccaggactccacctgcctcgtggagatcgctagttcgaccaaagctaaatatgtactttagttcggtaaccagtcaagaacgccgacggccacggcccctggtcgcgttggtagtaactaataagtaaaggactaggtagaacggacggccctaggacgggtactcccgtaggacgtcgtaacttccgtacgtcggtcctccgacgtccttacggaacgggtaaccaaacgtacggtaccgtacggtttacgaacctacgtacggacgggttacgggaaccgttaccgaagggaaccgtaaagggaaacggttcgtaacgggtacgggttcgtaagtaaccgttttaactttaccggtacggtaactaacggttaccgaagtacgaacgaacgtaggtaccgttaggtttacgggttttacggtttttggggacgggtttccgggacgggtaacgggaaccgtacggtccgtaccggtacccgttacggtacggtaaccacccggtacccgtaggtcccccgg

SEQ ID NO: 120166 - DNA, 772 bp, Homo sapiens
  misc_feature: GYAE6OF01BTGK9.2.38.D05.1.454.CMB.1.raw
tcagacgctcgacacacgaccggtgctcgatttagtatctgatagttggggtttgggggagccccagccctgggattcccagctgtttctgcttgctgatcaggactgcacacaagagaactcacatggagttgggctgagtcgttgggttttccttgttgtacttaattttaaaagggtgtccagttggtgagggtgcaggcgtgggtgggagggtccggggggaggtcttagttcgacggtccggtcggggggtccctggacgtacctcgtcctgtcgcacgtccgtcgtgtacttcctaccttacgagtacgtacttacgtggtacgtcgaccgtacggtcggggtaccccgacgtaacgccgtaccggagggggacgggtcgtgggtggtcgggtctacgtaagtaattaagtagtaggtagtggggagtacgacgaacgaacgtaccgtacggaccggtaccgtaccggtagggaaccgggtcctactaccaccgtattcctacgaacggaacgaaccgaaacgaacccgaaacgtaaccacggtactacgttactaccgtagtaaacgtaagtacgtaacgtacggtacgtacggaacggacgggaacccgggtaacggtaaccgggtaccggtacgtttaacggttaccgttaacgttacggtacggacggtaaacggtaaacggttaaggaacggtacggacaacggtacggaccggttacgggtaaccggtacccggtaacccggtaaccgggtacccggggg

SEQ ID NO: 120167 - DNA, 735 bp, Homo sapiens
  misc_feature: GYAE6OF01BSDCJ.2.38.D05.1.454.CMB.1.raw
  modified_base (662)..(662): a, c, t, g, unknown or other
  misc_feature (662)..(662): n is a, c, g, or t
tcagacgctcgacacacgaccggtgctcgatttagtatctgatagttggggtttgggggacgccccagccctgggattcccagctgtttctgcttgctgatcaggactgcacacagagaactcaccagtggtagttgggctgagtcgttcgggttttccttggttcgtattaaagtttaaaggtcgtacctaggtgtaggaggtcgacgagtcggtgggtagggtacgggtccggggagtcgttagttcgacggtccggtcgggggtcctagacgtactcgtcgtgtcgcacgtctgtgtacttcctactagagtacgtctagtgactcgcgtacgtccggtcaccgtacgtcgtacggagggtacggtcgttggtggtacggtctacgtaagttaagtaagtggtagtaggtcggtaacgtacgacgaacgacggtacgaccggtacgtaccggttaccggaaggacccgggtacctaaccgtaccgtaacctacgttacccgaacggaacgaaaccgaaccccgaaccggaaacgtaaacgaccgtaccgttagtaacgtcgtaacgtaagaacttaaacgacgtaacggacgtaaggaccggaagggacccgtaacgggaaccgcgggttaccgtaccgtttaagccggttaatacggngtaacgaacgtaggtaccaggtaccgagtacgacggtaacctcggtaaccggccaaccggtcggtaaccgggg

SEQ ID NO: 120168 - DNA, 877 bp, Homo sapiens
  misc_feature: GYAE6OF01D11UK.2.38.D05.1.454.CMB.1.raw
tcagacgctcgacacacgaccggtgctcgatttagtatctgatagctgggttttccttgttgctattttaaaaggtgtccagtgtgaggtgcagctggtggaggtccgggggaggcttagttcagcctgggggtccctgagactctcctgtgcagcctcgtggattccacctttcagtagcttacgtggattgcacgtcgggtcccgaccaagcctccggaagggggaggggcttgggtcgtgggttcctcgtaacggttatttaaagtaggtggagttggggaagtaagcaacgtaagcccttaacgggccgggtaaccttacccggtagggaaacgggtcccgtaactttccgaaccctaatccctaccggaaggaacgaaccaaaccgaccgaaaacgaacctccgacttacggtaactcgtagaaacctaaaagtcggaactaggttcctaggaaggaccgccgggtaaggacacgggtctaggttcgtaaacgtttcgtaggtacgaacgtaaaggtagtaacgtaggaccaacgacgtacggtacggtcggtaaccgggacccggttaacgtacccgggtacggggtacccggaaccggggttaaaccccgtcgggttacccctaacccggtttccccgtacccgttaccggaacccggttccccctacccggaaccccgggttaaacccggtccccgttaaccggtttccccgggttacccccttaccccccggtccggggtacccccggtaccccgttccggggtaccccctaccgggaacccgggtcccgaaccccgttaccccccggtaacggaacccgggacgaaacccggtacccgggtccgggtcccccgggggtaccccgggg

SEQ ID NO: 120169 - DNA, 789 bp, Homo sapiens
  misc_feature: GYAE6OF01BQMP3.2.38.D05.1.454.CMB.1.raw
  modified_base (720)..(720): a, c, t, g, unknown or other
  misc_feature (720)..(720): n is a, c, g, or t
tcagacgctcgacacacgaccggtgctcgatttagtatctgatagttgggtttgggggagccccagccctgggattcccagcttgtttctgcttgctgatcaggactgcacacagagaactcaccagtggtagtttgggctgagtcgttgggtttttccttgttgtactttaaagtttttaaaaggtgttccgagttggtggtaggtgcgagtcggttggtgggacgggtccgggggagtcgttaggtccgacggtccggttcgggggtccctggacgtaccgtccgttaccgtggtcgacgtacgtcccgttcgttggtactttaccgtaccctttacgaggttacgttacgtacgttaggtagtccggtacgtaccggttccgggtaccccgaccgtaacggccgtaccggtaaggggaacgggtcgttagggtcggtgggtactacgtaacgttaagttaagtaggtagtaggtaggaagtagacaacgaagtccgtacggcgtacggtccggtaggaccggtacctagtaccacgtactaccgtacgaaggacaaccggaaaccacgaaaacggtcaacgtacggttacgtacgttacgacgtaacgtaaagtcgtaaaccggtacgttcgtaacggaccgggtaccggaccggtaacggtacgaaccgggttcttaagggtttacttagtaccggttagggaacgacgaaagtanaggttaacggaccaaggtaccgtaacgggtcgtaacccgggtaccgtaccggttaaccgggtaacgggg

SEQ ID NO: 120170 - DNA, 637 bp, Homo sapiens
  misc_feature: GYAE6OF01BIRQD.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccgaggacagacggccaggatcacctgctctggagatgcattgaccaaagcaatatgcttattcggtaccaggcagaagccaggccacggcccctgtgctggtgatataataaagacagtgagacggccctacgagggactcccgtggagcgtacttctcgtgcctccgcgcgtacgagggaaccaacgtacgtcgtaaccgttcgaaccgtaacgtacgaggttgggacgtaccggacggacgtaaacggaagacgtaggaggaccgttagaacgtttattaaccgtgttaaccgaagttacgaagtaccaagactaaggccgtaaggttcggttttaacgtttttcggggtggtttcggggacgggtagggtaacccgtaaggtccggttaacggtacccggttaccgttacgggttaaccgacggtaaaccccggtcgggtaccccg

SEQ ID NO: 120171 - DNA, 701 bp, Homo sapiens
  misc_feature: GYAE6OF01DGN1K.2.38.D05.1.454.CMB.1.raw
  modified_base (275)..(275): a, c, t, g, unknown or other
  misc_feature (275)..(275): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggtagtttgggctgagtcgttgggtttttccttgttgtacttaagtttttaaaaggtcgttccagtggtggtaggtgcagtcgttgggtggaggtccgggggagtcgttagttcacggccgtcgggggtccctgagctcctctgtcgcngctcgtgtattcctaccttctagtagtctacgtggatgctacgtcggtccgacgacgccgacggagggagggtcgtgggtggtcggtctacgtacgttaagttagtaggtgagtaggagtagactaacgacgtcgtacggacggtaccgtacggtaggacggtccgtactccgaacctctacctacgagaacgaaccaaaccgacgaaacgaaccgtacgtcgtacgttaacgtacgtaccgaacttaaacgtacgtaaacgtcgtacgtaacgggacggaaccggtaccgggaacggtaaccgttcggtaacggttttggttaaccgtttaacgtttccgtaggtaccggtaacgtaaaggtagtagtaccgacgaggtacgtagtacccggtaggtaaccccggtccggtacggtaacccgggg

SEQ ID NO: 120172 - DNA, 745 bp, Homo sapiens
  misc_feature: GYAE6OF01B1LUL.2.38.D05.1.454.CMB.1.raw
  modified_base (620)..(620): a, c, t, g, unknown or other
  misc_feature (620)..(620): n is a, c, g, or t
  modified_base (636)..(636): a, c, t, g, unknown or other
  misc_feature (636)..(636): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgacggcctcctatgagctgacacagccacccgtcggtgtcgagttcgtaccccgaggacagaccggccaggtactccacctgctcgtggacgagtgactacgttcgaccctaaaagactaaagttactacggtacctttaagttacggtaaccgaacgacgaaggaaccgacccgaacgggaccccgacgggtcccccgttggtcggtcgttagggtacgtaagttaacgtaaagtaaacggaacgtaggtacggaacggtaccggtccccgtacgaacggggtaccttaccggtacggacggttaccgtaacgtttccgttaccgttcgggacccttacgacgtaccggtacggaaacgggaactaaacgtacgttaaccgtacgttaaccgactacgtacgtaggtacggtacgtaccgaaggacgtaagacgtagtacggcgtcgtaactacttaattacgtagtacaaccgtnacgacacgacgtaagngttacggtttcggtttaggtttggggaccggttcgggaacgggacggtaccgtaggtacccgtagggtacccgttaccggagttacccgaccgtaacggcccggtcccg

SEQ ID NO: 120173 - DNA, 775 bp, Homo sapiens
  misc_feature: GYAE6OF01E2NTJ.2.38.D05.1.454.CMB.1.raw
  modified_base (202)..(202): a, c, t, g, unknown or other
  misc_feature (202)..(202): n is a, c, g, or t
  modified_base (369)..(369): a, c, t, g, unknown or other
  misc_feature (369)..(369): n is a, c, g, or t
tcagacgctcgacacacgaccggtgctcgatttagtatctgatagctgggtttttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtgggtccnccaagcctccgaggggagggctggtggtggtctcaacgttattaatagtgagtggggagtagaccaacgaagtccgtaacggttacggaccgttccggtaggaaacggggtccgtatttaccacctactccgtaccgaaggaacgaaccgaacgaccaaaagaaccncgtactgtactctagactaaaatgaacgtgtcagaggacgccggaagacgtcggtctagtacgttaattacgtggtacgaacgaagagtagtagacgagacgacgcggttacggacggtaccgtaaccggtaccgggcggggtaacccggtaaaccggggtacccgttacgggtacccttaccccggttccgtaccctcgtaacccgcccgttaaccccgtaacccggaacccgggtccccttaaccgggtttcccccgggtacccccgtttccccgggcccggtacccgtacccccggttacgccccgttacccgggtaaaccgggtacccgccccgttaaaccccggccgggtaaaccacccggacccggaaacccggttccgggcccccggggtaccccgggg

SEQ ID NO: 120174 - DNA, 800 bp, Homo sapiens
  misc_feature: GYAE6OF01AUN1U.2.38.D05.1.454.CMB.1.raw
  modified_base (201)..(201): a, c, t, g, unknown or other
  misc_feature (201)..(201): n is a, c, g, or t
tcagacgctcgacacacgaccggtgctcgatttagtatctgatagctgggttttccttgttgctatttaaaaggtgtccagtgtgaggtgcagctggtggaggtccgggggaggtcttagttcagccgtggggggtccctgagactctctgtgcagcctctggattcaccttcagtagctacgtggatgcacgtgggtccncaagctcgagggaagggctggtgtggtctcgaagtattaagaggtgagtgggagtagcaacgaagctaacggcggtactccgtagaacggggccattccgacctatccgtaccaaggtacgaccaaccgccaaacgaacgacggcctaggtactctaggacaaaatcgaaacgtgtacctaggaagtacgacccggaaggaccacggggtaccttggttaacgttaagttttaccgtaggttaccggaacgtaaaaacggggtagtaagttaacggacgtaaacggtcgtaacgggtacgttaacgggtaccggtacccgggtaaccggttaaccgggtacgggggacccggtaaaccggggtaaaccccggttagggtcccgtaaccccggttcccgttacccgccggtaaccggtacccgtaccccgtaacccggaccgggtaccccgtaccggtacccggttccccgttaccccggtcccggacccggtaccccggtccgtacccggttcccggaaccggtacccgtaacccgtacccggttaaccccggaacggaacccgacccgaccgggtaaccgggtccccgggtacccggg

SEQ ID NO: 120175 - DNA, 646 bp, Homo sapiens
  misc_feature: GYAE6OF01EJV5T.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctgggggtccctgagactctcctgtgcagcctctggattcaccttcagtagtctactggatgcacgtggtccgcaagctcgagggaagggctggtgtggtctcgtacgtataagtagtgagtgggagtagcacaagctacggacgtacgtcggtacgaagggccgtattcaacctatcctacgaagacgtaacaacgaccaaacggaaccacgctgttactacgtcgaacaatacgaaacagtactagaggacgaccggtaggaaccgacgggtcgttgttagttaatttaacgtcgtaagacgaaacggtagtaactaggaccgacggacgacggtacggttacgggtaacccggacccggtaaccgttaacgggtaccggggggaacccaaccgggggtaaccccggtcggttacccaccccggttacctccccgtaccgaccgggttaacccccg

SEQ ID NO: 120176 - DNA, 616 bp, Homo sapiens
  misc_feature: GYAE6OF01AEQ0J.2.38.D05.1.454.CMB.1.raw
  modified_base (409)..(409): a, c, t, g, unknown or other
  misc_feature (409)..(409): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctgggagatgcattgaccaaaagcaaatatgtacttagttcggtaaccagcaaggaacgccgacggccacggcccccttggtgcgttggtacgataataataaaaggaacaggtagaagacggcccctaggagggtactcccgtgacgcgtattcgtcgtcgctccagctacgaggacaacgagtcacgttnaccatcgaggtggacgtccgaaggcaaagaaggactaggacgtctacggtaacttaacgttaccgtagtactaacgtcaagtacgaagaacgagtaccgttaagggttcgggttttacggtttttacggggtcggttacgggacgggtaaggtaccgaacggtccggtacgtacccgtcgtacgaccgaccgtacccgaggtccccg

SEQ ID NO: 120177 - DNA, 787 bp, Homo sapiens
  misc_feature: GYAE6OF01CCKBU.2.38.D05.1.454.CMB.1.raw
  modified_base (261)..(261): a, c, t, g, unknown or other
  misc_feature (261)..(261): n is a, c, g, or t
  modified_base (663)..(663): a, c, t, g, unknown or other
  misc_feature (663)..(663): n is a, c, g, or t
tcagacgctcgacacacgaccggtgctcgatttagtatctgatagttgggtttgggggtgggtccaggaggcagaactcgtgggtgtctcaccagtggcctggactccctcttacttcctcccctcttcactctctgcacgaggctcgtggacggccctactagtggacgtctagaccacgacgccctaccgtggtcgtacgacggtccgacccgaaggacgacggaccggccgaggactcgacctgcgtcgtaggaagtntacgctaacgtacgaaccaaagtactaaagttcgtacgttacgttttaacggttacggaaccgaacggacggaaacggtaaccggaccggaacggaccccgtccccgggtccttggttaccggtacggttggtaattaaattaacgtaaagaaaacggcgtaggacgaccggaccgtccgaaggacggtcctcggtaaggcttaccgttacgttccgcggtacgaccctacgagtaccgaaacggacgtaactacggtacgtccgtaacgtaacgactaggtacggtacggtacgggtaacgtacgggaaagacggtaaaggaacgtaggtacggtacgttacgtacggttaaacttacgttaacgacgttaacaacggtacgtaaacgacgaacgtaacgnggtttaacggttcggtttaacgggtttgggtttaccgggtaggggacgggtacgggtaaacggtcgtacggtaccgtaccgggttacgtaccgggtacggacctcggaacccggtcgtacccgg

SEQ ID NO: 120178 - DNA, 631 bp, Homo sapiens
  misc_feature: GYAE6OF01ADXFZ.2.38.D05.1.454.CMB.1.raw
  modified_base (512)..(512): a, c, t, g, unknown or other
  misc_feature (512)..(512): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctcgtggattccaccttcagtagctactggatgcacgtgggtcccgccaagcctaccgaggggaaggggtcgtgggtggtcgggtctcgacgttattaagtagtgagtggggagtagactacgaagtcctacggcggaccttccggtaggaacgggccattccaccactctcaagacgaacaccgaccaaagaaccacgctagtactctagactaaatcgaaactgtcgtagaggacgccggaagccgacggctagtatattcgtgacgagaagtagagtcgacgacgaacnggtcctacggggacccgacccggtaacgtacccgggtcgggggaccccgtaacgggggtaacccccttcgggtaccccttaccccggtcccttaccccgtccggaccccggtacccccg

SEQ ID NO: 120179 - DNA, 690 bp, Homo sapiens
  misc_feature: GYAE6OF01BXI9P.2.38.D05.1.454.CMB.1.raw
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (343)..(343): a, c, t, g, unknown or other
  misc_feature (343)..(343): n is a, c, g, or t
  modified_base (392)..(392): a, c, t, g, unknown or other
  misc_feature (392)..(392): n is a, c, g, or t
  modified_base (441)..(441): a, c, t, g, unknown or other
  misc_feature (441)..(441): n is a, c, g, or t
tcagacgctcgacacacgaccggtgctcgatttagtatctgatagttgggtttggggggaagaggaagactgacggtcctgccacaggtggtgctgggcacggtggcactcgacacaacatttgcgctcaactgtcttgtccagtgtgaggtgcagctggtggagtccgggggagcttagttcagccgtgggggtccctgacgactctcctgtgcagcctctggacttccaccttnagtanctaacgtggatgctacgtgggtcccaccaagcctaccggaagggggtaacggggctgggttggtcgggtccacgtacgttattaagtgtgagtgggagtacncacaagcgtaaccgcggtaccgtccgtaggaaccggcctattccaaccncgtccgtaccgaagaccgaacaacgaccaaagaaccacgtctagttacnctacgactaaagtcgtaaaccgtagttacgtacgaacggacggacccggaacggaccgacggtcgtgttagttaacttcgtaggtacgaacgaaggagtagtacgacggagaaccggtcgtacggtaccggtaccgacccgggtacgttacccggggtacggggaacccggtaaccgggtaaaccccgggttccggttaacccgtaacccccggtttcaaccccgttcccggaaccgttacccccccgg

SEQ ID NO: 120180 - DNA, 795 bp, Homo sapiens
  misc_feature: GYAE6OF01B1SUK.2.38.D05.1.454.CMB.1.raw
  modified_base (687)..(687): a, c, t, g, unknown or other
  misc_feature (687)..(687): n is a, c, g, or t
  modified_base (710)..(710): a, c, t, g, unknown or other
  misc_feature (710)..(710): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggtagtttgggctgagtcgttgggttttccttgttgtacttaagttttaaaaggtgtcctagtgtggaggtgcgagcgtgggtgggaggtccgggggaggtacttaggttcgacggtcccggtcggggggtccctggacgtaccttccgtccgtgtcgcgacgtcctcgtggtacttcctacccttcgtaagttacgtccgtaacgtggtacgtcgccgtaccggtcggggtaccccgaccgaacggtccgttaacccggggaagggggtaacggggtcggttaggggttcgggtcgggtttaccgtacgtaaacggtttaagttaaacggttaggttagggtaaggtacggggagtacggaacgacgaaggtccgtacggacggtaccgtaccggtacgggaacggtaccgtactaccgaccgtacttacccgaaccgtaacggaccgaaacgtaaccgaacccaaaacggaaccgtacgtgttacgtactacgaagtacgaaactcgaacgtagtagtacggaaagacccgggtaccggaacggttacccgacgggttnttacgggttaattacgtttaagngggtaaccaggaaaggtaagcgtaacggaactcggaagtccgggttaccggaaccggtaccgaccggtaccccggttaacggggg

SEQ ID NO: 120181 - DNA, 732 bp, Homo sapiens
  misc_feature: GYAE6OF01CS8FI.2.38.D05.1.454.CMB.1.raw
  modified_base (210)..(210): a, c, t, g, unknown or other
  misc_feature (210)..(210): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggccctcctatgagctgacacagcccaccctcggtgtcagtcgtccccaggacagacggccaggncacctgctcgtggagatgcagttgaccaaagacaatagtgtactttagttcggtaccagccgaagaacggccgaacggccgacggcccccgtgtcgcgtggtagattaataagtaaaacgacgaggttaggaagaccgggtacccctacggaaggggtacctcccgtaggacggtacgtacgtttctaccggttcggtaccctccgacgtccgtacggaacggtaaccaacgtacgtaccgtacgtttacgacccgtacttaccggaaggtacgggaccgtaccgacggaacgaagaaggtacgtagggacggtctacgtaacttatttaaccgtgtaaccacgttacgacgtacgaacggactacggagttaacgggtttaccgggtttttacggttttgggggtccggttacgggggtaccggggtaaccgggtaacgtaaccgggtacgttacccgggtaacccggttccggttaaccgggtaccgaaccgggtaaccccgtaccggttaccccccggg

SEQ ID NO: 120182 - DNA, 758 bp, Homo sapiens
  misc_feature: GYAE6OF01EUMCW.2.38.D05.1.454.CMB.1.raw
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
  modified_base (485)..(485): a, c, t, g, unknown or other
  misc_feature (485)..(485): n is a, c, g, or t
tcagacgctcgacacacgaccggtgctcgatttagtatctgatagttgggtttgggggaagaggaagactgacggtcctgccacaggtggtgctgggcacggtggcactcgacacaacatttgcgctcaactgtcttgtccagtgtgaggtgcagctggtggagtccgggggagcttagttcagccgtgggggtccctgagactctcctgtgcagcctctggtattccaccttcagtgctactggatgctacgtgggcccacaagctccgagggagggtctggtgtggtctacgagtattaatagtntaggnggtagtacgtaccaaagcgtaccgtacgggaccgtacccgttcggaaagggacccggtacggttacctaacccgaacgttaacgttccccaaacggtaacggtaacccgaaaccgtaaaccccgaaacggtaaaaccgaaccggaccgttacgtacgttaacctaccggttanaaaaccgtaagttaaacccgaaacgttccggtttacgacgggaaaagtttcccggggaaacccgggaactacccgggtaccgggtttactaaagggttttaaccctttaaccggtttaggtcgtaaaccggtacgaaaggtagtacgtacgagttacgcgtaacggtccggttaaacggacccgctttaaacgggccggggaacccgaaccgggtaacccgtaccgggttcgaaccccggtttccgaccctccggaacgtccccgttaccccg

SEQ ID NO: 120183 - DNA, 972 bp, Homo sapiens
  misc_feature: GYAE6OF01C93Q1.2.38.D05.1.454.CMB.1.raw
  modified_base (143)..(143): a, c, t, g, unknown or other
  misc_feature (143)..(143): n is a, c, g, or t
tcagacgctcgacacacgaccggtgctcgatttagtatctgatagttgggtttgggggagccccagccctgggattcccagcttgtttctgcttgctgatcaggactgcacacagacgaactcacagtgggtagttgggctgngtcgttcgggttttccttgttgtacttaagtttaaaggtcgtacgaggtggtggaggtgacgaggtcggtggggtggggacggggtaccggggggtacggttcgttacggttcggaccgggtccgggttccggggggtccctaggaacgtccgttccgtccgtggtcgccgtacgtcccgttacgttacggtaccttaccgtacccgttacgtacggtacgtccgttaacggtggtatccgtccgtaccggtccgggtacccgaaccggtaaccggtccggtaaccggggaacgggggtaacggggtcggttggggtacgggtttccggtaccgttaacggttaaacggttaagtttaacgggtaaggtgggtaagggttacggggaaacggtaacgaaccgaacggtaaccggtaccgggtaaccgggtaccggtacccggttaaccggggtacgggtaaaccgggtcccgttaacgttacccgtaacccggtacttaccccgtaacggaaacggaaaccggaaaccccggaaacccggtaaaccgaaaacggtaacccgttacccggttagttaaccggttacgtaaccggtaaccgtaaaactaaaggttacccggaaacgttacgggttaacgtaaccggaacggggtaaaccgggtacccgggaaaccgggtaccggtaaccggttacggtttacgggtactttaaaccggttcgggttaaagggaccgttaaaaggaaaggtacgttacgggaccgtacggtaacaccgggtacggacccgggtaacgggtacccggaaccgggttaacgggtaccccggggg

SEQ ID NO: 120184 - DNA, 809 bp, Homo sapiens
  misc_feature: GYAE6OF01BJPTI.2.38.D05.1.454.CMB.1.raw
  modified_base (585)..(585): a, c, t, g, unknown or other
  misc_feature (585)..(585): n is a, c, g, or t
  modified_base (672)..(672): a, c, t, g, unknown or other
  misc_feature (672)..(672): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagtcttgggttttccttgttgcttaattttaaaaggtgtccagtgtgaggtgcagcgtgggtgggaggtccgggggaggtcttaggttcaggtccgtgggggtccctgacgactctcctgtgcacgcctcgtggtacttaccgtaccttcgaggtacgccttacgtggtactcggacgtaccggttcggggtaccccgaccgtaaacggccggttaacccgggaaggggggtaaccgggggttccggttggggttcgggttcggggttacccttacggtaaaccggtttaagtttaaacgtagggttaggtaaggtagggggtaagtacgacaacgtaacgtccgtaaccgggaccggtaccgtccgggtaggaaccgggtccgtacttaccgaacctaacgttccctaccgaagaaccgtaaccgaaccgaaccgaaacgaaccncggtacttgtactacgtagaaacgtaactacggaacctaggtcctaagggaacggtaccggaacccgggtaggaaccgttacgggtnttagggtttaacgtacgttttaacgggcggtaaagaaccggtaaagggtaagtaaccgttacggaacgaaccggtaccggtaacggttccggttaaaccggggcccccggtaaccggtaaccggtttacccgggggg

SEQ ID NO: 120185 - DNA, 827 bp, Homo sapiens
  misc_feature: GYAE6OF01B2UZA.2.38.D05.1.454.CMB.1.raw
  modified_base (267)..(267): a, c, t, g, unknown or other
  misc_feature (267)..(267): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagcttagttcagccgtgggggtccctgagactctcctgtgcagcctcgtggtattccaccttcagtagctactggatgccgacgtcgggtcccnccaaagcctaccggaggggaaggggtctgggtggttcggggttctaccgtacgttaagtttaacgtaggtacggtagtaggggagttacgacaacgtaagccgttaacggccggtaccgtcccggtaggaacgggggtacctacgtttaccaacccgtacttccgtacccgaaaggaaccgtaaaccggaaaacccgacccgaaaacgaaacccgtaccgttacccgttagttaaccgtaccgtaaggtaaccgtaaaacgtacggtaaaaccgtacggttacgtaacgggaaccggaacggtaccccgggaaagggtaacccgtacgggttaccgttaggtttaacggtttaactttaaccggtggtaaccggtaaccgtaaagggtaaccgtaagttaacggaccgtagggaccctaagggtccggttacgggtaacccggtacccgtaaccggtttagggggtccccgggaacccgggtaaaccggggttaacccccgttcgggttaaccccgtaccccgtttaccgtaccccgtaccgttccccggtaaacccccg

SEQ ID NO: 120186 - DNA, 767 bp, Homo sapiens
  misc_feature: GYAE6OF01E4OT1.2.38.D05.1.454.CMB.1.raw
  modified_base (129)..(129): a, c, t, g, unknown or other
  misc_feature (129)..(129): n is a, c, g, or t
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
  modified_base (608)..(608): a, c, t, g, unknown or other
  misc_feature (608)..(608): n is a, c, g, or t
tcagacgctcgacacacgaccggtgctcgatttagtatctgataggttgggtttgggggaagaggaagactgacggtcctgccacaggtggtgctgggcacggtggcactcgacacaacatttgcgctnaactgtcttgtcagtgtgaggtgcagctggtggaggtccgggggagtcttagttcacgccgtgggggtcctgagacctctcctgtncancctntggattcnccttnagtnctntggatnctacgtcggtaccgaccaacgtccgtacggaggggaggggtcgtgggttcggtcgggttcctaccgtaacggtttattaaagttgtaggtaggtgggtaacgtacggactaaccgaacggtccgttaaccgggtaccgggtaccgtccgggtaacgggtaaacggggtcccgtaaccgtttaacccgacccgtaacgttccgttaacccgaaggtaacgaaacccgaaaccgacccgtaaaaacggaccgtaaccgtacgttacgttaccttccgtaaaggacctaaaagtcgtaaacgtacggtgtaggaacggtacggaccgggtagaccggtacgcgttagttacgttattaccggngtaacggtacgaaatacggaagaccgacgtagacccggtaagaccggggttaccggacccgtacccggtaacgttaccggggacccggggtaacccgtaccggggaacccccgtttcggtacccttaccgttaccccctctaccggccccgttaccccg

SEQ ID NO: 120187 - DNA, 851 bp, Homo sapiens
  misc_feature: GYAE6OF01AXO36.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggaggtcttagttcagccgtgggggtcctgagactctccgtgtgcagcctcgtggattccgaccttcagtagctacgtgatcgactacgtcgggtcccaccgtaagccgtaccggaagggggtaagggtccgtggttaggtcgggttctacggtaacgttaatttaagtaggtaggtaagtagggagtacgacaacgtaacggccttaaccgggacggtaccgttccgggtaagggtaaccgggtcccgtaactttacccaacccgtagtacccgtaaccgaacggaacgaaaccctaaaccgggaaccctaaaacggaaacccgtaccggtactttaacggtaactccgtaacggtaaaccgaaaagttaccgaaacttagggtttacccaaagggaaggtaaccccgggtaccgggaacggtaacccggtaacccgggtttgtaccgtttaacgggtttaaccgttacgttacgggtaaggtaacccgaaaggggtaaaccttaacgtaaccgggaccgaacgttccggtaaccggtaccgggttacccgggaacccgggttaacccggttaccgggtaacgggtacccggggaaccccggaaccgggtttaacccccggtcggtaaccccgtaacccggtttacccacccggttcccgaaccggtaacccccccg

SEQ ID NO: 120188 - DNA, 638 bp, Homo sapiens
  misc_feature: GYAE6OF01BOYXK.2.38.D05.1.454.CMB.1.raw
  modified_base (152)..(152): a, c, t, g, unknown or other
  misc_feature (152)..(152): n is a, c, g, or t
  modified_base (157)..(157): a, c, t, g, unknown or other
  misc_feature (157)..(157): n is a, c, g, or t
  modified_base (169)..(169): a, c, t, g, unknown or other
  misc_feature (169)..(169): n is a, c, g, or t
  modified_base (197)..(197): a, c, t, g, unknown or other
  misc_feature (197)..(197): n is a, c, g, or t
  modified_base (310)..(310): a, c, t, g, unknown or other
  misc_feature (310)..(310): n is a, c, g, or t
  modified_base (354)..(354): a, c, t, g, unknown or other
  misc_feature (354)..(354): n is a, c, g, or t
tcagacgctcgacacacgaccggtgctcgatttagtatctgatagcgtgggttttccttgttgctattttaaaaggtgtccagtgtgaggtgcagctggtggagtccgggggaggcttagttcagccgtgggggtcctgagctctctgtgcngcctntgattcaccttnagtgctagtggatgctacgtgggtaccncgaagctacggaggggagggtctggtgtgggtctacgtagttaattaagtgtagtagtagggatagacaagacgtctacggcgtaccgtcggaggaacggcgtattacgaccntccacgagacaccgaacgacaaagaccgtgtctagtactcgtanaactaatacgaacgtcgtgaggacggacgcgtaaggacgtcggtattgagttactacgtggaacgacgaaggagtaactcgacgagccgtaggtacgtacggacgaaccgtacggtacgggtaccgggaaccgtacggtacccgtggacctaccgtcctccgtacaccgtcccgacgaaccgtacggcccttacggtcccttcccgtccgaccgtccgtaccgttcgccgtaggaccggactaccccgacgtacaacgtccaaccggcgtccgccgggtcccgg

SEQ ID NO: 120189 - DNA, 706 bp, Homo sapiens
  misc_feature: GYAE6OF01B4Q9S.2.38.D05.1.454.CMB.1.raw
  modified_base (269)..(269): a, c, t, g, unknown or other
  misc_feature (269)..(269): n is a, c, g, or t
  modified_base (312)..(312): a, c, t, g, unknown or other
  misc_feature (312)..(312): n is a, c, g, or t
  modified_base (688)..(688): a, c, t, g, unknown or other
  misc_feature (688)..(688): n is a, c, g, or t
tcagacgctcgacacacgaccggtgctcgatttagtatctgatagttgggtttggggagccccagccctgggattcccagctgttctgcttgctgatcaggactgacacacagagaactcacatggagttggctgagtctgggtttcctgttgtcttaagtttaaaggtgtcagtgtggaggtcgcagcgtggtggacggttccggggagtcgttaggttccgacggtccggtcgggggtacccgtgaacggtccttcgtccaggtacnccgacgtcctcgtggtaccttccgcttacaggtactcgtacgnggtaactcgacgtccggttccggtaccaccgtaacggtccgttaccgggaaggggtacgtccgtgggttacgtcggacttacgtaaccggttatttaaggagtggaaccgttcgggggaatagacccgaaagtaacggtaccgacggccggtaacgtcggtaacggaacgcgtaactccaacgtcgtcgtaccgaagaacaaccgtaccgaaccgtaaacgaccgtaacaggtacctacgttacgtaaccgaaattaaacgtcgaagtaccgttaggaacggacgggacgtaacgggacgtaacgacgtctaggttactacgttcgtagtacgaagacgtaggactacggacaagtggacctacggacgggtaccnccggacggttaacccggg

SEQ ID NO: 120190 - DNA, 831 bp, Homo sapiens
  misc_feature: GYAE6OF01C2WBV.2.38.D05.1.454.CMB.1.raw
tcagacgctcgacacacgaccggtgctcgatttagtatctgatagctgggttttccttgttgctattttaaaaggtgtccagtgtgaggtgcagctggtggaggtccgggggaggcttagttcagccgtgggggtccctgagactctcctgtgcagcctcgtggtattcaccttcagtagctacgtggatcgcacgtcggggtccaccaagccgtaccggaagggggaacggggtcttgggtggttcggggtctaccgtaaggttaatttaagtaggttggaagttaggggaagtacggacaacgaacggtccgtaacgggccggtaaccttccggggtaagggaaacggggtccctaatttacccaaccctacgtttccaccgaaagggaaccgaaccgaaaacccggaccctaaaaggaaaccctcggtactttacggttaactccgtaaggaaactaaaaagtcggaaaacctaggttccgaaggaacggaacggacccgggtaacggaaccgtacggtctttaggttagtttaaacttcgtggtaacaacgtaaagagaacgtacgacgacggacgacggtacgttacggaccggaaccgtaaccggtaaccgggtcggggaaccggtaaccgggtacccgtacggtacccgtacccgttacctacccgttaaccgcccgttacccgaaccccgtaacccggaacccgggtccccttaacggttcccggttacccggttcccccgtcggccccgtacccgtccgcccgtacgaacggtaccgccccaccgtaccggacgaacgaccgacggtcccggccggtcccgg

SEQ ID NO: 120191 - DNA, 779 bp, Homo sapiens
  misc_feature: GYAE6OF01ANSCD.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagcccaccctcggtgtcagtcgtccccaggacacggaccggccaggatccacctgctcgtggatatcgctattcgaccgaaagcaaatatcgtactttagtcggtaccagacgaagaacgccgacggccgaccgggtcccccgttgtcggtccgttggggtacgtaatttaaacgttaaagtaaaacggtaaccgtaaggttacgggaaacgggtaacccgggtacccccgttacgggaacgggggttaaccctcccggtacgggtaacggtaccgttaccgttttacccgttaccggttcgggtaccccttaccggtaaccggtccggtaaccgggaaacgggtaaaccctaaacggtacggtaccgtaccggttaacggaacctagtacggtacgggtacggacgtaccgaaggactaaagggaagtacggtaggacggtactacgtaacttacttacgttacgtactaacgtacgacgtaccgaacgaacgtcggtacgttaacgggtttccggttttagggttttcgggtcggggttaccgggtacggggtacgacgtacggtccgtacggtacccgtacgtacggacgtaccgcccggtacggtccccgg

SEQ ID NO: 120192 - DNA, 760 bp, Homo sapiens
  misc_feature: GYAE6OF01B6DVO.2.38.D05.1.454.CMB.1.raw
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
  modified_base (480)..(480): a, c, t, g, unknown or other
  misc_feature (480)..(480): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtgggaggtccgggggaggtcttagttcagccgtgggggtccctgagctctctgtgcagcctcgtgtacttcctaccttacgagttacgctacgtagggactcggacctaccggtcggggtacccgacccgaaacggtcccgtaccgggaaggggggtaacggggtccggttggggttgggttcgggttaccgtaccgtaacgtttaaagtttaagttaggtaggtaggtagggagtaacgacaacgacgtcgtaccggcggtactcggaggacggctatcacnctcacganacgacgaacacgaagacacgtctatacnctacgaacaagtacgaacgtagtacgtacgaacggacgtaccgggaaggtaacccgggaacgttccgttaaggttacggttttaacgtaccggttggtaaacggtaaccgaaaggtacgtaacgtaacgacgaacggtacgtaacccggtcggtttaaccgggaacccggtaccggtaaccggtaccgggggtacccgggtaaacccggtaaccccgggttacccgggttccgtaccccgtacccgttacccctaccgttaccccgacccggtacccccg

SEQ ID NO: 120193 - DNA, 649 bp, Homo sapiens
  misc_feature: GYAE6OF01C370Y.2.38.D05.1.454.CMB.1.raw
  modified_base (238)..(238): a, c, t, g, unknown or other
  misc_feature (238)..(238): n is a, c, g, or t
  modified_base (275)..(275): a, c, t, g, unknown or other
  misc_feature (275)..(275): n is a, c, g, or t
  modified_base (288)..(288): a, c, t, g, unknown or other
  misc_feature (288)..(288): n is a, c, g, or t
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
  modified_base (536)..(536): a, c, t, g, unknown or other
  misc_feature (536)..(536): n is a, c, g, or t
  modified_base (634)..(634): a, c, t, g, unknown or other
  misc_feature (634)..(634): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggagtcttagtcagccgtggggggtccctgagctctcctggtgcagcctcgtggtacttcacttnagtagctacgtggatgcacgttcgggccacaaggtcncgaaggggacggngtcggtgtagggtctcgacgttaattagtagtggtaagtgggtaagtagactaacgaagtaccgtacggaccggtacctacgggtaacgggaacggaccgttacttaccgaactgttaccacgaacgaacggaaccaacgaccaaagtaacccaaggtcttataacgtcgaagaactaagtacgaatgtagagagtacgacgggaacgacgcgtactagtagttctacgttnaggcgaaanggtaaanacgaacgacgtcgtaacggtcgtacgaaccgaccggtaacgtacgggaccgggacccgtaaccgggttacccgtaccgtcccgaacccgttccgaccnccggaaccgtccccg

SEQ ID NO: 120194 - DNA, 782 bp, Homo sapiens
  misc_feature: GYAE6OF01DTTRI.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccgaggacaggacggccaggactccacctgcctcgtggagatgctagttcgaccgaaaagctaaattatcgtactttacgttacggtaccgaagacaaggaacgccgaacgggcccaacggcccccgtggtcggtccgttaggtacgtaattaacgtaaagttaaaacggacgtaaggtaggaaacgggtacggacccccgttacggaaacggggtacctttacccccgaaggacgtaccggttaacgttttcccgtccggtcggtcccgtttaccgacggtacccgtacgggtaaacgggaaccctaaacgtccggttaaccgttacggtttaccgaacctacgttacggtaacggtacgggtacgtacggaaccgggaagtacggaagtaacgtaggaacggtctaacggtacttaacgtttacgtacgtaaactacgacgtaacgcgtaagacgtagtaccgttagggtttcgtttacggttttcggggtacgggttaccgggacgggtaacgggtactaaccggacggtttacccggaaccggttacggtaacggtacccgaaccggtccggtaacgtaccccccggg

SEQ ID NO: 120195 - DNA, 683 bp, Homo sapiens
  misc_feature: GYAE6OF01D5B8Q.2.38.D05.1.454.CMB.1.raw
  modified_base (206)..(206): a, c, t, g, unknown or other
  misc_feature (206)..(206): n is a, c, g, or t
  modified_base (355)..(355): a, c, t, g, unknown or other
  misc_feature (355)..(355): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgagcctcctatgagctgacacacgccaccctcggtgtcagtcgtcccaggacagacgccaggntccactgctcgtggagatgctattcgaccaaagcaaattatcgtctttaagttcggtaaccagacagaacgccaggccgacggtcccctgtcggactggtagtaatataacgtaaagacgagtagagacggcctagacgggtactccgngacgtcgtacttcgtcgtacggctccgagcgtacgaacgggaacaacgtacgtactacggttacaccgtactcgtaggtggacgtccgaaggctaacggaagtacgtacggtacggacttacgtaacgtttaactacgttaccgtaagtaacgttcgaacgcgtaaacgacgtaacgtacggttaaggttttcgggtttaaaccgggttttttggggtaccgggtttaacgggggacggggttaaacggtaacccgggtacgtaccggttaccggtaacccggttacgttaacgggtacccgaacggtccccgtaacgggtcccccgg

SEQ ID NO: 120196 - DNA, 639 bp, Homo sapiens
  misc_feature: GYAE6OF01B8NIW.2.38.D05.1.454.CMB.1.raw
  modified_base (271)..(271): a, c, t, g, unknown or other
  misc_feature (271)..(271): n is a, c, g, or t
  modified_base (583)..(583): a, c, t, g, unknown or other
  misc_feature (583)..(583): n is a, c, g, or t
tcagacgctcgacacacgaccggtgctcgatttagtatctgatagttggggtttggggggagccccagccctgggattcccagctgtttctgcttgctgatcaggactgcacacagagaactcaccatgaagtttgggctgagtcttgggttttccttgttgtcttaattttaaaaggtgtccagtgtgaggtgcagcgtggtgggaggtccgggggaggtcttagttcaggccggtggggggtccctgagactctccgtgtcgcagcctntggtacttcctaccttacagtacgtctacgtggtatcgactacgtcgggtccgaccgaagccgtaccggaggggacgggtgtgggtggtcgggtctcgtaacgttagttaagtaggtagtaggtaggggtatagacaacgaagtcgtacggacggaccgtccggtagggaacggtccgactacgacctactaccgtacacggaacaacgaacgaccaaagacctacgtctagtactacgagtaacaaatacgaactagtacgagaacgacggaccgtacgggagtacgtcgtagtacgttacttagtacggnaaaggtagagaacgtaggacagctacgtcgggacggtacccgcgtcgggtaacggg

SEQ ID NO: 120197 - DNA, 775 bp, Homo sapiens
  misc_feature: GYAE6OF01CP3MG.2.38.D05.1.454.CMB.1.raw
  modified_base (239)..(239): a, c, t, g, unknown or other
  misc_feature (239)..(239): n is a, c, g, or t
  modified_base (644)..(644): a, c, t, g, unknown or other
  misc_feature (644)..(644): n is a, c, g, or t
  modified_base (756)..(756): a, c, t, g, unknown or other
  misc_feature (756)..(756): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgacggcctcctatgagctagacacacgccctacccgtcggtgtcacgtcgtaccccgaggaccaggaccggccgaggactcacctgcttcgaggagntcgactattcgaaccgaaagactaagttagtcgttacgtttacgtttacggaccgagacgaacgtaaccggaccgacggacccgaccggtccccttggtcggtcgttaggtagtaataaagttaaacgtaaacggacgaggtacggaacgggtaccgtacccgtacgggtaacgggttaccctccgaagggtacgttaccgttaacgtttccgaccggttcggtacccgttccgacggtacggtaaccgggaaacgggtaaaaccacggttaacgtacccgtttaacgggttaacgaccgttacgttaacgggtacgggtacggtaaccgtaccggaggtaaaccgaaggtacgggttagacgggactaccgtttagaacgttttactacgttacgattaacccnggaacgtacgaacgacgagttagggttcggtttacggttttggttttccggggtggaacccggggtcgggaacctaggccgttaccggtaccgacggttaccggtagacccncggacccgtgttaccccgg

SEQ ID NO: 120198 - DNA, 779 bp, Homo sapiens
  misc_feature: GYAE6OF01BOE6U.2.38.D05.1.454.CMB.1.raw
  modified_base (124)..(124): a, c, t, g, unknown or other
  misc_feature (124)..(124): n is a, c, g, or t
  modified_base (239)..(239): a, c, t, g, unknown or other
  misc_feature (239)..(239): n is a, c, g, or t
  modified_base (617)..(617): a, c, t, g, unknown or other
  misc_feature (617)..(617): n is a, c, g, or t
  modified_base (735)..(735): a, c, t, g, unknown or other
  misc_feature (735)..(735): n is a, c, g, or t
  modified_base (766)..(766): a, c, t, g, unknown or other
  misc_feature (766)..(766): n is a, c, g, or t
tcagacgctcgacacacgaccggtgctcgatttagtatctgatagttgggtttgggggaagaggaagactgacggtcctgccacgaggtggtgcgtgggcacgggtggcacgtcgacacaactntttgcgctcaacttgtcttgtccgagtgtgaggtgcgagtcgtgggtggacgggtccggggagtcttagttcgacggtccggtcggggtccctgacgtccttctccgtggtgacncgtccgttacgtggttcttacccgtactttcgaaggttacggtccttaagtggtacgtcgcgtacggttccggaccgacgtaacgccggtacggaagggggtcggtcgttggtcgggttcggtctacgtagttaaagtacgtggtaggacggttaggctaacgaccgaagtacggaccgttacggaccggttaacctccgggtaacggtaccggtacttaacctccgaaaccttctacccgaacggaacgaacaacccgaacgtaaccgaacgaaccgtcttacggttataccgcgtaacgtaaaccgaggttaaccgacgttaacggacgaacgggaccgtaacgacccggggaaagtccgtacgtgttaacggttnttacgtagtcggaattaagacggtactaggtaaccgacggtagaccgtagggccttaacgggtaacccgacccggttacgggtagggtaaccccggcccggtaaaccgggttaccccngggttacccctacggttcccaacccgttccncccggtaaccccg

SEQ ID NO: 120199 - DNA, 1134 bp, Homo sapiens
  misc_feature: GYAE6OF01BXEJI.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaacctcacagtggtagtttgggctggagtcgttcgggttttccttgttgtacttaagttttaaaaggtcgtccgtagttgtaggaggtgcgagtcggtgggtgggacgggtcccgggggtagttcgttacggttcgacggtcccgggttcgggggttccctaggtacgtaccttccgtccgttcggtcgaccgtaccgtccgttcggttacggtacctttaccgttaccgtttacgtaacggttacgtaccgttaaccggttaggtacgtaccggtacccggtaaccgggttcccggggtaaccccgtaacccgtaaaccgggtcccggtaaccgggggtaaacgggggggttaaccgggggttccggggtttacgggggtttccggggtttaccggggttaaccgttaccggttaaaaaccggttttaaaggttttaaaacggttacgggttaagggtaacgggtttaacgggggtaaacggttaaccggaaaccgtaaaccgggtaaaccgggttaacccggtaacccggggtaacccgggttaacccgggttacccggggtaaacgggggtaaacccgggggttaaccctttaacccgtttaaccccgtaacccggttaaccgttaacccccgttaaaccgggaaacggtaaaccccgtaaaacccggtaaaacccccggaaacggtaaaaacccgttaaaccccgggttgttaacccgttttagtaaccccgttacgggtaaacgtaaaacccggttaagtttaaacccggtaacggtttaacggtaaccggtaacgggtaaaccgggttaacccggaacccggggtaacgggtaccgtttacccggggttaacgttttaacgggttaaccgtttaaacggtttacgtaaccgggttaaacgaaaacgggtaaaggtacgggtaaacttcggggaactaccgggtacggttaaccgttaaccggggttacccgggaacccggttacccggggttaaaccgggtaccccgggggg

SEQ ID NO: 120200 - DNA, 669 bp, Homo sapiens
  misc_feature: GYAE6OF01BICCV.2.38.D05.1.454.CMB.1.raw
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (558)..(558): a, c, t, g, unknown or other
  misc_feature (558)..(558): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaggggctgggtgtgggtctcacgttattaatagtgagtggggagtagcacaagctacgcggactccgtgaagggccattcacatctccagagacaacgccaagaacacgctgtatcgtgacaaatgaacagtctagagacgccggaggacacggntgtntattcgtgtgacaagagatagacagcaggtcctagggtaccgcccggtaacttaccggtcgggggaccctaacggggtaaccccgttcgggtaccctacccggttcctcccgtacgaccggtcccctacccggaacccggaaccgggtcccctaaccggttccccgggttcccctttaccccccggngggtaccccgtcccccgttacggtcccgttacccggaacgggtcccgacccgtaaccccggttaccggaaacgaccggaccctaccggaaccgggcccgggtacccccggg

SEQ ID NO: 120201 - DNA, 646 bp, Homo sapiens
  misc_feature: GYAE6OF01AXYDS.2.38.D05.1.454.CMB.1.raw
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (382)..(382): a, c, t, g, unknown or other
  misc_feature (382)..(382): n is a, c, g, or t
tcagacgctcgacacacgaccggtgctcgatttagtatctgatagctgggttttccttgttgctattttaaaaggtgtccagtgtgaggtgcagctggtggagtccggggagcttagttcagcctgggggtccctgagactctcctgtgcagcctctggattcaccttcagtagctactggatgcacgtgggtccgccaagctccgagggaagggctggtgtgggtctcacgtattaanagtgatgggagtagcanagctacgngactcgngaacggccatcacatctcagagacaacgccaaagacacgctagtactctagactaaatcgaactagtcagagacgcgaaggacacggctgtgtattacgtgtagacaaagngatagacagtacagcgtaggtacgaccgtactacggtacggggaccaacgggtaacccgtcggtaccgtaccgtaccgtccgtaccgtaccgccctacccgaaccgaacccgggtacctaccggttaccccgggttcccttccccccgggtacggtccccggtacccccgtcgggtacccgtacccggaacgggtacccgacccgtaccccggtacccggaacgaaccggtacctacccggaaccggtcccggtacccccgggg

SEQ ID NO: 120202 - DNA, 722 bp, Homo sapiens
  misc_feature: GYAE6OF01CMWJQ.2.38.D05.1.454.CMB.1.raw
  modified_base (238)..(238): a, c, t, g, unknown or other
  misc_feature (238)..(238): n is a, c, g, or t
  modified_base (284)..(284): a, c, t, g, unknown or other
  misc_feature (284)..(284): n is a, c, g, or t
  modified_base (613)..(613): a, c, t, g, unknown or other
  misc_feature (613)..(613): n is a, c, g, or t
  modified_base (703)..(703): a, c, t, g, unknown or other
  misc_feature (703)..(703): n is a, c, g, or t
tcagacgctcgacacacgaccggtgctcgatttagtatctgatagttgggtttggggggaagaggaagactgacggtcctcgccgactaggtggtgctggggcacggtgggcacggtcggactacaacatttaggcgtcgtcaactggtcttgtccaggtcgtggacggtgccaggtctagggtcggtacggttccgggggagtcgtttaagttcaggtccggtggggggtccctggngacctcgtccgtggtgacacgcctcgtgtacttcaccttcaagtcncttacgtggactgtacgacgtcgggtcccgaccgaacgcctccggaagggggtaacgggtcgtgggtggtcgggttctacgtacgttaagttaagtaggtgtaaggtacggtagtaacgcgaacgtaacgtccgtacggaccggaccgttccggtaggaccggcgttaactaccactacgtcgtacgacggaacgtaacccgagacccaaaggaccacgtctagtacttacgtacgaactaagcgaactgttgagacggcgacggttacgacgaggtctggttagtaacttcgtcggagacgtaagagttaacgacgacgtactacggngtccggttacgacccggaccggttacggtaccgggtcgggtaccggtaacccgggtacccgttcgggtcccgtaccccgttgttaccccnccgccccgttaacccccgg

SEQ ID NO: 120203 - DNA, 628 bp, Homo sapiens
  misc_feature: GYAE6OF01C98FI.2.38.D05.1.454.CMB.1.raw
  modified_base (176)..(176): a, c, t, g, unknown or other
  misc_feature (176)..(176): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (416)..(416): a, c, t, g, unknown or other
  misc_feature (416)..(416): n is a, c, g, or t
  modified_base (435)..(435): a, c, t, g, unknown or other
  misc_feature (435)..(435): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
tcagacgctcgacacacgaccggtgctcgatttagtatctgatagctgggttttccttgttgcttattttaaaggtgtccagtgtgaggtgcagctggtggaggtccgggggaggcttagttcagccgtggggggtccctgagactcctctgtgcagcctctggacttccaccttnagtagcctatggatgcacgtgggtcccaccgaagcctacggaaggggagggctgggtgtcgggtctacagttaattaagtgtgagtggganagacanagtacctacggcgactccggtaggacgggcctattccacctatccgtccaagtacgaaccacggaccaaagtacacgtctgtaactcagaactaagacgaatcgtangaggacgacggagtacncgtntgtacgttattacgngtagacaggtacgtagacngaacttcgagtccggtgacccgacgtacgtacgggcgggaaccgaccggtacccnggtacccncttccncgtacncgtaccccacgaaccggtcggaccccttgtcccgttaccccgttcccggagccccgtcaccgtccgaccgacggtccaccctaccgcgacgacttcccgaacgccggccgggtacccg

SEQ ID NO: 120204 - DNA, 869 bp, Homo sapiens
  misc_feature: GYAE6OF01APDQV.2.38.D05.1.454.CMB.1.raw
  modified_base (284)..(284): a, c, t, g, unknown or other
  misc_feature (284)..(284): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcttgggttttccttgttgcttaatttaaaaggtgtccagtgtgaggtgcgagctgggtggaggtccgggggaggtcgttagttacacggtccgtcggggggtcccctgacggacctcctccgtaggtcgacctacgcccgttnttcggtacttacctacccttcgaacggttacgtaccttaacgtggtaactcggtaccgtaccggttccggggtaccccacccggtaaacggtcccgttaccgggtaacgggggaacggggtccgttggggttgggttccggggttacgtacccgttaacggtttaaactttaaaaggtgggttaaggtaggttgggggtaaacgttacgaccgtaaacgaaccggtaccggtaacccggaccgggtaaccgttacccgggtaaggggaacccgggtacccgtaacgtttaccccgaaccgtaccgttccgtaaccgaaggaacccgtaaacaaccccggaactaaaacggaccgaaccgttacgtacgttacgtaccgtaagtaaacgttaaagtacggtaactacgttgggaaacgacgggaacccggtaacgggaaccgggtaaccggtaccgggttagttacggtttagttaacgtttcggttcgtaaggtaacccgtaaagggtataacggtcgacgtaaccgacgttaacccgggtcgtaacccgggtacccgtaacccgggtcggttaacccccggggg

SEQ ID NO: 120205 - DNA, 643 bp, Homo sapiens
  misc_feature: GYAE6OF01A6GLX.2.38.D05.1.454.CMB.1.raw
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattgaccaaagcaatatgctttattggtaccagcaagaacgccgacggccacggccccctgtcgctggtgtatataanaaagacagtgagacgccctagaggactcccgngagcgtattctcgtcggctccgacgtctacgaagggaaccaacgtacgtccgtacgttacgaccaagtcgtaggtaggacgtccgaaggacaaggaaggactagggaggcttagtacctttaagttaactcgtaataactcgaacgtacgaacgacgtacgacgttacgggtttacggttttaacgggtttttgggttcgggttaccggggacggggtaacgggtaacccggtaacggttccggtaaccggtacccggtttacccggtacggttaccgtaccggaaccccgtaacgggttcccccg

SEQ ID NO: 120206 - DNA, 1076 bp, Homo sapiens
  misc_feature: GYAE6OF01C4F0B.2.38.D05.1.454.CMB.1.raw
tcagacgctcgacacacgaccggtgctcgatttagtatctgatagctgggttttccttgttgctattttaaaaggtgtccagtgtgaggtgcagctggtggaggtccgggggaggcttagttcagccgtggggggtccctgagactcctcctgtgcacgcctcgtggtacttcctaccctttcgaagttacgtctacgttgggatggaccacgttcggggtcccgacccgaaacggccctaccgggaaggggggtaaacgggggtccgttgggggttcggttgggggttacccttaccgtaaaccggttttaaagttttaaaagtaaggttaggaacggttagggggtaaaggttaacggaccgtaaaaccgaaacggtaacccggttaaccggggacccgggtaacccgttaccgggtacgggtaaaccgggggaacccgttaactttaccccaaaccctaccgttacccgttaacccgaagggaaaccgaaacccgtaaaacccggaacccaaaaaccggaaacccgaacccgggttccgttaaggttaaccggttccttaaacggtaaaccaaaaggttaaccggaaaaccgttaccggtaacgttaacggggaaccgggtaaaccgggaacccggggtaaacgggaaacccgggtacccgggttaggttacgggtttaacgttttaaccgtttaacggttacggttaacggtaaacggaaacgggtaggtaaacgtacggacgaacggtacggaacgggttacggttaacccgggtaacccgtaccgggtaaacccgggttaccggggtacccggggggtaacccgttaacccgggggtaaccccttaccgggtacccccgttacccggttaccccttacccgtacccgtacccggttaaccccctacccggtaaaccccgggtaccgggtaccccgtccccgtttacccggttccccggttacccccgtccgggtcccccggtacccgtccgtacccggttacggaaccgggtccgaaccccgttacccggcgaacgtaccgtcggaaccccggtcggcccggggtcccgg

SEQ ID NO: 120207 - DNA, 810 bp, Homo sapiens
  misc_feature: GYAE6OF01AG00S.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagcccaccctcggtgtcagttcgtaccccaggacaggaccggccgaaggatccacctggcctacgtggaagatcggtctatttcggacctaaacggcctaaattacgtacgtacctttaagttcggtaaccacggaacgaacgtaaacggcccgaacggcccgaaccggtcccccgtggtccgcgttagggtacgtaacgtattaacgtaaaggtacgaggttaggacggtaaccggtcccgtacggaacgggtacctacccgtaggacgtacggtacgttaccgttcgtacggtccctaccgtacgacgttaccggaacgggtaaacctaacggaccgttaacgtaacccgggttacgaaccctacgttacgggtaacgtacgggtaaccgtaccgggaacggaacgtaacggtaacggaggtaacggaaggtccgtaacgttaacgtttacgtttaacgttacgtaacgtaacgttgtaacgtacggtaaacgaccgtaaggtcggttaagggttttacgggtttcggttttacggggtacgggttccggggaaacgggtacgggaaaccggttcgtacccgggttacgtaacccgggttccggtaacggtacccggaacggtaccccgtaacgggtacccccg

SEQ ID NO: 120208 - DNA, 897 bp, Homo sapiens
  misc_feature: GYAE6OF01BY1UE.2.38.D05.1.454.CMB.1.raw
  modified_base (800)..(800): a, c, t, g, unknown or other
  misc_feature (800)..(800): n is a, c, g, or t
tcagacgctcgacacacgaccggtgctcgatttagtatctgatagttgggtttgggggaagaggaagactgacggtcctgccacaggtgtgctggcacggtggcactcgacacaactatttgcgctacaactgtcttgtccagtgtgaggtgcagtcgtaggtggacggtccggggagtcttagtcacgtccgtggtcgggtccctgacgtccttccgtctgtacgccacgtccttgtaggtactttcctaacccttttgaacggttacgtaccgttaacgtaggtacgttacgaccgtaccggttccgggggtaccccaacgtaaccggtcccgttaaaccggggtaaggggggtaacggggtccggttagggttcgggttaccgggttcctaaccgttaacggttttaagtttaagttacggtaggttaaggttacgggtaaacgtacggaacctaaaccgtaacggtccccgttaacggggtaccggttaacccggttcccgggtaagggaacccgggtaccttaaccgtttcccgaacctaagttccccgtaaaccggaaacggtaacgtaaacccgaaccggtaaacctaacgaaccccgtaggtacctttaggttaccgtacgttaacggaaacttaacgttacgaaacggttcttacggaggacccgtaggaaaccccgggtagtaccgggttacctagtttaacgggttatttaaccggttaggacggtaaccgagaaccgggtagttgaaccccgtagcggtacaaccggttcccggtaaggttaaccccnccggtttaaggtacccggggacccggaaccccgggttaccggttaccccgttacggtaccccttacccgggtcctaaacccggcccgtttaacccgg

SEQ ID NO: 120209 - DNA, 747 bp, Homo sapiens
  misc_feature: GYAE6OF01EWQ9V.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggactcactgctctggagatgcattcgaccaaagcaaatatgcttattcggtaccagcaagacgccgacggaccacggcccctggtcgtccgtggggtataattaagtaaacgtaaaaggacgtaagggtacggaacgggaccggtaccccgtacggaacgggtaccttaccccgtaggaaccgtacgttaacgtttcctcggttcgggtacccttaccgagtacccgttacgggaacgggaaacctaacgtacggtaccgttaacggttacgaacctacgttacgagggtttagggaccgttaccgaagggacgtaaaggaacgtaggtaaggacggtacttacggtaacgtttaacttacgtacgtaactaacgttaccgaggtaccagaacgtacggtacgttaacgggtttaggtttacgggtttttggggtacggtttaccggggaaccgggttaacgggaccttaacgggtaccgttacggtaaccccggtttaccggtacggtacccgaaccgggtccccgtaacgtacccccgg

SEQ ID NO: 120210 - DNA, 794 bp, Homo sapiens
  misc_feature: GYAE6OF01A24ZP.2.38.D05.1.454.CMB.1.raw
  modified_base (352)..(352): a, c, t, g, unknown or other
  misc_feature (352)..(352): n is a, c, g, or t
tcagacgctcgacacacgaccggtgctcgatttagtatctgatagcgtgggttttccttgttgctattttaaaaggtgtccagtgtgaggtgcagctgggtggaggtccgggggaggcttagttcagccgtggggggtccctgagactctcctgtgcagcctctggattcaccttcagtagctactggatgctacgtgggtcccgccaagcctccgaggggaaggggctgggtgtgggtctcgacgttattaagtagtgagtgggagtagcaacgaagcgtacggcggactccggtaggaacgggcctattccacctatcctaccgagaacgaccaacgaccgaaagaaccncgtctagtactctagaactaaagtacgaaacgtagtccgaggaacggaccggtaccgggaaacggaccgtaaccgggtctttacggttaaggtttaacctttacggttcggtaacggtaaccgaaaagggtaacggtaagtaacggaccgacggacgtacggtacgttaccgggtaccccggaccgtaccggtaccgggtcggggaacccggttaaccgggacccgttcggtacccctacccgttcctccgacccgacccgtacccccgaacccggtaaacccggacccgggtcccttacccggggtttaccccggttcccccgttccccgggacccggtccccgtccccgtaccggacccggtaccggaacgggacccggtacccctaaccccggaccggtacggacccgaccgacccggtccgggtccccgggacccggg

SEQ ID NO: 120211 - DNA, 705 bp, Homo sapiens
  misc_feature: GYAE6OF01DSQ9A.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattcgaccaaagcaatatgtcttattggtaccagcaagaagccaggccacggcccctgtgcgtggtagatataataaagacagtagagacggccctcgaggactcctgacgcgtacttcgtcgtcggctccgacgctacgagggaaccaaacgtacgtacctaacggttacgaacctacgtacgaaggtcgggtacgtaccgaagggaccgaaaggaaacgtagtacgggaacgggtacttacggtaacctttaagtttaccggttacgtaaacctaacgttaccgaaacggaccgtaacggaaccgaggtacgttaacgggtttacggtttttaacgggttttttggggggtacggtttccggggggaaccgggtaacggggtaaacccgaacggttaccggttaccgggttaaccccggttacccggttaacggggttacccgaacccgggtaccccggtaaacggggtccccccgg

SEQ ID NO: 120212 - DNA, 849 bp, Homo sapiens
  misc_feature: GYAE6OF01C7JYY.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctcccctcttcactctctgcacaggctctgacggcctcctatgagctgacacacgcccacccgtcggtgtcagtccgtaccccgaggaccacggaccggaccgaggactcctaccgtgtaccgtcggtagggagtagttcggtaccgtacggtaaccgaaacgtaaacaattaagtacggttacgtttacgttacggtaaccgaacgacgaaggaaacggaccgaccggaccgaccggcccgtcggtacggtccgtggtaggaacttaataaagtaaacggtaaccgaggttaggaacggaccgggaccgtacccggtaagggaaccgttcccgtacggaggtaccgttacgttccgttccgtcggtaccgtacccacgtacgtacggaacggaacccgtaaacgacgttacgttaccggtacgtaaccgtacgtaccgaagggttacgggtaacggtaaccggtaaaccggacgtaaaggggaaacgtaaacggtcggttaaacggggtaccgttaccggtaaagttacccgttttaacggtagttaacctaacgtaacgacccggtaacaacggtaaacgtaccggtaggttaacggtttaccggggtttttgtttaaccggggtttggggtacccgggtacgggtacggaacgggtaccgtaacggttcccggtaaacccggtacccgtccggtaaacgacccgggccccgaaggttcccgtaccccccggg

SEQ ID NO: 120213 - DNA, 794 bp, Homo sapiens
  misc_feature: GYAE6OF01BQIWH.2.38.D05.1.454.CMB.1.raw
  modified_base (625)..(625): a, c, t, g, unknown or other
  misc_feature (625)..(625): n is a, c, g, or t
  modified_base (746)..(746): a, c, t, g, unknown or other
  misc_feature (746)..(746): n is a, c, g, or t
tcagacgctcgacacacgaccggtgctcgatttagtatctgatagttgggttgggggagccccagccctgggattcccagctgttctgcttgctgatcaggactgcacacagagaactcaccatgggtagttgggctgagtcgttgggttttccttgttgtacttaaagttttaaaaggtgtaccgaggtggtggtagggtgcgacggtcgtggggtacgggacggggtccggggggaaggtcgtttaacggttcggtacgggtccgggttcggggggtcctagggtacgtccttcgtccgtggtcgactcgtcccgttagtcggtactttacctaccgttttacggaagttacgtacgtaacggtggaacgttcgaccgtccgggttaccgggaccctaccggaacggtccggtaccgggaaggggtaacggggccgttggggtcggttacgggttcctaccgtaagtttacttaaagtgggtagtaggtggggtaacgtagtacgaacgtaacggccgtaaccgggtccggtaccggtacgggtaacggaccgggtaccttacgtaccgtacctcgtaccgtacgaacgaacgaacccgtaaccgaacgaaacgactacggtntacgtattaccgagaacctaaggacgtaagtacgtacggaggaaccggtaccggaccggtaacgacgtacggtcgttacgtacgttaggttacgacgttaagggaacgttagataacggtnacgtacgaccggtcgtacggtacgcccgtaaaccggtgtaacccgggg

SEQ ID NO: 120214 - DNA, 700 bp, Homo sapiens
  misc_feature: GYAE6OF01CO877.2.38.D05.1.454.CMB.1.raw
  modified_base (255)..(255): a, c, t, g, unknown or other
  misc_feature (255)..(255): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtctgtccagtgtgaggtgcagctgggtggaggtccgggggagtcttagtcagccgtggggggtccctgagtacctctccgtgtcgcagtcctgtggtacttcctaccttcagtgctacgnggatcgctacgtcgggtcccacgtaacgccgtaccggaggggagggtctgggtgtcgggtctcgacttaagttaagtagtggaggtgggactagacaacgaacgtcgtacggccggaccgtaccgggtaggaaccggggtcctacgttaccaactacgtcctaaccgaacggaacgaacccgaaaccgaccaaaacggacctacgtcttagtactcgagtaacaatgaaacgtgtacgaaggacggacggtcggaaacggccgtacgtcgttaggtttacttaagttacggtcgtaacggaacgtaaagggacggttaacgtagaccgtagacggtacccggcggtacgggtacccgtaaccgggtcgtaacggggacccggggtacccgaacccgggttaccctcggtaccccgccttaccctacccgcgtcccgtaacccccg

SEQ ID NO: 120215 - DNA, 891 bp, Homo sapiens
  misc_feature: GYAE6OF01CWB4B.2.38.D05.1.454.CMB.1.raw
  modified_base (246)..(246): a, c, t, g, unknown or other
  misc_feature (246)..(246): n is a, c, g, or t
tcagacgctcgacacacgaccggtgctcgatttagtatctgatagttgggtttgggggtgggtccaggaggcagaactctgggtgtctcaccatggcctggatccctctacttcctcccctcttcactctctgcacgaggctctgacggcctcctagtcgagctgacacgacgcccacccgtggtcgtcgagtccgtacccgaggacgaggaccggccaggtactccgaccgtgccgtgtaggganagtgacctagttacggaccaaaggactaagttagtcgttacgtttacgttacggtaccaagaccgaaacggaaccgaccggaacggcccgttaaccggccccgttaggtcggtacggttacggtagaacgtttaaattaaacgtaaacggacgtaggtacggaacggacccggtcccctacgggtacgggaaccttccggaggaccggtacttacgtttccgtcggttaccggtcccgtaccgacggtacccgtacggaaacggaaccgtaacggtaccggttccgtaacgggtttaccaaccgtacgttaaccgggttaggtaccggggttaccgtacccggtaagggaaaccggtaaggggtaaagtacgggtttaacgggaacgttacgttaaaccggttaaccgttttaaacggttttaaccgttacgttaaaacccgtaagttaaccccggaagtaacccggtaacggaaccgtaccgggtttacttaaacggggttttacggggttttttaccgggtttaggggtttaccggggttaccggggtaacggtaacccgggtaaccaacgggttccttaaccgggttaccccgtacgggttaccgaaccgggttacccgacccggttaccggtacccccggg

SEQ ID NO: 120216 - DNA, 697 bp, Homo sapiens
  misc_feature: GYAE6OF01DAMN9.2.38.D05.1.454.CMB.1.raw
  modified_base (141)..(141): a, c, t, g, unknown or other
  misc_feature (141)..(141): n is a, c, g, or t
  modified_base (147)..(147): a, c, t, g, unknown or other
  misc_feature (147)..(147): n is a, c, g, or t
  modified_base (241)..(241): a, c, t, g, unknown or other
  misc_feature (241)..(241): n is a, c, g, or t
  modified_base (481)..(481): a, c, t, g, unknown or other
  misc_feature (481)..(481): n is a, c, g, or t
  modified_base (512)..(512): a, c, t, g, unknown or other
  misc_feature (512)..(512): n is a, c, g, or t
  modified_base (521)..(521): a, c, t, g, unknown or other
  misc_feature (521)..(521): n is a, c, g, or t
tcagacgctcgacacacgaccggtgctcgatttagtatctgatagttggggtttgggggtgggtccagggaggcagaactcgtgggtgtctcaccatggcctggactccctctacttcctcccctcttcactctctgcacnggctcngacgtcctctatgagctgacacacgccctaccgtggtgtcgagtccgtcccgaaggacgacggacggcaggactccaccgtgctcggtggaagntcgactagtacgaaccgaaaagtctaaattgtacggttacttaacgttacggaaccaggacgaacgacggccgaacggccgaccggtccttggtaccgtgtacgggtagtaactaaagtaactaacggagtaacgggtaggaaccggtaccggtccctaacggacggtacctccggtaggaacgtcgtacttcgacgtcgactcgactcggtacgaacggtacacgtcgtactacggtanaccgtagtcgaggtacggacctaggacgtanaaggtaacnggaggtcgtactaggtaactttaaggccttaaggacagtacgtaagacaaggcgtaacgtgttaaggggttcgtttagggtttccgggtaggggttacccgggacgggtaaccgggactacgggtcccgttaaccgacgggtacgtacggaccggaccgaccggccggttacccgg

SEQ ID NO: 120217 - DNA, 699 bp, Homo sapiens
  misc_feature: GYAE6OF01CRHXF.2.38.D05.1.454.CMB.1.raw
  modified_base (313)..(313): a, c, t, g, unknown or other
  misc_feature (313)..(313): n is a, c, g, or t
  modified_base (357)..(357): a, c, t, g, unknown or other
  misc_feature (357)..(357): n is a, c, g, or t
  modified_base (420)..(420): a, c, t, g, unknown or other
  misc_feature (420)..(420): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
  modified_base (669)..(669): a, c, t, g, unknown or other
  misc_feature (669)..(669): n is a, c, g, or t
tcagacgctcgacacacgaccggtgctcgatttagtatctgatagctgggtttcctgtgctatttaaaggtgtccagtgtgaggtgcagctggtggaggtccgggggaggcttagttcagccgtggggggtccctgagactctcctgtgcagtcctcgtggatttccaccttcagtagctacgtggatgcacgtcgggtccgccaagctccgaggggagggctgggtgtcgggtctcaacgttaattatagtgagtgggagtagcaacgaagccgtaacggcggtactccggaggaacgggcctattccaacnttccgaccaggaaccacaacgaccgaagaaccacgtcttagtanccgtagaacaaagtcaaaacgtgttacgaggacgaacggaccggttaacggaccgaccgggtnttaggttcgtaatttaccggnggtanacaagggtntaagtcggacaggacacggtacgtacggtaccgaccgtaacgtacggacggggaccgtaacgggacccgttggaaccccttcgtcccgtcccgtaccgtaccgtccccctaacccgccggtaaacccggcccgtaacgttccccggtccccgttcccggtcggcccgtcccgtacgccgttaccggacggcccgaccgtaccccggacggaacnccgtccgaaaccggccggtccggtacccgg

SEQ ID NO: 120218 - DNA, 831 bp, Homo sapiens
  misc_feature: GYAE6OF01C2N7W.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggtagtttgggctgagtcgttgggttttccttgttgtacttaagtttttaaaaggtgtaccgagttgtgaggtgcgagtcgttgggtgggacgggtaccgggggaggtcgtttagttcgaggtccggtcgggggttcccgtggaacgtccgttccgttccgtggtcgtccgacgtccgtcgttacggtactttaccgtaccctttacgaaggttactaccttaaccgtggtacttagacccgtaacggttccgggtaccccggacctaacggaccgttacccggggaaggggggtaacgggtccggtggggttcggttcgggttccgtacgttaaacgtttaagttaacgttagggttaggtacggtagggtacggtttacggaaccaaaccggtacggtacccgtacggtacccgggtaccgttccgggtaacggggaacggttccccgtattacccgaccttacgtacccgtaccgaacggaaccgaaccgaacccggaaaccaaacgaacccgaacgtcccgttaacgttataccgttacgaacaacggtacgtaaccgtagtcgtaacggacggacggaccggaacggacgtaccgtccgttagttaggttaccgttaggtacgtagaacgtaacgaaggtagtaacgacgagacgtaccggtacgttaaccgggacccgtacccgtacggtacccggggg

SEQ ID NO: 120219 - DNA, 813 bp, Homo sapiens
  misc_feature: GYAE6OF01AFYBQ.2.38.D05.1.454.CMB.1.raw
tcagacgctcgacacacgaccggtgctcgatttagtatctgatagttgggtttgggggagcccagccctgggattcccagctgtttctgcttgctgatcaggactgcacacagagaactcaccatggagttggctgagtcgttgggttttcctgttgtacttaagtttaaacggtgtacctagtcgtgaggtgcagtcgtgggtggacgggtccgggggagtcttagttcgacggtccggtacgggggtccctaggacgtaccgttccgtccgtggtcgtacctacggtcccttcgtacgggttaacctttcccgttacccttacggtacggttacgtccgttaacggttcggtaacgtccggtaccgtaccggttaccgggggttaccccaacggtaccgtccggttaaccgggaacggggtacgggttcggttggggttccggttcgggttcctaacgtaacgttagtttttaaaggacggttaggacggttaggggtaacgttagaaccgttaacgtacggtaacgtacccgggtacgtaccggtacgggtacggtaaccgggtcttaaccttaccgaccgttacgtaccgtaccgaaaggaaccgtaaccgacccgaaacgtaaaccgtaccgacggttaaccgtcgttaacctacgtacggtaaactaaccggtcgtaaacggtatacggtacgacgggtaccggacgtaccggtacgcggtacttacggtacgttacgtgtacgagtacgtaggatacgtcgacgagtcgtacgtacggtacccggcgttaccgacggttacccggg

SEQ ID NO: 120220 - DNA, 729 bp, Homo sapiens
  misc_feature: GYAE6OF01A4VW8.2.38.D05.1.454.CMB.1.raw
  modified_base (524)..(524): a, c, t, g, unknown or other
  misc_feature (524)..(524): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggatcacctgctcgtggagatgcagttgaccaaagacaaatatcgtctttaagttggtaaccagacaagaacgccgaacggccaccggcccctgtcgtcgtgggtcgtaataattaaagtaaaacgacgtaaggtacgaacgggtaccggcccctaggacgggtacctcccgtaggacgtcgtactttccgtcgtcggtacctccgacgtccgtaccggaacggtaacaaccgtacgtaccgtacgttacgacctagtcgtaggtacggacgtacgaggacgaagaagagtggacggtactaggtaacttataacgtntaactaatcgaacgacgtaacgtacacgttacgttacgggtttacggttttaacggggtttttggggtacccgggtttacgggggaacggggttaacccgggtaaccggtaaccggttaccgggtaaaccccggttacccgggtttaacccggtaccggggtttaacccgaaccccgggtaacccggtaaccgggttccccccgg

SEQ ID NO: 120221 - DNA, 622 bp, Homo sapiens
  misc_feature: GYAE6OF01EQJU8.2.38.D05.1.454.CMB.1.raw
  modified_base (259)..(259): a, c, t, g, unknown or other
  misc_feature (259)..(259): n is a, c, g, or t
  modified_base (410)..(410): a, c, t, g, unknown or other
  misc_feature (410)..(410): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcttgggttttccttgttgcttattttaaaggtgtccagtgtgaggtgcagctggtggaggtccgggggaggtcttagttcagtccgtggggggtccctgagactctctgtgcagcctntggattcaccttcagtagctacgtggatgcacgtgggtcccgccaagccgtaccgaggggaacgggcgtgggttggtcgggtctcgacgttattagtagtgagtgggagtagacagagcgtacgcggactcgtaggacggcatcacatccncgagagacaacgcaaagaacacgctcgtatctagctaaatacgaacgtagttacgaggtaaggacggtaccggaaggaaccgtacgggcgtttacggttcgttagtttacgttaggtcgtaaaccgaagggtaacgaagttacgggaccgtaggaccgtacgggacgttaaccggggtaacccggtcccgggaacggtttaaccccgggggg

SEQ ID NO: 120222 - DNA, 737 bp, Homo sapiens
  misc_feature: GYAE6OF01EXEWA.2.38.D05.1.454.CMB.1.raw
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggaggtcttagttcagccgtggggggtccctgagactctcctgtgcagcctctggacttcaccttcagtagctactggatgcacgtgggtccnccaagctccgaggggagggntggtgtgggtctcagttattaatgtgagtgggagtagcaacgaagccgtaacggcggacgtcggtaggacgggtccgaattccacctatcctaccgaagaacgaactaaccgaccaaagaaccacgtcttagtactaccgttagaacctaaagtaccgtaaactacggttacgtacggaaacggaccgggtaacccggaagggaacccgtacggggtaccgtttaggtttacgttaaacgtttacggtggttaacgaacgaaaggggtaagtaacgtacggacccgtaaggcccgtaagggtcccggttttaacggggaacccggtaaccccgggttaacgttaacccgggggtaccgggggaccccggaaaccggggggttaaccccccttaggggtccccctaaccccggttaccccgtttcccaaacccgggtcccgtaacccccccg

SEQ ID NO: 120223 - DNA, 748 bp, Homo sapiens
  misc_feature: GYAE6OF01ASK5T.2.38.D05.1.454.CMB.1.raw
  modified_base (208)..(208): a, c, t, g, unknown or other
  misc_feature (208)..(208): n is a, c, g, or t
  modified_base (704)..(704): a, c, t, g, unknown or other
  misc_feature (704)..(704): n is a, c, g, or t
tcagacgctcgacacacgaccggtgctcgatttagtatctgatagttgggtttgggggagccccagccctgggattcccagctgtttctgcttgctgatcaggactgcacacagagaactcacatggtagtttgggctgagtcgttgggttttccttgttgtacttaagttttaaaggtgtccaggtggtggaggtgcagtcgtgggngggtagggtccgggggaggtcttagtcgacggtccggtcggggggtccctaggacgtacctcctccgtgtcgccacgtcctcgtaggtacttcctaccttcgaggtacgtctacgtggtatcgtacgtccggtccggggtccccaaccgaacggtccggtaaccgggagggggtaacgggtcggtgggttcgggtcggtactacgttaacgtttagttaagtaggtggtaggtgggtaagacgacgaacgacgtccgacggccggtactaccgggtaggaccggtctactaccacctacgtccaccgtaagaaccgtaaccgaaccgtaacccgaaagtacccgtcgtaaccgttgtaacttacgacgtaaactaacgtacggtaaactgttacgtacgggaaccggtaccgggaccggtaacgggtaccgacggttggttacggtaagttacgttcgtaccggttaagaccggtaaggtacaggtacgcaacggntacggtcccgttaaggtccccggacggttaaccggtccccgggg

SEQ ID NO: 120224 - DNA, 854 bp, Homo sapiens
  misc_feature: GYAE6OF01C84WY.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccagtggtagtttggctgagtcgttgggttttccttgttgtacttaagttttaaaggtcgtccgaggtgtggaggtgcgaggtcgtgggtgggacgggtccgggggaggtcgttacggttccgacgggtccgggttcgggggtccgtggacgtaccttccgttccgtggtcgtccgcggtccgtcgttacggtactttacccgttaccgttacgtaggttaccgtccgttacggtaggtacttcggaccgtaccgggtccggggtaccccgaacccggtaacggtaccggttaacccgggggaacgggggtaacggggtcgggtttcggggtgggtttaccggttaccgttaaccggttaaaggtttaacgtttaaaggtagggttaggttaaagggtacggggtaaacggtaccgaacggtaaacgtaacggtacccggtaaacggcccgggtaaccggtaccgggtaaacgggaccggggtacctacgtaacctaccgtccgtacgaccgtaaggaaccgtaaaccgaaccgaaccgaacgaaccgcgtagttactacgtacgttaagaactaagtaacgaacgtacgttagagaacggaccggacggtaacgtaccgaacggtgttacggttacttaagtcggtaggtaacgaacggtaagtaacggagtacgagtacggtaccgtacggtacgtacccgggtacccggtaggtacccgggtaccgggg

SEQ ID NO: 120225 - DNA, 786 bp, Homo sapiens
  misc_feature: GYAE6OF01B5MLY.2.38.D05.1.454.CMB.1.raw
  modified_base (121)..(121): a, c, t, g, unknown or other
  misc_feature (121)..(121): n is a, c, g, or t
  modified_base (480)..(480): a, c, t, g, unknown or other
  misc_feature (480)..(480): n is a, c, g, or t
tcagacgctcgacacacgaccggtgctcgatttagtatctgatagttgggtttgggggagccccagccctgggattcccagcttgtttctgcttgctgatcaggactgcacacagagaacncacatggtagttggctgagtcgttgggtttccttggttagtacgttaaagttttaaaaggtgtaccgtaggtggtaggtaggtcgacgaggtggtagggtaggggagggttaccggggggaggttacgtttaggttcgacggtccgggtcggggggtccctaggaacggtccttctccgtgtgaccgacgtcctgtacgtacttaccgtaccgttcgaaggtacgtacgtaacgtaggtagtcgacgtaccgggttcggtaccggaccgtaacgccgtacgggaacggggacgggtgtcgggtaggtcggtacttaacgtaacgttaataaggtaggagtaggacggagtagacgtaanaacgcggtaacgacggtacgtacggtaacggacggtacgttacgacctaacgtacgtaactacgaacgaacgaaccgaacgaaaccgaaagaaccgtacgtacgtagtaacgttacaacggtaacaaagtaccggtaacgagttaccgagggtaaccggaaccggacgggaaacggacggtaaccggtggttattaacggtacgttaggtacgtaacggaaagtaaacggtaagaccgtaggaacccgagaacggtacggtacccggttaacggtacccgggaacggttaacccggtaaacggggg

SEQ ID NO: 120226 - DNA, 858 bp, Homo sapiens
  misc_feature: GYAE6OF01ERCTU.2.38.D05.1.454.CMB.1.raw
  modified_base (97)..(97): a, c, t, g, unknown or other
  misc_feature (97)..(97): n is a, c, g, or t
  modified_base (157)..(157): a, c, t, g, unknown or other
  misc_feature (157)..(157): n is a, c, g, or t
  modified_base (832)..(832): a, c, t, g, unknown or other
  misc_feature (832)..(832): n is a, c, g, or t
tcagacgctcgacacacgaccggtgctcgattttagtatctgataggttaggggtttggggggaagaggaagactcgacggtctgccacaggtggtncctgggcacggtggcactcgacacaactacttttgcgctcaacttgtcttgtccagttgnggaggtgcagcgtgggtgggacggtaccgggggagtctttagttccaggccggtcggggggtccctgacgtaccttccttccgttggtggtaccaacgtcccttcgtaggtacttccgtaccgtttacgagtacgctacgtggactcgacctacggtcggtcccacgacgtccgtaccggaggggaacggtcgttggttacgttgggtcgttacgtaacggttttaataaggttagttagggacggtagggtactacgacctacgaacggtctacggaccggttaccgtaccggacggaacggtaccgtactaccgaacaccgttaccgtaacccgaacggaaccggtaacccgaacccggaaccgtaaaacggaaacccctacggtaccgtttaagtccgttaacccgttaagaaacccgttaaagtaaccggtaactaccggtagaagggaacctaaccgggtaccggacggtaacccgtacgggtaccgtttagtttaccggtttaacttacccggtgtaaccgtagtaggtaacgtaacggtcgtacgtaccgggtacctaaggttccccgggtttacgggtaccccggaccggtttaaccccgttcggggtcccggggtaaccccgaaacccgggtttaccccgtaccgggttaccacccccggtttacnccccgggtcccctaccggtccccccg

SEQ ID NO: 120227 - DNA, 813 bp, Homo sapiens
  misc_feature: GYAE6OF01B4LLO.2.38.D05.1.454.CMB.1.raw
  modified_base (744)..(744): a, c, t, g, unknown or other
  misc_feature (744)..(744): n is a, c, g, or t
  modified_base (754)..(754): a, c, t, g, unknown or other
  misc_feature (754)..(754): n is a, c, g, or t
  modified_base (763)..(763): a, c, t, g, unknown or other
  misc_feature (763)..(763): n is a, c, g, or t
  modified_base (774)..(774): a, c, t, g, unknown or other
  misc_feature (774)..(774): n is a, c, g, or t
tcagacgctcgacacacgaccggtgctcgatttagtatctgatagttgggtttgggggagccccagccctgggattcccagctgtttctgcttgctgatcaggactgcacacagagaactcacagtggagtttgggctgagcgttgggttttccttgttgcttaagtttttaaaaggtgtccgagtgtgaggtgcgagcgtggtgggacggtccggggggaggtcgtttaggttcgacggtcccggttcggggggtccctggaacgtaccttcctccgtgtcgcgtacggcccgttcgtacggtactttccctaccgtttaccgtaacggttaacggtacctttaacggtagggtaactttccggaccgtaaccggtttccggggtaccccgaccgtaaacggtcccggttaacccgggaaaggggggtaacgggggtccgttggggttacggttgggggttaccttaccgttaaacggtttaaagtttaaagtaagggttaggtaaggtaggggtaagtacggaccgaaacgtaacgtaccggtacggaccggtaccggttaccgggacgggaaacgggtccgtaacttacccgaacctacgtcctaccgaagacgaaaccaaccggactaaaacggacccacgtagttactacgtactaagaaccaaaggttcaaacgttagacggtagaacggaccggtaacggacgtacccgaacgttcgtagttacggttaattacggnggtacgaaanaacggtaanacgtagccganaccgtggtacggtaacggcccaacggtacggtacccggg

SEQ ID NO: 120228 - DNA, 882 bp, Homo sapiens
  misc_feature: GYAE6OF01D1M4D.2.38.D05.1.454.CMB.1.raw
  modified_base (117)..(117): a, c, t, g, unknown or other
  misc_feature (117)..(117): n is a, c, g, or t
tcagacgctcgacacacgaccggtgctcgatttagtatctgatagttgggtttgggggagccccagccctgggattcccagcttgtttctgcttgctgatcaggactgcacacaganactcacatggtagtttgggctgacgtcgttgggtttttccttgttgtactttaagtttttaaaaggtctctaggttgtggaggtgcaggtcgtgggtgggtacgggtaccgggggagtactttagttccgacggtccgggttcggggggttcccaggtacgtccttccgtccgtaggtcgacgacgttccgtcggtaggtaccttaccgttaccgttagtaacggttccgtacgttaaccggttggtaagtaccggtaccgttaaccggttccgggtacccccgtaaccggtaaccggtaccccgggtaacggggtaacggggggtaacggggttccggttggggttacgggtccgggtttacttaccgtaaagttaacgttaacgttaggtggtaaggtacgggtacggaacgtcaaaccggagttaccggtacggaaccggttcggtaccggtaaggggaacgtccggtacttaaccgaaccttacctacgtaacccgaacggaaaccgaaccaaccggaaacgaaccgaaaccgttcgtaccggtaattacggttaccaaccgtaagtaaaccgtacgaaaccgtgtttaacccgaaagggtaccggaaccggaacgggttacgacccgggttaacgttcggttaacgttacggtttaatacgggtttcgaagtaacggtaaacggtattaacggaccgtacggaggttaccaaacggggttccgtaaccggttaaccggaaccgtcgggtaaacccggggg

SEQ ID NO: 120229 - DNA, 737 bp, Homo sapiens
  misc_feature: GYAE6OF01A8GY9.2.38.D05.1.454.CMB.1.raw
  modified_base (479)..(479): a, c, t, g, unknown or other
  misc_feature (479)..(479): n is a, c, g, or t
  modified_base (596)..(596): a, c, t, g, unknown or other
  misc_feature (596)..(596): n is a, c, g, or t
tcagacgctcgacacacgaccggtgctcgatttagtatctgatagttgggtttgggggaagaggaagactgacggtctgccacaggtggtgctgggcacgggtgggcactcgacacaacatttgcgctcaactgtcttgccagtgtgaggtgcagtctgggtgggacggtccggggggagtctttagttcgacgtccggtggggggtccctgacgtactcctccgtgtgcacgtcctcgtggtacttccaccttcgagtacgctacgtggatcgccgtacggtcgggtaccaccgagccgtacggaggggaacggggtcttgggtgtcgggtcctacgtacggttaaattacgtagtaggtacggtggggtatacgctaacaacggtaccgtaccgggaccgtaccgtacggacgggtaaccggactacttccgacctctccgtacgaagacgaccaaccgactaaacgacgtaccgtntacgtactcgtacgaactaaacgtacgtaatagtttaccgaaggaacggaccgaacgggacgaaccgtccggtacttaggtacgttaacgttagtcgaacgacggtaaagacgtaanacggtaacgacgcgtaccgtacggttaccggaccgtaccggtacgggtacccggtacgggggtaaccccgaaccgggttaacccgttcccgggtacccctttaacccgccgtttaacccgcccggtacccggtaacccccg

SEQ ID NO: 120230 - DNA, 697 bp, Homo sapiens
  misc_feature: GYAE6OF01DPEUB.2.38.D05.1.454.CMB.1.raw
  modified_base (514)..(514): a, c, t, g, unknown or other
  misc_feature (514)..(514): n is a, c, g, or t
  modified_base (523)..(523): a, c, t, g, unknown or other
  misc_feature (523)..(523): n is a, c, g, or t
  modified_base (564)..(564): a, c, t, g, unknown or other
  misc_feature (564)..(564): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctctatgagctgacacacgcccaccctcggtgtcagtcgtccccgaaggacacggaacggccaaggactccacctgccgtcgtagggagatgactagttcgaaccaaaagctaattgtacgtactttagtttacggaaccagacaaaggaaccgccgacggcccgacggtcccctaggtcgcgtggtagaataactaaagtaaacggcgtaaggtaggacggtaccggacccgtacggacgggtactcccggtagacgtcgttacttccgtccggtcgttcctaccgacgtaccgtacgaacgggaaacagtaccggtacgtacgtacaacacgtacggaggtacgggtccgtaacggacggtanaaggtaagngacgggtagcgtaacgttaacgttagttatacttaaccganacgagtcaagacgagtcgtaagggtttccggtttagggtttcgggtacggggttaccgggacgggttaacgggtacctacggtcgtaccgtaacccggttcgaccggtacggacccgacggtcccggtcccgg

SEQ ID NO: 120231 - DNA, 732 bp, Homo sapiens
  misc_feature: GYAE6OF01DNHAK.2.38.D05.1.454.CMB.1.raw
  modified_base (577)..(577): a, c, t, g, unknown or other
  misc_feature (577)..(577): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggagcttagttcagccgtgggggtccctgagactctcctgtgcagcctctggattccaccttcagtagctacgtggatcgcacgtcgggtcccaccaacgctaccggaagggggaacggggcgttgggtcggttggggtcctacgtaacgtttaagtttaagtggtggagtggggaagtagacctaacgaacgtccgtaaccgggccggtaaccgtccgggtaaggaaccgggggtccctaattcccgaaccctactcctaacccgaagaaccgaaccgaaaccgacgaaaacgacctacggcttagtaactcgtagaactaatacgaaactagtctaggacggacggccggaaggaccgccggtcttggttaagttacgttaacgtgtacggactaaaggtanaagtacgacgagacgaacggtccgttaccgggaaccgacccggtaacggtaccggggttaccggggggaacccctaaccggggggttaacccccttacggggttaccccctaccccggtttcccgtaccccggtaccgtaccccggtaccccccg

SEQ ID NO: 120232 - DNA, 712 bp, Homo sapiens
  misc_feature: GYAE6OF01BX47Z.2.38.D05.1.454.CMB.1.raw
  modified_base (258)..(258): a, c, t, g, unknown or other
  misc_feature (258)..(258): n is a, c, g, or t
  modified_base (547)..(547): a, c, t, g, unknown or other
  misc_feature (547)..(547): n is a, c, g, or t
tcagacgctcgacacacgaccggtgctcgatttagtatctgatagttgggtttggggggaagaggaagactgacggtcctgccacaggtggtgctgggcacggtggcactcgacacaacatttgcgctcaactgtcttgtccagtgtgagtgcagctggtggagtccggggagcttagtcagccgtgggggtccctgagactctctgtgcagcctctggacttcaccttcagtagctactggatgcacgtgggtcccncaagctaccgagggagggtctggtggtgggtctacgagttataactgtgagtggggatagcaacgagtcacggacggtacgttccggtaggaacggggtcccgtaattccgaacctattacccgtaccgaaggtaaccgaaaccgaaacccggaccaaaacggtaaccgacccggttacgttaacgggttactacctaggaaccctaaaagttacgaaacgtaagtcgtaaggaaccggacggtaccggaacgccggaacggttccttacgttacgttatttaaccggnggttacgtaaccgaaggaaggtaagtacgccgaaggtccgaagtccggttacgggacccgtacccgggtaaactttccgggacgggggttaaccccaccggggttaaaccccggttcggtcccccgttaaccgtccccgttacctaccggtcccgtaaccccccg

SEQ ID NO: 120233 - DNA, 873 bp, Homo sapiens
  misc_feature: GYAE6OF01B0WX2.2.38.D05.1.454.CMB.1.raw
  modified_base (261)..(261): a, c, t, g, unknown or other
  misc_feature (261)..(261): n is a, c, g, or t
tcagacgctcgacacacgaccggtgctcgatttagtatctgatagttggggtttgggggtgggtccaggaggcagaactctgggtgtctccaccatggcctggatccctctacttcctcccctcttcactctctgcacgaggctcgtggacggtccttcctagtggagctacgacacacgccctaccgtcggtcgtcaggtccgtacccgaggaccgacgaccggtaccaaggactaccgtacgtcgtcctcggtaggagntcgatacgtacgaacaaagactattacgttacgttacgtttagtaccgtaacgacgtaacgacgaccggtaccggaccggtaccgtacccggccgttaggtcgtagttagggtaacttaataaacgtaacggtaaacgacgtacggtaacggtacggccggtacccggtaagtaccgggttacccgtacgtacgggacttaccggttttactaccggttccggtccgtacctaccggtacgtacggaaacgaaccgggtaactaacgggttaccgtaccggtttaacgggtaccgtaaaccgtagggttaacgggtacgggtaaccggtaaccggtacggaacgggtaacgaaagggtaacggtagtacgggtaacgttacgtaacgtttacttaaccgttagtacgtaaacgtatacggtacgtaacgacgtaacgttaaggttacgggttttaagggttaccgggtttcggggtttaacgggtaccggggtaaaccgggggtacgggtaacccggttaacggtaaacccggttccgggttaaacccgggttccggttaaccggtacccgggaaccgtaccccgggttaaccggtccccggttaccccggg

SEQ ID NO: 120234 - DNA, 673 bp, Homo sapiens
  misc_feature: GYAE6OF01DO8CK.2.38.D05.1.454.CMB.1.raw
  modified_base (395)..(395): a, c, t, g, unknown or other
  misc_feature (395)..(395): n is a, c, g, or t
  modified_base (465)..(465): a, c, t, g, unknown or other
  misc_feature (465)..(465): n is a, c, g, or t
  modified_base (501)..(501): a, c, t, g, unknown or other
  misc_feature (501)..(501): n is a, c, g, or t
  modified_base (585)..(585): a, c, t, g, unknown or other
  misc_feature (585)..(585): n is a, c, g, or t
  modified_base (630)..(630): a, c, t, g, unknown or other
  misc_feature (630)..(630): n is a, c, g, or t
  modified_base (634)..(634): a, c, t, g, unknown or other
  misc_feature (634)..(634): n is a, c, g, or t
tcagacgctcgacacacgaccggtgctcgatttagtatctgatagttgggtttgggggacgccccagccctgggattcccagctgtttctgcttgctgatcaggactgcacacagagaactcaccatggagtttgggctgagtcttgggttttccttgttgacttaattttaaaaggtgtaccagtgtgaggtgcagcgtggtggtaggtccggggagtcttagtcgacgtccggtcgggggtccctgacgactctccgtgtcgcagcctagtcggtacttccgacctttcgaggtacgtaccgtacgttggactgtccgacggttcgggtccaccgtaacgccgtacggaggggtacgggcgttgggtggtcggtctacgtaacgtattaacgngtagagtagggatacgacaacgaacgtcgtaacggcgacgttacggaggaacggcctattaccaccgtanccctaacgaagaacaaccgtacgaccaaagggtacnccggtattagtactacggacctaagtaaacgtcggaacctgttaccgaagggacccgaggaaccccggtagggaccctacggtnttaggtttagtaaccttcgaggaactacggaaaagtgtagacggntacnccggtaagcccgttaggtaaccgcgttaccggtacgggg

SEQ ID NO: 120235 - DNA, 718 bp, Homo sapiens
  misc_feature: GYAE6OF01B86AB.2.38.D05.1.454.CMB.1.raw
  modified_base (278)..(278): a, c, t, g, unknown or other
  misc_feature (278)..(278): n is a, c, g, or t
  modified_base (424)..(424): a, c, t, g, unknown or other
  misc_feature (424)..(424): n is a, c, g, or t
tcagacgctcgacacacgaccggtgctcgatttagtatctgatagttggggtttgggggtgggtccaggaggcagaactctgggtgtctcaccatggcctggatccctctacttctccccctcttcactctctgcacaggctctgagcctctatgagctgacacacgcccaccgtcggtgtacagttcgtaccccgaggaccaggacggccaggactccacctgctcgtggagatgctagttcgaccaaagcaatacgtgtacttagttacggaaccngaccgaagtaaccgccgtaacggccctacggtcccccgttaggtccgggtctttagggacgtaattaactaaaagtaaacgacgtagaggacgtaccgggtccccgtaggaacgggtccctacgtcggacgtaccgtattttccgnggtttaccgccgtaaccgaggttacccaaggaaacggaaactaacccgtaggttacctaaccgggttacaacgtacgtacgtaggtcgtaagtacccgaaggtacaacggtaagtacggtagacggacgttacgtaacttaactttaacgcttaaacgacttacgacgtacgaaacacgttaccgattagggtttaacgtttacgggttttgggaccggtccggggaacggttagaaccgttaacgccggtaagttccccggtacgttacaccggacgtacccgcgtaccccgg

SEQ ID NO: 120236 - DNA, 818 bp, Homo sapiens
  misc_feature: GYAE6OF01CKRLD.2.38.D05.1.454.CMB.1.raw
  modified_base (722)..(722): a, c, t, g, unknown or other
  misc_feature (722)..(722): n is a, c, g, or t
tcagacgctcgacacacgaccggtgctcgatttagtatctgatagttgggtttgggggagccccagccctgggattcccagctgtttctgcttgctgatcaggactgcacacagagaactcaccagtggtagttgggctgagtcgttgggttttccttgttgtacttaagtttttaaaaggtcgtccgagttgtggaggtgcagtcgtgggtgggtacgggtccgggggagtcgtttaggtccgacggtccggttacgggggtcccgtaggacgtaccttccgttccgtgtcgccgtacgccgttcgttcggtacttaccgtaccttacgtagtacgtactacgtggaacgtcgaccgtaccggttcgggtacccgaccgaacgtccggtacgggacggggacggggtcgtagggtcggtcggtacctacgtaacgttaagttaagtaggtcggtaaggtggggtacgaacgtaccgaacgacgtaccgtaacggccggtaccgtaccgggtagggaccggtaccgtactaccgaacctacctaccgtaaccgaagggtaaccgaaacccgtaaacccgaaccgaaacgaacccgtaggtacctttacgtaacgttaccgtaacgaaaacttaacggtaagaaacccgttgttaacggaggaaccggaacggaacccgggtacgtaaccgacgggttcgttagttaggttacgtttaacggngtaaacggagtaaacgggtataacggtacccgacggacgtaacgtaccgggtaccgggtacggaaccccgttaccgggtacccggttaaccggggg

SEQ ID NO: 120237 - DNA, 898 bp, Homo sapiens
  misc_feature: GYAE6OF01DZSXQ.2.38.D05.1.454.CMB.1.raw
  modified_base (85)..(85): a, c, t, g, unknown or other
  misc_feature (85)..(85): n is a, c, g, or t
tcagacgctcgacacacgaccggtgctcgatttagtatctgatagttgggtttgggggtgggtccaggaggcagaactctgggtntctcaccatggcctggactccctctacttcctccccctcttccactctctgcacgaggctcgtggacgccctctagtcgagctagacacgacgccctacccgtgggtgtacgtacggtccggtaccccgaagggaccgaaggacccggaccgtaagggtaccttacccgtaaccgttcggtccgttacggtaggggaacgtaactggtaccttaacgtttaccggaaaaccaaaagaccttaaagtaagttcggttaacgttttaagttaaccggggtaaccgaaggaacgaaccggtaaaccggaccgtaccggggacccgtaccgggtccccttggtccgggtagtttagggtacgtaaagttaaacgtaaagtaaagacggtagggtacgaacggtaccggacccgtagggaacgtaccgtaccggaggtaaccgtcgtacgttacgtacgtcggttaccaacggtaccggtacgtacggaaacgggaactaaccgttacgttaaccggtacggttaaccacttaacggtagtaaccggtaggttaacaccgggtaagaaagaaggtagtacggtaacggagtaacccgtaggttaacgtttactaggttacaactaacggtagaccggttaacgaacgacgtacgggttacttaccgggtttaacgggtttttaccggttcggggtttaagggtacccggggggtaaacggtaaaccggggtacgtaacccgggtaccggtttaaacccggcccgggttaaacctcggggtaaacccgtaacccggtacccggacggttaccccccggg

SEQ ID NO: 120238 - DNA, 777 bp, Homo sapiens
  misc_feature: GYAE6OF01CQLRN.2.38.D05.1.454.CMB.1.raw
  modified_base (583)..(583): a, c, t, g, unknown or other
  misc_feature (583)..(583): n is a, c, g, or t
  modified_base (628)..(628): a, c, t, g, unknown or other
  misc_feature (628)..(628): n is a, c, g, or t
tcagacgctcgacacacgaccggtgctcgatttagtatctgatagttgggtttgggggtgggtccaggaggcagaactctgggtgtctcaccatggcctggactccctctacttcctcccctcttcactctctgcacaggctctgaggcctctatgagctagacacacgcccacccgtcgggtgtcgagtccgtccccgaggaccgaggaccggccaagggactccaccgtgtccgtcgtaggagtatggactagttacgaaccgaaacgacttaaatattacggtactttaacgtttacggtaaccaggaaccgaaggaaccggaccggtaacggccccgaaccgggtccccgtaggtaccggtcggttagggttaagtaattaaagttaaaagaaaacggacgttaaggtaaggaacgggacccgtacccgtacggaacgggttaccttacccggtaggacggttacctaacgtttccgtaccggttcggccctaccggagtccgtaacgggaacggtaacaacgtcgtaccgtagtaccgactagtacggaggtacggactacggacgaacgtaagaagngtacgacggtctaagtactattacgtacgactaacgtcgaacgtnaacgaagtaccgtaagggtttggtttaacggttttcgggtttacggggttcgggaaccgggggtaccggttaacgaaccgggttcgtaccggtacggaacccgttacggggtacctaacgggaccggtaaacccggtcggtacccccgg

SEQ ID NO: 120239 - DNA, 852 bp, Homo sapiens
  misc_feature: GYAE6OF01BS1DX.2.38.D05.1.454.CMB.1.raw
tcagacgctcgacacacgaccggtgctcgatttagtatctgatagctgggttttccttgttgctattttaaaaggtgtccagtgtgaggtgcagctggtggaggtccgggggaggcttagttcagccgtggggggtccctgagacctctcctgtgcagcctctggattcacctttcagtagctacgtggatgcacgtcggggtcccacaagcctaccggaggggaaggggctgggtggtggtcctacgtacgttaattaagtagtgagtggggtagtacgacaacgtaaggccgtaccggccggtaccgttaccggagggaaccgggtcccgtaagtttacccaaccgtactaccgtaccgaaggaaccgaaacccgaaacccggacccaaaacggaacccgacggtcctttaaggttaactcgtagaacgaaaacttcggaaacgtacgtcgttagggaacggaacggaacccggacggaaccgtaccgggtcttggttaacgtttacgttaacgtggtacgaaaggaacggtagtaacgtacggaaccgtacggacgtacggtaccggttaccgggtaaccccgtacccggtaaccggttaccgggtaccgggggtaacccgaaccgggttaccccggtacggttaccccgtacccgtcccgttacccgacccgtacccgtaccccgtacccggaaacccggtacccgtaccccgtaccggtttccccggttccccccgttacccggtcccggtacccggtcccccgttccggtacccgtacccggacgtccgtaccccggaaccgtaccgacggaacccgacgaccggcccgggtccccggtacccggg

SEQ ID NO: 120240 - DNA, 1156 bp, Homo sapiens
  misc_feature: GYAE6OF01BRLOZ.2.38.D05.1.454.CMB.1.raw
tcagacgctcgacacacgaccggtgctcgatttagtatctgatagttgggtttgggggagccccagccctgggattcccagcttgtttctgcttgctgatcaggactgcacacagagaactcacgagtggtagtttgggctgagtcgttgggttttccttgttgtactttaagttttaaaaggtgtccgtaggttgtaggtaggtcgacgagtcggttagggtgggtacgggtccgggggaggttcttaacggtttccgacggtccgggttcggggggtccctaggtaacgtcccttccgttccgtgggttcgaccgtacggtcccgttacggttcggtaccttttacccgtaccgttacgtaaggttaaccgtaccttaccggttacggagtcggtaaccccgtacggttccggggttacccccgaaccccggtaacggtacccggtaacgggggtaaacggggggaacgggggttcggttcgggggtttagggtaccggggttaccctttaacgggttaaaaccgtttaagtttaaacgtaggggttaaggtacgggttaacggggttacgtaacggaaccttaaaccggtaaaacggttcccggggtaacccgggtaaacccggttaacccggggttacccggggtaaaaggggggtaaaccccggttaaccccgttaaagttaaccccccgtaaccgttaacgtaccccgtaccgggtaaaaacggtaaccgaaacccgtaaaccccgggaaaccccgtaaaaccgtaaaaccgtccggtaacggtttactttaacccggtccgtaaaaccgttaaaccgtaaaaggtaacccggttaaaacgtttacggtaacggtaaaccgggacggttaaacccggggaaacccggggtaaacccggtaacccggggttaacgggggtttacccgtttacgggttttaaacggtttaaacgttttaaccggggtaaccgggtttaaaaccccggtaaagggtaaaaaaggggttaacccggttaagggtaaacccggaaaccggtaacccgggttaaaacgggtccccggggggttttaaacccggttaaaccccccggggggttaccttaaaaaccccccgggggggtttacgggtttaaaaaacccccggggggggg

SEQ ID NO: 120241 - DNA, 760 bp, Homo sapiens
  misc_feature: GYAE6OF01DOMC4.2.38.D05.1.454.CMB.1.raw
tcagacgctcgacacacgaccggtgctcgatttagtatctgataggttgggtttggggggaagaggaagactgacggtcctgccacgaggtggtgcgtgggcacggtgggcactcgacacaacatttgcgctcaactgtcttgtccagtgtggaggtgcagcgtgggtgggaggtcccgggggaggtcttagttccgaggtccggttcggggggttccctggaacgtaccttcctccgtgtcgccacgtccttcgtaggtaccttacctacctttaccgaagtaccgaccgtagtaggtacgtcgtaccgtacggttcgggtccccgaaccgtaacggtcccggtaccgggaaggggggtaacggggtgttggggtcgttcgggtacctacgtaaacgttaagtttaaagtaggtcgtaggtcgggaatacgacgaacgacggtacacggacgtaccggtcggtaaggaccggaccgttactacgaaccctgtaccacgagaacaaccgaccgaaacgaacgtaacgacgtcgttagtacgtacacgtaacaacgtacgaaagtcgtagacgtagacggacgacggtacgacggtagtgttacgtcttagcgtacagtaagtagtacgtaacgacgacgtcggtaacggtcgtacggtacccggtaccggtaccggtaccgggacggggaacccgggtaaccggtaacccgggttcggtacccgttacccgtccgtaacccgttccgtaccggtaccccg

SEQ ID NO: 120242 - DNA, 783 bp, Homo sapiens
  misc_feature: GYAE6OF01BII2M.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttggctgagtcgttgggttttccttgttgtacttaagttttaaaaggtgtccgtagtgtgaggtgcagcgtggtcggaggtccggggagtcgttagttcgacggtccggtcgggggtccctggacgtaccttctccgtgtcgcgacgtcctcgtggtacttaccaacccgtttcgaaggttacgaccgttacgtggtacgtcgaccgtacggttccgggtacccgaccgtaacggtccgtaccggaagggggtaacgggtcgttcgggttaggtccgggttacttacccgtaaaggtttaatttaaagtaggttaggaaggttacggggaacgttacgaccgtaaagtaacggtccgtaacggccggtaaccggttaccggtaacgggaacgggtacccgtacttacccgaacccttaactccgtaccgaaagacggaaaccctaaacgacccgtaaaagaccgtacgcgttcgtaattccgaagtaaccgtaaagccgtaacgtacgttagtaacggacgaacccgggacggtacgaacccgtagggttaccttaggttagttaccggtagttcgaagtaaaccgtaggaacgatacggcgtaacgcgtacggttaggacccggtaccgacccggttaggtaaccccgggg

SEQ ID NO: 120243 - DNA, 771 bp, Homo sapiens
  misc_feature: GYAE6OF01CSY3S.2.38.D05.1.454.CMB.1.raw
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctctatgagctgacacacgccaccctcggtgtccagtcgtccccaggacagacggccaggatcactgctacgtggagatgcattgaccaaaagcaatatgcttagttggtaccagacagaacgccaggccaggtccccngtcgctggtnaatataataaagacagtgaagacggccctcgaagggtaactcccgttaggacgcgtaattctcgtcgggctacccaggccttcgaacggggaacaaacccgtagtaccgtaaccggtttacgaaccctagtccgtaaggttacggggaacggttaccccgaagggaccgaaagggaaaacgggtaattagggaaacggggcgttaacgggttaaaccgttttaactttaaacccggtttacggtaacctaaaacgttcccgaagtaaccgaaacgggttaacgaacggtaccgttaaggggtttacgggtttttaacgggttttttttacggggggttcggtttttaaccgggggggacggggtttaaaccgggggaacccggtaaacgggttacccgttaccgggtaacccccggttacccgttaaacgggttacccggtaaaccgggaacccccgtaaggggttaacccccgg

SEQ ID NO: 120244 - DNA, 869 bp, Homo sapiens
  misc_feature: GYAE6OF01AH0HQ.2.38.D05.1.454.CMB.1.raw
tcagacgctcgacacacgaccggtgctcgatttagtatctgatagttgggtttgggggaagaggaagactgacggtcctgccacaggtggtgctgggcacggtggcactcgacacaacatttgcgctcaactgtcttgtccagtgtgaggtgcagctggtggagtccggggagtcttagttcagccgtcgggggtccctgacgtactccgtcctgtgcacgtcctcgtcggtacttccgtaccttcgagtcgctacgtggatcgcacgtcggtaccaccgtaagtcctaccggaggggtacgggtccgtgggtgtacggtcctacgtaacggttaagtttaacgtaggtcggtaaggttcgggtaacgttacgaccgtaacgaacggtcgtaaccggtacggtaccgttaccggtacggaacgggtacccgtaacgtttacccgaacctacgttaccgtaccgtaacggaacgaaacccgtaaacccggaaccgaaacggaacccgtaccggtacgttacggttaaccttccggtaaacggtaaacgtaaacgtttcgggaaacccccgtttagggttaaccaggggaaaaccggaccccggttacccgggtaaaagggcccgtaacggggttcttacggttttaaaccgtttaccgttaacggttacggaacgggtaaacccgaaaagggtcgttaaaccgtacccgggtaacacggttaacggtaacggtaacccgttcgggggtaaccccaaacccggttaggtaaccccgggggtttccggaaaacccgggtaccgttaaccccggttcggtaaccccgttaacccggtcccctttaaccgaaccgggtcctaaacccccccggg

SEQ ID NO: 120245 - DNA, 761 bp, Homo sapiens
  misc_feature: GYAE6OF01BD7PF.2.38.D05.1.454.CMB.1.raw
  modified_base (224)..(224): a, c, t, g, unknown or other
  misc_feature (224)..(224): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccacccgtggtgtcagtcgtccccaggacagacggccaggactccacctgcttcgnggagatgctattcgaaccaaagactaaatattgtactttagttacggtaaccacgaccgtaaggaaccgacccgacgggcccgaccgggtccccccgttggtcggcggttcgggttgaaactttaagtaaagtaaaacggacgtaaggtacggaacggtaccgggtcccctacggacgggtaacctcccggttaggacggtaccgtactttcgtccgtcggtcctaccgacgtccgtaaccggacgggaaccaacgtcgtaccgtacgtaccgacctagtacggtacggtgggtaccgtaccgaaggactaaacggataggtaggacgtcgtacgtaacgttcgttacgtcgtaactaactacggaacgttacggaacgaacggtggtaacggttagggtttaaccgggtttttcggttttggggtacgggtttacccggggaaggtaccggggttaacctaccgggttacccggtagggttaccccgtacggttacgggtaacccgaacccggtacccgacgggttaccccccggg

SEQ ID NO: 120246 - DNA, 851 bp, Homo sapiens
  misc_feature: GYAE6OF01CY6CF.2.38.D05.1.454.CMB.1.raw
tcagacgctcgacacacgaccggtgctcgatttagtatctgataggttgggtttggggggaagaggaagactgacggtcctgccacaggtggtgctgggcacggtggcactcgacacaacactttcgcgctcaactgtcttgtccagtgtgaggtgcgagcgtggtggaggtccgggggagtcttagtcagccgtcgggggtccctgagactctccgtgtgcgagtcctctaggtcttcctacctttcgaggtacgcttacgtggactggtaccgaacggttcgggtcccgaccgtaaacggtccgttaaccggaagggggtaagggtcgtcgggtcggttacggggtcctaccgacgtacttaattaacgtagtagtaggtagggtacgtacgtacaacgaacggtcgtaccggcggtacgtccgggtacggacggtacctacttacacctgtaccctacgagtaaccgaccgaacgtaccgaaacgtaccgacctgtaacctactcgtaacggtaactaaacggtacggtaaccgtaggttaacgcgggtaacgtccgggaaacgggtaaccggtacggtaccgggtttacgtaggttttaaacggttcgtttaaccggtaggttaacccggaaaggtaacgggttaacggttaacgggtacggtacccgggtaacggttaaaccgggttccgggtaaacccgggttcgggtaaacccccggaaccgggttacccggggttaccgggggaaccccggggttaaaccgggtaaccccgggtaaacccggttcccggtaaaccccggttcccccggttaacccgtcccggttaaccccgggtaccccccgg

SEQ ID NO: 120247 - DNA, 718 bp, Homo sapiens
  misc_feature: GYAE6OF01EINN8.2.38.D05.1.454.CMB.1.raw
  modified_base (225)..(225): a, c, t, g, unknown or other
  misc_feature (225)..(225): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagcccaccctcggtgtcagtcgtcccgaggacagacggccaggatccacctgctcgtgganatgactattgaccaaagcaatatgtcttagtcggtaccagcaagaacgccgacggccacggccccctgtcgtcgtgggtgaattaataagtaaagacaggtaggagacggccctaggacgggtactcccgtagacgtcgtattcgtcgtcggtcctaccgacgtccgtacggaaacgggaacctaaacgacgttacctaacggttaacgaaccgtacttacggtaacggtacgggtaccggtaccgaagggacgtaaagggaaacggtagttacgggacgggtaccttaggtaacctttaagttacctaggtaaacctaacgtacgaaggtaaccgaagtaaccgtaacggtacgttacgggtttaacgggttttacggttttgggggtacggtttaccggggacggggtaacgggtaacgtaacggtcggttaccggtaccccggtttaccgggtaacggtaccggtaccggaacccggtaggtacccccgg

SEQ ID NO: 120248 - DNA, 777 bp, Homo sapiens
  misc_feature: GYAE6OF01CZ3W1.2.38.D05.1.454.CMB.1.raw
  modified_base (177)..(177): a, c, t, g, unknown or other
  misc_feature (177)..(177): n is a, c, g, or t
  modified_base (273)..(273): a, c, t, g, unknown or other
  misc_feature (273)..(273): n is a, c, g, or t
  modified_base (316)..(316): a, c, t, g, unknown or other
  misc_feature (316)..(316): n is a, c, g, or t
tcagacgctcgacacacgaccggtgctcgatttagtatctgatagttggggtttgggggagccccagccctgggattcccagctgtttctgcttgctgatcaggactgcacacagagaactcacagtggagttgggctgagtcttgggttttcctgttgacttaattttaaaaggtntcctagtgtgaggtgcgagtcgtgggtggacgggtccgggggtaggtacttacggttcacggtccggtcgggggtcctgacgtctctcgtgtgacncgtctcgtgtacttcctacttacgtagtacgtatacggtaggntacgtacgaccggtccggtaccggacaacggttccgtaccgggaagggggtcgggcttagggttcgttgggacctacggtaacgttaagttaagtacggttgaaggtcggggtaatcgaaccgaacgaaagtcccggtaaacggtcccggtaaccaccgggggtaggtaaacggtccgtaagtttaaccccaaccgtacgtaccgtaaccgtaaagaaccgaaccgaaaacccggaacccaaaaccggtaacaaccgtcgtaggtaaacctccggtaaacgaacgtaaagtaacgtaacgaggtacgtaaggtacgaacgggacccggaaggtacgtaccggtcgtacgttaggtttaacttacgtacggtaacgaaccgaaaggtagaaccggttaaggacccgtaaggactaccggtaacggtacggtaacccggttaaccggacggttaacccggggg

SEQ ID NO: 120249 - DNA, 803 bp, Homo sapiens
  misc_feature: GYAE6OF01AZ8ZS.2.38.D05.1.454.CMB.1.raw
tcagacgctcgacacacgaccggtgctcgatttagtatctgatagttgggtttgggggtgggtccaggaggcagaacgtctgggtgtctcaccatggcctggatccctctacttctccccctcttccactctctgtcacaggctctgacggcctcctatgagctgacacagtcccacccgtcgggtctacagttcgtccccgaaggaccaacggaccggccgtagggactaccacctcgccttcgtggacgtatcgctacttcgaaccaaagcaattatgtacctttagtcggtaccagtcgaagaacgccaaggcccacggcccctggtcgcgtggtagaataacgtaagtaaagctaaggtagacggtaccggcccgtaggaacgggtcctcccgaggtacgtacgtactttcgcgtcggccctcgaacgtccgtaacggaggtaaccaacgtacgtaccgtacgttacaccgtacttacggcggttacggaccgttaccgacgggtaaacaaagggtacgtacgtacgggtaacgtaccggttactaaacgtttacgttaccttaacgggtacctaaacgtaccgaacggttaaccgaacggtacgttaaccggtacggtttagggttttaccgggttttttacgggttttaccggggtaccggggtttaccggggtaccggggtaaacccggttaaccggtaaacccggttccggttaaccccgggttaccccgtttaacggggttcccggtaaacccggaaccccggttaccggggtaaacccggtttcccccccggg

SEQ ID NO: 120250 - DNA, 856 bp, Homo sapiens
  misc_feature: GYAE6OF01EJVF1.2.38.D05.1.454.CMB.1.raw
  modified_base (126)..(126): a, c, t, g, unknown or other
  misc_feature (126)..(126): n is a, c, g, or t
  modified_base (624)..(624): a, c, t, g, unknown or other
  misc_feature (624)..(624): n is a, c, g, or t
  modified_base (636)..(636): a, c, t, g, unknown or other
  misc_feature (636)..(636): n is a, c, g, or t
tcagacgctcgacacacgaccggtgctcgatttagtatctgatagttgggtttgggggagccccagccctgggattcccagctgtttctgcttgctgatcaggctgcacacagagactcacatggngttggctgagtcgttcgggttttccttgttgtacttaagttttaaaggtcgtactaggtgtaggaggtgcgagtcggtgggtgggcgggtccggggtaggtcgtttaggtccgacggtccgggttaccgggggtccctaggacgtcgtccgtccgtgtcgacgacgtccttcggtacgttaccttaccctaccttacgtacggttagttaccccgttaggtccggagttcgtaccggttccggtaccgggtccccgtaacccgaccggtaccggttacccgggggacgggggtaacgggttaccggttggggttcgggttacggtcccttaacgttaacgtttaaagttacggtagggtacggtaaggtaggggtacgtaacgaccgtaacgaaccgtaccggtacgggtaccggtaccggttaccgggagggtaacccgcgttactaccgtaacctcgttaccgaacgacgtaaaccggacccgaacacggaaaacncgtcacggtttntacgcgtaaagaacgtaaacgttccggtaaaccgggttaccggtaacgaacggggacccccgaaggggtacccgtacgggtttaccgttcggttaagggttacttacggtttggaacggtaactaacgggtaaacggataccggtaacggcgttacccggtaaagtcccggggttaaccgtttaaccccgggcccgtaggggtttaaccccggacggggg

SEQ ID NO: 120251 - DNA, 720 bp, Homo sapiens
  misc_feature: GYAE6OF01DT453.2.38.D05.1.454.CMB.1.raw
  modified_base (584)..(584): a, c, t, g, unknown or other
  misc_feature (584)..(584): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacacgcccaccctcggtgtcagtcgtcccaggacagacggccaggatccacctgctcgtggagtagtcgactagttcgaaccaaaagactaatagtgttacttagttcggtaaccagacgaagaacgccgaggcccacggtccccgtggtcgcggttaggtacgtaattaacgtaaagtaaagacgtaggtacggaacggtaccggccctaggaacgggtaacctcccgtaggacgtcgttacttccgtcgtacgggtcctaccggacgtccgtacggaagggtaacccaaagtacggttacccgtaacggtttaccgaaccgtacgtacggtaacgggtacggtaaaccgtccggaagggaaccgtaaaggaacgtaggtacgaggtacctaagtaactttaacgttactacgtacgtaancgaagacaacggtagaagtcgtagggttttccggtttagggtttcgggtaggttccggggaagggtacgaaccggtacgttccggtaacgttcccgggtaacgtcgggtaacctaccggccggtaacggtccccgg

SEQ ID NO: 120252 - DNA, 720 bp, Homo sapiens
  misc_feature: GYAE6OF01DAXOE.2.38.D05.1.454.CMB.1.raw
  modified_base (378)..(378): a, c, t, g, unknown or other
  misc_feature (378)..(378): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacacgcccaccctcggtgtcagtcgtccccaggaccagacggccaggatccacctgctcgtggagtatgctattcgaccaaagacaattatgtactttaacgttggtacccagaccaagaacgccgacggccgacggcccctgtcgcgtggtagaataataagtaaaagcgtaggtgagcggacctcgaaggtacctcctagacgtcgtacttcncgtgcctcgacgtcctacgaacgggacaaacgtgtacgtaccgttacgaacctaagtaccgtagggtaaggtacggtaccgaagggaaccgtaaggaaaggtacgtagggtacggacttcggtaaacctttaagtttaccgttaggttaaaccttaaacgttacccgaaggtacctaaggaacccgtaaggttacggttaacgggttttacgggtttttacggggttttacggggtttcgggttacgggggtaccgggtaaacgggaaacccggttacggtaccggtaccggtacccggttaccggtacggtacgtaacccggccgtaaaccgggtccccgg

SEQ ID NO: 120253 - DNA, 1069 bp, Homo sapiens
  misc_feature: GYAE6OF01BBGND.2.38.D05.1.454.CMB.1.raw
tcagacgctcgacacacgaccggtgctcgatttagtatctgatagttgggtttgggggagccccagccctgggattcccagctgtttctgtcttgctgatcaggactgcacacagagaactcacagtggtagttggctgagtcgttggttttccttgttgtacttaagttttaaaggtcgtaccgtaggttggtggaggtcgcgtaggtcgttgggtgggtacgggtccggggggtagtcgtttaggttcgacggtcccgggttcgggggtccctaggacgtaccgttcctccgtggtcgccgtacgtcccttcgtcggtacttacctaccgttacgtaggttaacgtccgttaacgtaggtactcggtaccgtaaccgggtccgggttaccccgaacccgaaacggtcccggtaaccggggtaaggggggtaaacggggtccggtttaggggttacggggttccgggttaccttaaccggttaacggtttaaacgttttaaaggttaaggttacgggttaaggtaagggggttaacgtaacggtaaccgtaacggtaaaccggtaccggtaacccgggttacccggtaaccggttaccggggtaaccgggaaaccggggttacccgttaaaccgttacccgtaacccgtaccgttaccccggtaccggtaaacggaacccggtaaacccgtaaaccccggtaaacccggtaaaaccgaacccgttaacgttacgttaaccggtttacgtaccgtaaccgtaaacgtaaacgtaacggtaaacgttaaccggttacgggtaaccgaaacggggtaaccccggggaaccgggtaaacccgggggtaacccgtttaaccgggtacggttttaacgggtaaccggttttaaaccggttacgggtttaacgggtaaccgggtaaaccggtaaacgggttaaaccggtaaagggttacccggaacccgggtaaaccgggttaacccgggtaaccggttacccgggggtttaaaccccgggtaacccggggttaaccccccgggtttaaaccggggttaaaccccccgggggggg

SEQ ID NO: 120254 - DNA, 725 bp, Homo sapiens
  misc_feature: GYAE6OF01COAID.2.38.D05.1.454.CMB.1.raw
  modified_base (599)..(599): a, c, t, g, unknown or other
  misc_feature (599)..(599): n is a, c, g, or t
  modified_base (620)..(620): a, c, t, g, unknown or other
  misc_feature (620)..(620): n is a, c, g, or t
  modified_base (631)..(631): a, c, t, g, unknown or other
  misc_feature (631)..(631): n is a, c, g, or t
  modified_base (641)..(641): a, c, t, g, unknown or other
  misc_feature (641)..(641): n is a, c, g, or t
  modified_base (657)..(657): a, c, t, g, unknown or other
  misc_feature (657)..(657): n is a, c, g, or t
tcagacgctcgacacacgaccggtgctcgatttagtatctgatagttgggtttgggggagccccagccctgggattcccagctgtttctgcttgctgatcaggactgcacacagagaacctcaccagtggtagtttgggctgagtcgtttgggtttttccttgttgtacttaagtttttaaaaggtgtcctagtgtggaggtgcgagtcgtgggtgggacggtcggggaggtcgttaggtcgacggtccggttcgggggtccctggacgtaccttccgttccgtgtcgaccgacgtcccgttcgtaggttacttaccgtacctttacgacggttacgtaccgttacgtaggagtcggaccgtacggttccgggtccccgaccgtaacggtaccgtacgggaggggtaacggggttcgtgggttcggttcgggtacctacgtaacgtttaagttaagtggtaaggtaggttacgggtaagtacgaacgtaacgaacggtccgtacggaccggtaccgtacgggtaggaccggtctaccttaccgactacgtccgacgaagtaccgaaccgaaccgaacaacgtacacgtcttataacgtnaacgaataagacacgtgtagngaacgcgacgngaacgtcgtnttagttactcgttagnggtaccgaagtagacgtacgcgagtacgacgtggtacccggtaagacccgtaccgtcggtaaccgggg

SEQ ID NO: 120255 - DNA, 730 bp, Homo sapiens
  misc_feature: GYAE6OF01BAAK9.2.38.D05.1.454.CMB.1.raw
  modified_base (541)..(541): a, c, t, g, unknown or other
  misc_feature (541)..(541): n is a, c, g, or t
tcagacgctcgacacacgaccggtgctcgatttagtatctgatagttgggtttgggggaagaggaagactgacggtcctgccacaggtggtgctgggcacggtggcactcgacacaacatttgcgctcaactgtcttgtccagtgtgaggtgcagctggtggagtccggggagcttagtcagccgtgggggtccctgagactctctgtgcagcctctggacttcaccttcagttagctacgtggatgacagttcgggtccaccgaagctacggagggtaagggctggtgtcgggtctcgacgttattaacgtaggtgtagtcgggtaagtagctaacgaagtcctaacggccggtagtccgtaggaacggggtacctagttaccaaccgtatccgtacccaaggtaaccggaaccaaaccggaccaaaacgaaccgacgtacgttagtaacgtacctaggaacaaagtacggaactacgttacgaggaacggacggtacccgaaggtacccgaaggtccgttaggtacgttaacgttacgngttacgggaactaaacgggtagacttaacgaccgaggtacccgtaaggtaccccgtttaggggaaccccggttaccccgaaacgggtttacccgggacggggtaaacccccgttaaggggaccccccgttttacggtaaacccgtccccgtttaacggtccccgttaaaccgcccggggttaaaccccc

SEQ ID NO: 120256 - DNA, 818 bp, Homo sapiens
  misc_feature: GYAE6OF01D3QZM.2.38.D05.1.454.CMB.1.raw
  modified_base (137)..(137): a, c, t, g, unknown or other
  misc_feature (137)..(137): n is a, c, g, or t
  modified_base (799)..(799): a, c, t, g, unknown or other
  misc_feature (799)..(799): n is a, c, g, or t
tcagacgctcgacacacgaccggtgctcgatttagtatctgatagttggggtttgggggtgggtccaggaggcagaactctgggtgtctcaccatggcctggatcctctacttctcccctcttcactctctgcacgnggctctgacgtcctctagtgagctgacacgacgccctacccgttcggtcgtcacgtccgtacccgaaggaacgacggtaccggaccgtaagggacctccgtacctggtccttcggtaggaacgtagttcgtactacgttacgaaaccgtaaaagtactaattaacgttcgttaacgtttaggtttacggaaccgagacgaacgaaccggaccggacggacccgtaccggtccccgtggttcggtcggttagggtagttaaattaaagttaaacgtaaaacggtacgtaagggtacggtaacgggtaacccgtcccggtaacggtaaaccgggtccttacccggagggtaacgtcgtttacgtttccgtaccggttccgtacccgtaaccgccgttaaccggaaccggaacggtaaacctaaacggtacggttaccgttaacggttacctaaaccggttgtaaccgggtacggtacggtacccgtaaccgggaagacgtaaaggaggtacgtagtaacggtctttaagtaacgtttattaacgtactaactaacgacggtacgaagtaaccggactacgttagttaggttttaacgggttttgggttcggggtacggtacggggaccggtaaggacgtacgcgtacggtacccgtgtaaccgngacccgtcggagttccccg

SEQ ID NO: 120257 - DNA, 707 bp, Homo sapiens
  misc_feature: GYAE6OF01A4LT3.2.38.D05.1.454.CMB.1.raw
  modified_base (289)..(289): a, c, t, g, unknown or other
  misc_feature (289)..(289): n is a, c, g, or t
  modified_base (399)..(399): a, c, t, g, unknown or other
  misc_feature (399)..(399): n is a, c, g, or t
  modified_base (483)..(483): a, c, t, g, unknown or other
  misc_feature (483)..(483): n is a, c, g, or t
tcagacgctcgacacacgaccggtgctcgatttagtatctgatagctgggttttccttgttgctattttaaaaggtgtccagtgtgaggtgcagctgggtggaggtccgggggagcttagttcagccgtgggggtccctgagactctcctgtgcacgtcctctggtattccaccttcgagtagtcttacgtggatgacacgttcgggtacccacgtaacgctaccggaggggagggtctggtgttgggctacgtaagttattaataggtagagagggtagtagaccganacggtcgtacggacggtaccgtcggaagaacggggtacctattaccgaacttactccgtacgacgaacgtacaaacccgaccaaacgaaccgacctcctagtactcgtanaacgaagtaccgaatacgtcgaggacgacggaccgtaaggactacggtagttgtacggttacttacggcgacgaacgaaggtanacgtacgagacgtacacgtacgtacggcgtacggtacgtacgggacggaccggtaaccggtaccgtcgtaccgtacccgtcctacgtaccgacgtacccctacggtaacccgaccgtacccgtacgtcccgtaccgtcccggtccgcccgtcctcccgtaccgtacccgaacggtccaacccgtccgaacggtaccgagacccgacgccgggtccggtacccgg

SEQ ID NO: 120258 - DNA, 709 bp, Homo sapiens
  misc_feature: GYAE6OF01BIXZE.2.38.D05.1.454.CMB.1.raw
  modified_base (295)..(295): a, c, t, g, unknown or other
  misc_feature (295)..(295): n is a, c, g, or t
  modified_base (370)..(370): a, c, t, g, unknown or other
  misc_feature (370)..(370): n is a, c, g, or t
  modified_base (421)..(421): a, c, t, g, unknown or other
  misc_feature (421)..(421): n is a, c, g, or t
tcagacgctcgacacacgaccggtgctcgatttagtatctgatagctgggttttccttgttgcttaattttaaaaggtgtccagtgtgaggtgcagctggtggaggtccgggggaggtctttagttcacgccggtcggggggtccctggagtactctcctgtcgcagtcctgtggtacttcaccttgagtagcttacgtggatcgcgtacggtcgggtacccaccgagccgtaccggaggggagggtctgggtcggtggtctacgtaacttagttaagtgtgagtgggatacganacgacgctacggcgtacgtacgaggacggcctactccgactctccgacaagtacgaccaacgacaaacgacgctntagtatgacataatacgatcgcgtaggaccgacggacggacgacgtcggtnttagttacttaacgttcgaggtaaccaaggaagtcgtacgtacgacgacgtcggtacgtaccggtacggtaccggtaccgtacggtaccgggccggtaccggtacccgggtaccgtacggtaccctccgtaccctacgacctacccgtacccgtacccgtaacccgtaccggtacccgttccgttcccgttcccgtcccgaccggttccctaccggtacccgtcgtaccgacggccgtacccgtaccgaccgacggtaccgaccggccggacccggtccggtacccgg

SEQ ID NO: 120259 - DNA, 762 bp, Homo sapiens
  misc_feature: GYAE6OF01BHF7R.2.38.D05.1.454.CMB.1.raw
tcagacgctcgacacacgaccggtgctcgatttagtatctgatagttgggtttgggggtgggtccaggaggcagaactctgggtgtctcaccatggcctggactccctctacttcctccccctcttcactctctgcacgaggctctgaggccctcctatgagctgacacacgcccgtacccgtcggtgtcagtcgtaccccaggacacggacggccaggtactccaccgtgcgtcgtggatatgactattgaccaaagctaatatgtacttagttacggaccagacaggacgcgacggccgtacggtccccgtagtcggtcgtggtacgtaagtaacgtaagtaaacgacgtagggtaggaacggtaccggtcccgtacggaacgggtacctcccggtaggacgtacgttacgttccgtcgtcgtccgtaccgtacgtaccgtacggaacgggtaaccaaacggtacggttaccgtaccgggttaacgaaccgtacgtacggtaggttacgggtaaccgtaccggaaggaacgtaaacggtaagtacggtacggtacggtacttacggtaaacttagttacgtacgtaaactaacgtcggaagtacgtaacgtcggacgtacggttacgggtttacggttttacgggttttcggggttacgggttaccgggacgggtaccgggtaaccgacgggttccgtaaccggtacccggttaccggtaccgggtaaccgaccccggtaccggttaaccggtcccccgg

SEQ ID NO: 120260 - DNA, 925 bp, Homo sapiens
  misc_feature: GYAE6OF01CAB05.2.38.D05.1.454.CMB.1.raw
tcagacgctcgacacacgaccggtgctcgatttagtatctgatagcgtgggttttccttgttgctattttaaaaggtgtccagtgtgaggtgcagctggtggaggtccggggaggcttagttcagccgtgggggtccctgagactctcgtgtgcacgcctcgtgtacttccaccttcgaagtacgtcctacgtggtactgtacctacggttccgggtcccgaccgaacggtcccgtaccgggaagggggaacggggtcgttgggttcgggttacgggtccttaacgtaacgtttaaattaaagttaggtaggtaggtagggtaacgtaacggaccaaacgtaacggtccgttaaccgggccggtaaccgttaccgggtaacgggaacccggggttcctaactttacccgaacccttaacgttccgaacccgaaggtaaacgaaccccgaaacccggaacctaaaacggaaacccctaggtccgttaagttaccttacgacaaaccgtaaataccggaactacgtcgaacggacgtaaccggacccggaacggaactccggtagttttaggtaacgtttacgtttaggccgttaagaaacggtaagaaagtactaacggaacgcgtaaccgtcgggttaaccgtaccggtaacccggtacccggtaacggttaccgggacccgggtaaacccggaaccggttaccccggtcggtacccccgtacccgttcccgttaccggcctaacccgtcccccgtaacccgggtacccggtaaacccgggtcccttaacccggtcccccggttcccccgtcccggtcccgacccgtccccgtacggtacccggtaccgaaccggcccgttaccccgaacccggtacggaaccaaccccggtacgtaaccccgggcccggtacccgggttcccgg

SEQ ID NO: 120261 - DNA, 872 bp, Homo sapiens
  misc_feature: GYAE6OF01E3TK7.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccacccgtcggtgtcagtcgtccccaggacgagacggccaggactcacctgcctcgtggagatgactattcgaccaaagcaatatgtcttagttcgtacgagcaagaacgccgacgccgaccggtcccctggtcgtcgtggtataattaacgtaagtaaacgacgtaaggtagaacggaccggtcccccgtacggacggggttacctacccgtgggtaacgtaccgtacgtttcccgtcggttaccggtccccgtaccgacggtaccgtacggaaacggggtaaaccaaccggtacgtaccgttaaccggtttacgaacctacggttacggtaacgggtcgggtaaccgtacccggaacggtaaccgaaagtaacggtaggtacgggtacgggttaccgtacggttaaaccgtttaactttaccgtaacgttaaccgtaaaccgttaccggaagggtaaccctaaacggtaccggtaaccggtttacggtttaaaccggggtttttcggggtttttaaccggggtttttttcggggggtacccggggtttaacccggggggtaaacgggtaaccccgggggtaaacccggttaaccgggttaccccggggttaccccggggtttaacccggtttaaccccgggttacggggtaaccccccggtaacccgggttcccccgggtaaaccgggttccccccccgggg

SEQ ID NO: 120262 - DNA, 752 bp, Homo sapiens
  misc_feature: GYAE6OF01EAH90.2.38.D05.1.454.CMB.1.raw
  modified_base (150)..(150): a, c, t, g, unknown or other
  misc_feature (150)..(150): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgnggtgcagcgtggtggacggtccgggggagtctttagtcaggccggttcgggggtccctagacgtaccttcctccgtggtcgccacgtcctacgtcggtacctttccaccttacgagtacgtacctacgtggatcgctcggtcggtccaccgtaacgcgtaccggaaggggacgggtctgggtgtacggtctacgtaagttagttaaagtaggtggtaggtgggtaagtacgacgaaccgtaagaccgtacggtaccggaccggttacggacggaaccgggtccgtaacttcccacgtacttcccgaagtaaccgacggtaaccaaccgtaacgaaaaccgaacgaccgttagtaaccgtttaactccgtaaagaaaccttaaaggtaacctaaagtacggttagaaccgggaacccgacggtaaccgggaaccgcggtacgttacgttggtttacgtaagttacctgggtacgaaactaggtacgtaagttaccacgaccgtagtaccggacggttaccggacccttaccgggtaacgtcgggcccggttaaccggacccgttacgccgttacccctacgtccctcgtacccgcctacccgg

SEQ ID NO: 120263 - DNA, 713 bp, Homo sapiens
  misc_feature: GYAE6OF01A7SAO.2.38.D05.1.454.CMB.1.raw
  modified_base (122)..(122): a, c, t, g, unknown or other
  misc_feature (122)..(122): n is a, c, g, or t
  modified_base (180)..(180): a, c, t, g, unknown or other
  misc_feature (180)..(180): n is a, c, g, or t
  modified_base (488)..(488): a, c, t, g, unknown or other
  misc_feature (488)..(488): n is a, c, g, or t
  modified_base (531)..(531): a, c, t, g, unknown or other
  misc_feature (531)..(531): n is a, c, g, or t
tcagacgctcgacacacgaccggtgctcgatttagtatctgatagttgggtttgggggtgggtccaggaggcagaactctgggtgtctcaccatggcctggatccctctacttctccccctnttcactctctgcacaggctctgacgcctctatgagctgacacagcccacccgttggtntcgagtccgtccccaggaccaggacggccaggctccaccgtgcctcgtggaatacgtgacctaagttcgaaccaaagctaaattagtgtaccttttagttacggaacccaggacaaaggaaccgccgacgggtaccctaccgggtccccgtaggtcgtccgtggggtataacgttaataacgtaaaagacggtaggtaggaaccggtaccggtccctaggaacgggtaccttcccgtaggaacggtcgttacttcgtacgtcggtcctcgacgcgtacggaaggaacctagcgtactagtacgacctntcgaggtacgacgcgtaagaccgtaaggacgtgaggacgtatnttaaccgttgtttaactcggactaagtcccgaagacgtaaacgtacgtacgttagttaaccgggtttgtttttacgggttcggggttaacgggttaccgggacgggtaaacggtactaccggacgtttccggaaccttaccgggtacgtaaacccgccgttaccccgggaagttcccccggg

SEQ ID NO: 120264 - DNA, 717 bp, Homo sapiens
  misc_feature: GYAE6OF01BYMQJ.2.38.D05.1.454.CMB.1.raw
  modified_base (590)..(590): a, c, t, g, unknown or other
  misc_feature (590)..(590): n is a, c, g, or t
  modified_base (598)..(598): a, c, t, g, unknown or other
  misc_feature (598)..(598): n is a, c, g, or t
  modified_base (610)..(610): a, c, t, g, unknown or other
  misc_feature (610)..(610): n is a, c, g, or t
  modified_base (618)..(618): a, c, t, g, unknown or other
  misc_feature (618)..(618): n is a, c, g, or t
  modified_base (696)..(696): a, c, t, g, unknown or other
  misc_feature (696)..(696): n is a, c, g, or t
tcagacgctcgacacacgaccggtgctcgatttagtatctgatagttgggtttggggggaagaggaagactgacggtcctgccacaggtggtgctgggcacggtgggcactcgacacaacattttgcgctcaactgtcttgtccagtgtgaggtgcagctggtggaggtccgggggagtcttagttcagccgtggggggtccctgagactctcctgtgcagcctctggtacttccaccttacagtagctacgtggatcgccgtacgtcgggtcccgaccgtaagccgttacggaaggggaacgggtccgtgggtcggttcgggttcctacgtaacgttatttaaagttcggtagaaggtagggagtacgaccgaacgtaacgccgtaccggccgtaaccgtccggtaaggaccggacctacttaccaccgtactcccgtaccgaaggaacgtaaccgaaacccgaccgtaaaacgaaacccgtacgtaccgttacggtaactcgtaaccgaacgttaaagtacggaaactcgggttacgacggaacgacgggtaccggacggaccacgggtcgtagttagttaacttcgngtaaccgngtaagacgttanacgcgaancgaagtcgttacggaccaccggtaaccgtcgggacggggacctaacccgggacccttcggtacccgaccccgtttacnccctaagggcccctaaccccg

SEQ ID NO: 120265 - DNA, 754 bp, Homo sapiens
  misc_feature: GYAE6OF01EIA0O.2.38.D05.1.454.CMB.1.raw
  modified_base (391)..(391): a, c, t, g, unknown or other
  misc_feature (391)..(391): n is a, c, g, or t
tcagacgctcgacacacgaccggtgctcgattttagtatctgatagttgggtttgggggtgggtccaggaggcagaactctgggtgtctcaccatggcctggatcctctacttcctccccctcttcactctctgcacaggctctgaggcctctatgagctgacacacgccacccgtggtgtcagtcgtcccgaggacaggaccggccaggactccactgctcgtggagtatcgctaagttcgaaccgaaagctaaattagtcgtactttaagtaccggtaacagacgacgaacgaccgacggacccgacggtccccgtaggtcgtcgtggtacgtaattaacgtaagtaaagacgtaggtagacggaccgtccgtaggacggtacctccgnggtacgacttacgttcgtcggtacgcctacggtacgcgtacgaacggaacaacgtacgtacctacgtacacctagtccgtaaggtcggacgtaccgaacgggtagaaacgtaagtacggttaggacgttacggttaactaaacgtttagttaaccgtagttaacctaacgtacgaaccgtaaccaaggtaaccgtacggtacgtttaacggggttttaccgggttttacggtttttacgggggtccggtttaaccgggggtaaccgggtaaaccgggtaaccggttaccgggtaacccgttccgggttaacccggtaaccgggttacgtaacccggaacccgtccggtaaaccggttcccccg

SEQ ID NO: 120266 - DNA, 751 bp, Homo sapiens
  misc_feature: GYAE6OF01AO38X.2.38.D05.1.454.CMB.1.raw
  modified_base (543)..(543): a, c, t, g, unknown or other
  misc_feature (543)..(543): n is a, c, g, or t
  modified_base (562)..(562): a, c, t, g, unknown or other
  misc_feature (562)..(562): n is a, c, g, or t
tcagacgctcgacacacgaccggtgctcgatttagtatctgatagttgggtttgggggagccccagccctgggattcccagctgttctgcttgctgatcaggactgcacacagagaactcaccaatggagtttgggctagagtccttgggttttccttgttgtcttaagtttaaaaggtgtccagtgtagcggtgcagcgtggtggacgggtccgggggagtcgttagttcgacggccggttcggggggtccctggacgtaccttcctccgtgtgccgacgtccgttcgtacggtactttcctaaccctttgaacggttacgtaccttaacgtggtaactcggactacggtcgggtaccctacgaacgtccgtacggaaggggtaggtcgtgggtgtcggtactacgtaagttaattaagtaggtagtacggttagggacttaacgactaacgacgtccggtacggaccggtacctcggacgggacgggtacctattaccacgtactccacgaagtaccaacgacaaccgaaagacgtaccgntaggtacctagtacgaaanaacgttacgaacacgtacgtacggaaccgacggtaccgggtaacgacggttacccggtgttaccggttaagttacgttaccgtaggtacggtaaacgaaacggttagaaacggtccgtacccgaaggaccggtacggggttacccgtaacggtacccccgggtaaaccgttacgggtaaccccgggggg

SEQ ID NO: 120267 - DNA, 758 bp, Homo sapiens
  misc_feature: GYAE6OF01EOL0A.2.38.D05.1.454.CMB.1.raw
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (464)..(464): a, c, t, g, unknown or other
  misc_feature (464)..(464): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
tcagacgctcgacacacgaccggtgctcgatttagtatctgatagctgggttttccttgttgcttatttaaaaggtgtccagtgtgaggtgcagctggtggaggtccgggggagcttagttcacgccgtcggggggtccctgacgacctcctcctgtcgcacgtcctctggattcacctttcgagtacgcttagtggatgctacgtcgggtccnccgaacgccgacggaacggggaggtcgtggtcggtcgtctacgtaagttattagngtagtaggtggagtanacgaacgacgtacgaccgccggtaccttacggaggaccgtcctacgtccacgtactccagacgacgaaccaccgaacgaacgaaccgtcacttgtaactgtacgaaactaagtaccgaagtcgtgtaacggccggtacggaccgggactaacggtcgtcgtttacgtagttacttacgngtaagacgtaaggtataacggngtaccgacgtacncggtacggtaccgacggtaaccgtccggaccgggtacgggacccgtaaccggtaccgtacgttccccgtaccgttcccacccgacgtcccctaacccgaccgaaccggtacccgtaccccgttcggttccccgttcccccgtacccgggtccccgttacccggcccttaccccggtaccgacccggtacggtcccctacccggtacccgaaacgggtccgaaccccgtacgaccccgggttcgcccccgggttaccggg

SEQ ID NO: 120268 - DNA, 737 bp, Homo sapiens
  misc_feature: GYAE6OF01DAQC5.2.38.D05.1.454.CMB.1.raw
  modified_base (123)..(123): a, c, t, g, unknown or other
  misc_feature (123)..(123): n is a, c, g, or t
  modified_base (236)..(236): a, c, t, g, unknown or other
  misc_feature (236)..(236): n is a, c, g, or t
  modified_base (707)..(707): a, c, t, g, unknown or other
  misc_feature (707)..(707): n is a, c, g, or t
tcagacgctcgacacacgaccggtgctcgatttagtatctgatagttgggtttgggggtgggtccaggaggcagaactctgggtgtctcaccatggcctggatccctctacttcctccccctnttcacttctctgcacaggctctgacggcctcctatgagcctgacacagccctacccgtggtgtcagtcgtcccaggaccaggaccggcaggactccacctgcctgtggaacgntcgactagtacgaccaaagctaattagtgtacttttaggtccgtaccgagacgaagaacgccaacgggacccgacggtccccgttgtacggtccggttggtacgtaaattaataaaggttaaacgagtacggtagaaggtacccgccgttaacggaacggtcccttaggcggaacgttcgtaactttcggcttaccgcctacgacgtccgaacgaaccgggactaaacggtacgtaccgttaagtaccgtactaacggacgtaacggtacggtacgtaaccggaacggaacgaaaggaacgtaacgaggtacgtactacgttaacgttttaataccgtactaaacgttaacaccgtaaagccgtaacgacggtagttacggttacggtttagggttttacggttggggttaccggtacgggaaccggtagggtaacccgtggtaccggttacgtacccggttacggtaacngggtaaacccgtcggtaccggttaccccgg

SEQ ID NO: 120269 - DNA, 724 bp, Homo sapiens
  misc_feature: GYAE6OF01EQ6ZG.2.38.D05.1.454.CMB.1.raw
  modified_base (499)..(499): a, c, t, g, unknown or other
  misc_feature (499)..(499): n is a, c, g, or t
  modified_base (536)..(536): a, c, t, g, unknown or other
  misc_feature (536)..(536): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagcgtggtggaggtccgggggagtcttagttcagccgtgggggtcctgagtactctctgtgcacgcctcgtggtacttcctaccttcagtacgtctacgtggatcgctacgttcgggtcccgaccaagtccgtaccggaggggaacgggtgtcgggttggtggtctacgtaacgttaatttaagtgttaggagtggggaagtacgactaacgaagtcgtaacggcggtaccgtaccggtagggacgggacctacgttccaactatccacgagaacaaccgaaaccgaccaaagaaccgacgtacgttagtctacgtacgaactaaagtaccgaaactagtaccgngggaacgaccgggaaccggtacggacgtacccgggtnttaggttacgttaaagttcggtagtaggtaaccgaaagtagaagtacgacgacggtaccgtaagtcccggttacgggtaacccctaccgggtaacccggttaacggggaccggggtaccccggaaacgggtacccccgttacggtacccctacccgggtttacctacccgtccgaaccccgtaccccg

SEQ ID NO: 120270 - DNA, 822 bp, Homo sapiens
  misc_feature: GYAE6OF01APK42.2.38.D05.1.454.CMB.1.raw
  modified_base (124)..(124): a, c, t, g, unknown or other
  misc_feature (124)..(124): n is a, c, g, or t
  modified_base (134)..(135): a, c, t, g, unknown or other
  misc_feature (134)..(135): n is a, c, g, or t
  modified_base (139)..(139): a, c, t, g, unknown or other
  misc_feature (139)..(139): n is a, c, g, or t
  modified_base (160)..(160): a, c, t, g, unknown or other
  misc_feature (160)..(160): n is a, c, g, or t
  modified_base (168)..(168): a, c, t, g, unknown or other
  misc_feature (168)..(168): n is a, c, g, or t
  modified_base (243)..(243): a, c, t, g, unknown or other
  misc_feature (243)..(243): n is a, c, g, or t
tcagacgctcgacacacgaccggtgctcgatttagtatctgatagttgggtttggggtgggtccaggaggcagaactcgtgggtgtctcaccatcggcccggatccctctacttcctccccctnttcactctcnncacnggctctgacgcctactatganctgacacncgcccaccgtggtgtcagtccgtaccccaggacacggaccggccaaggtctcctaccgtgaccttcggtggactntcgctacgtcgaacaagactaagttgacgttacgttttacgtaccgtaccagccggtaaacgaccgacccggtacgacccgtaccgggtcccttaggtccggttgttcggtaactaagtttaaaacgtagtaaaacggtcgtaagggtacggaccggtacccgtacccggtacggacgggtccttacccgagggacgttacttccgttaccgtcggtccgtaacccgttcgaccggtccgtaacggaacccggtaaacgtaccggttacctaaccggttaaccgtccgtaaccgtacgttaccgggtcgtacgggaccgtaaccggacggtacgaaggagaggtaagccgttaccgttacgttacttaacgttcttaggtaacctagtaaccgacggaacggttaaacgcggtaccggttaacggtttccggtttaagggttttacccgggttttccggggttacgggtttaccgggggtacgttaacccggttacgaaccgggttcgttaacccggtcccggtaaacggttcccggtacggtaaccccggcccgggtacccgttcccgggtccccccg

SEQ ID NO: 120271 - DNA, 877 bp, Homo sapiens
  misc_feature: GYAE6OF01CSN33.2.38.D05.1.454.CMB.1.raw
  modified_base (203)..(203): a, c, t, g, unknown or other
  misc_feature (203)..(203): n is a, c, g, or t
tcagacgctcgacacacgaccggtgctcgatttagtatctgatagttgggtttgggggagccccagccctgggattcccagctgtttctgcttgctgatcaggactgcacacagagactcaccatggtagttgggctgagtcgttgggttttccttgttgtcttaagttttaaaggctcgagtgtggaggtgcagcgttgggngggacgggtccggggagttcttacgtcgacggtccgggttcgggggtccctagacgtaccttccgtccgtaggttcgccgtacggtcctacgttacggtacctttaccgtaccccgttagtaacggtacgtaccgttacggttcgggtaacttcggtaccggtaccggtttaccggggaccccgaaccggtaaacgggtaccccggttaaccggggaaaggggggttaaccggggtccggtttaggggtttacgggtttaccggggttacctaacccgggttaaacgttttaaagttaacgggtttagggtacgggtaaggttagggggtacgtaaacggaccgtaaacccgggtaacggtaccggtaacccgggtaccgggttacccggtaccgggtaacggggtaaccggtacccgttacgttaacccgaaccgttccgtaacccgtaaccggtaacgaaaccgaaacccgtaaaccgaaacgtaaaccgtaaccgtacgtacgttacgtaacgttaccaacgtaacgtaacgtacgtaacgtacgtcggaacgacggtacggacggtacggacgtacggtagttggttaccgtacgtttacgacgtagacgtaagtagacgtacgacgagacgtacggtaccgttacggaccgtcgtacccggtaccgggg

SEQ ID NO: 120272 - DNA, 751 bp, Homo sapiens
  misc_feature: GYAE6OF01ASTM0.2.38.D05.1.454.CMB.1.raw
  modified_base (414)..(414): a, c, t, g, unknown or other
  misc_feature (414)..(414): n is a, c, g, or t
  modified_base (439)..(439): a, c, t, g, unknown or other
  misc_feature (439)..(439): n is a, c, g, or t
  modified_base (562)..(562): a, c, t, g, unknown or other
  misc_feature (562)..(562): n is a, c, g, or t
tcagacgctcgacacacgaccggtgctcgatttagtatctgatagttgggtttgggggtgggtccaggaggcagaactcgtgggtgtctcaccatggcctggactccctctacttcctcccctcttcactctctgccacgaggtcttctggacggtccctacctatggacgtctacgacacgaccgccctacccgtggtctcgagtccgtacccaggacacggaccgccaggtactcctaccttgccttgtggaagtctcgtatacgtacgaaccaaagtactaagttacgttgttaccgtttagttacgaaccgagacgaacggaaccgccgtaaccggccccgtacggtcccgttggtacgtcggtaggtataagttaaagtaacgtaaagcggtaagcgacggtctaccgngtaccggctcgtaggctgtcttcgngtcgcctcgctacgaagtacgaactacgtcgtacgcgttacgactacgtaggttcggacggtacgacgacggaacgaaaggtcgaacggtaggaccgtactaacgtacgttacttaccgttanaccttaacggactaacgtacgaacgtacgtacggttaccggttgggtttaaccggttttgggtttaccggggtttaggggtaaccggggttaacgggtaccggttaaacccggtccggtacccggtttaccgtaacccgggttaccgaacccgggttaccctaaacccggggccgttcccgtaccccgg

SEQ ID NO: 120273 - DNA, 663 bp, Homo sapiens
  misc_feature: GYAE6OF01BRV3O.2.38.D05.1.454.CMB.1.raw
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (332)..(332): a, c, t, g, unknown or other
  misc_feature (332)..(332): n is a, c, g, or t
  modified_base (378)..(378): a, c, t, g, unknown or other
  misc_feature (378)..(378): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactcgggtccgccaagcctccgaggggaagggctggtgtgggtctcacgtattaatgtgatgggagtgcacagctacgcgactcgtgaaggccattcacatcnccagacacacgcaagacacntgtanctgactaaatcgaacngtctaggacagccgaaggacacggtctagtcgtaattacgtggtanacgtaagagatagacagactacggacgtacggtaccgaccggtaacgttccgggacggggtacccgaacggggtaaccccgttgggtacccgtacccgttccgtccgtccgaaccggtcccgtaccccaacccgggtaaccgggtcccctacggttccccggttcccttcccccggtacggccccgtacccgttccggtacccgttacccgaccgggtccgacccctaacccggtacccggaacgacccggaaccgtacccggaccgggtcccggtcccccgggg

SEQ ID NO: 120274 - DNA, 763 bp, Homo sapiens
  misc_feature: GYAE6OF01BPWKO.2.38.D05.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
tcagacgctcgacacacgaccggtgctcgatttagtatctgatagttgggtttggggggaagaggaagactgacggtcctgccacaggtggtgctgggcacggtgggcactcgacacaacattttgcgctcaactgtcttgtccagtgtgaggtgcagctggtggaggtccgggggagtcttagttcagcccgtgggggtccctgagactcttccgtgtgcagcctcgnggtattctaccttnagtacgctacgtggatgcctacgtcggtcccgaccaagtcctaccggaggggaacgggtcttggggtacgtcgggttcctacgtaacgttaagtttaacgtaggtggaacggtcgggatacggaaccaacgtacgtaccgtaacggtccggtaccgtacccgggtaggtaacgggggtaccctaacgtttaccaaacctagttcccgtaacaaacgggtaaccgaaacgtaaacccggacctaaaacggtaaccacggtccttagtaatcgtataaccgtaaattaccggaaatacggtttcgagtaacgggacctaccggggaaacggtccgacggttcgttaacgtttagttacgtttaacgtgttacgacgttaaacgtaggtaccaggtaccaggactacggtccgtaaacgggacccggttaccgtacccggtaaccggggtacgggccccgggtaaaccggtaaccgtccgggaacccttaccggttccctaacccgccgtcccgttaaccccg

SEQ ID NO: 120275 - DNA, 582 bp, Homo sapiens
  misc_feature: GYAE6OF01B8TRO.2.38.D05.1.454.CMB.1.raw
  modified_base (404)..(404): a, c, t, g, unknown or other
  misc_feature (404)..(404): n is a, c, g, or t
  modified_base (462)..(462): a, c, t, g, unknown or other
  misc_feature (462)..(462): n is a, c, g, or t
  modified_base (492)..(492): a, c, t, g, unknown or other
  misc_feature (492)..(492): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctctggattcaccttcagtagctactggatgcacgtgggtcccgcaagcctccgaggggagggctggtgtgggtctcacgtatttaataggtgagtgggatagcacaagctacgcggactccgtgaacggccattcacatctacagagacacgacaagacacgctgtatctagactaaatgaaacngtctaggagacgccggaaggaccacggtctggttagtattcgtggtagacgaaggtanatacgctagcaaggtccgtacgggtaaccncccggtaccgtacgggtcgggggaccctaaacggggtaaccccttcgggtacccttaacccggttcccgtacccgtcgacccggtccccc

SEQ ID NO: 120276 - DNA, 730 bp, Homo sapiens
  misc_feature: GYAE6OF01EB79U.2.38.D05.1.454.CMB.1.raw
  modified_base (658)..(658): a, c, t, g, unknown or other
  misc_feature (658)..(658): n is a, c, g, or t
  modified_base (686)..(686): a, c, t, g, unknown or other
  misc_feature (686)..(686): n is a, c, g, or t
tcagacgctcgacacacgaccggtgctcgatttagtatctgatagttgggtttgggggagccccagccctgggattcccagctgtttctgcttgctgatcaggactgcacacagagaactcaccatgggtagtttgggctgagtcgttgggtttttccttgttgtactttaagttttaaaaggtgtacctagtggtgaggtgcagtcgtgggtgggacgggtccgggggagtcgttagttcgacggtccggttcgggggtccctggacgtaccttccgtccgtggtcgacctacgtccgttcgtacggtacttccctaccttagtacgtacgccgttaacgtggtacgtcggtaccgtacggttccgggaccccgtaccgtaacgtccggtaccgggaacgggggtaacggggtcggttagggtcgggttcggtaccgtacgttaaggttaagtttaaggtaggtaggtaggtagggtaacgtacgacgtaacgaacgtccgtaccggacggtaccgtacgggtacggaccggtaccgtactaccgtacgtactaccgaaccgaagaaccgaaccctaacggaacctaaacgacctacggtactagtaaccgtgaacgaataacgtcgaatcgtagagacgcggaccgtagacgtgtntaggtacgttatagtgagacgagagtanacgcacgcgtacggtacgtacggcccgtacggtcggtaccgggg

SEQ ID NO: 120277 - DNA, 681 bp, Homo sapiens
  misc_feature: GYAE6OF01EY9FD.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctggaggcctcctatgagctgacacacgcccacccgtcggtgtcagtcgtcccaggacgacggacggccgaggtactccacctgctcgtggagtatgactagttcgaaccaaagactaatattcgtactttagttacggtaaccagacgaagaacgccgacggccgaccggtcccctggtcgcgtggtagtaattaagtaaagtaaagacgtaggtaggaacggaccggtaccgtacggacgggtacctacccggtagtacgtacgttacttcgtaccggtcggtcctaccgtacgtcgtacggaacgggaaccaacgtacgtacgtaaccggttacgaacctagtacgtagggtacgtacgtaccgaggaacgaaggaagtagtaggacgtacgtatacgttacttacgtacgtacgaactacgaagtcgaacgtagacgtagttacggttgggttttacggtttggggtcggttacggggcgggtaacgtacggtagtccgtacggtaccgtcgtacgaccggctaccggcgtcccgg

SEQ ID NO: 120278 - DNA, 976 bp, Homo sapiens
  misc_feature: GYAE6OF01DHTT3.2.38.D05.1.454.CMB.1.raw
tcagacgctcgacacacgaccggtgctcgatttagtatctgatagttggggtttgggggaagaggaagactgacggtcctgccacaggtggtgcgtgggcacggtgggcactcgacaacaactatttgcgctacaactgtcttgtccagtgtgaggtgcagcgttgggagggacgggtccggggggaggtacgtttagtccgacggtccgggtcggggggtccctaggacgtccttcctcgtgtcgacacgccttgtggtaacttcctaccgttagaagtacgtacgttacgtgtacgtacgtccgtaccgggtcggtacccgaccgtaacgccgtaacgggaggggtaacgggtcgtgggttacggtcggtactacgtaacgttaagttagtcgtaaggtcggtaggtacgaacgtacgaacgtaagttcccggaacgggtaccggtaccgtaccgggtaagggtaaccggggtaccttaagttaaccgactaaccgtacctaacggaacgaaaccgtaacggaaacccgaaaccgtaaacggtaaaccgtacccggtagtttaaccgtaacgttaccgtaaacggtaaacgtaaacggttaaaccggtaaacggtttaacgtaaccggggttacggaaaacggggaccccgggggttaaaacccgaaacgggggttaaaccccgtaccggggttaacctttaacggggttttaacgttttaaaccgtttacgggttaacgggtaacggttaaacccggaagggtaacgtaaaccggttaacggaaggtacccggttaccgtaaagggaccccggtttacggggaaaaacccccgtttccggggtaaaccggtaccccggggggtaaccggtaaaccccgggaaccccggggggtttaccctttacccgggtaaaccccgttccgtacccccgggtttacccctaaacccggttacccggttaaacccccccggg

SEQ ID NO: 120279 - DNA, 781 bp, Homo sapiens
  misc_feature: GYAE6OF01CJSY1.2.38.D05.1.454.CMB.1.raw
  modified_base (138)..(138): a, c, t, g, unknown or other
  misc_feature (138)..(138): n is a, c, g, or t
  modified_base (198)..(198): a, c, t, g, unknown or other
  misc_feature (198)..(198): n is a, c, g, or t
  modified_base (326)..(326): a, c, t, g, unknown or other
  misc_feature (326)..(326): n is a, c, g, or t
  modified_base (439)..(439): a, c, t, g, unknown or other
  misc_feature (439)..(439): n is a, c, g, or t
tcagacgctcgacacacgaccggtgctcgatttagtatctgatagctgggtttccttgttgctattttaaaaggtgtccagtgtgaggtgcagctggtggagtccgggggagcttagttcagcctggggggtccctgngactctcctgtgcagcctctggattcaccttcagtagctactggatgcacgtcgggtccnccaagctccgaaggggagggctgggtgtcgggtctcgtacgttaattacgtagtgtagtgggagtagactacgaagtccgtaacggcggtaccgttccggtaggaacgggtccctaagttccaacctntcctccgaagacgaaccaaccggacccaaaaggtaacccacgtccgttagtactcgtacggaactaaagtcgaaactggtacgtgaacggtacgccggaacggtacaccggtntacggttcgtacgttaactggtacaaagtaacggaagtacgtaacggacaggtaccgtggtaccgttacgggtaccgaccggtaccgttacgggtccggggaccctaaacggggtacccttcgggtaccctacccggttactaccccgtacgacccggttaccccgaaacccgtacccggtaaaccgggtcccccgttaacggttccccggtttaccccgtttcccccggaccgggttccccctaccccgttcgacccgtaccgggaaccggtaccctacccggaacccgttaccggacggtaccacccggtaaccccggtacgggccccgggttccccggg

SEQ ID NO: 120280 - DNA, 828 bp, Homo sapiens
  misc_feature: GYAE6OF01EAKLH.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggagcttagttcagccgtgggggtccctgagactctcctgtgcagcctcgtggtattccaccttcagtagctacgtggatgcacgtgggtcccgaccgaacgtccgtaccggaagggggaacggggcgttgggtcggtcgggtctaccgtaacgttaatttaagtagtggtagtggggtagtaacggacaacgtaacgtaccgtaccggccggtaccgttccgggtaggaaacggggtcccttaacttaccgaccctaagttccctaccgaaggaaccgaacaaaccccggaaccgaaacgaacccgacgtctaggttactacgtaacggaaataaaactacggaaacaggttacgtaggaacgacgggacccggtaacggaacgtcggtcgtaggttacttactttacggtgtacgagaaggtaacgtagtacgcgtaacgcgacggtacgtacgggaccgtaccggtaaccgtacggggaccgggtacccggaacgggtacccggtcgttaccccgtacccgttctacccgtacgtacccgacccgtacccgaaacccggtaccggtaccccgtaccggttccccgttcccccggttcccgtcccgggtacccgtccccgtaccggtcccgtaaccgggacggtaccccgtccccggaacccgtaccgggtaacgacccgggtcctaaacccgggcccggtcccggggtacccccgg

SEQ ID NO: 120281 - DNA, 882 bp, Homo sapiens
  misc_feature: GYAE6OF01DRIBP.2.38.D05.1.454.CMB.1.raw
  modified_base (790)..(790): a, c, t, g, unknown or other
  misc_feature (790)..(790): n is a, c, g, or t
  modified_base (814)..(814): a, c, t, g, unknown or other
  misc_feature (814)..(814): n is a, c, g, or t
tcagacgctcgacacacgaccggtgctcgatttagtatctgatagttgggtttgggggagccccagccctgggattcccagctgtttctgcttgctgatcaggactgcacacagagactcaccagtggtagtttgggctgagtcgttgggttttcttgttgtactttaagttttaaaggtgtcctagtgtggaggtgcaggtcgtgggtgggtacgggtccgggggtagttacgttacgttcgacggtcccgggtcgggggttacctggacgtccgtccttcgtgtagccgacgtcctgttgtcttacctaccgttactaggtactcgttaacggtaggacgttcgaccgtacggttccgggaccgaccggtaacgtcccggtaacgggaagggggtaacggggtcggttggggttcggtttaccgggttccttaacggttagtttaaaggtttaagtaggttaggtaacgggtgggtaaacggacgaaaccgtacggaaacggtaccggttcggaaccggtaaccggtccgggttaaacgggaacccgggtcccgttaaacttcccgaaccgttaccgtaccgtaccggaaacgaaacccgggtaaccgaaaccggtaaacccctaaaacggggtaaccctccggttaccggtttaactaacggtttagaaaacccgtaaacgtttaacgtaaaggaacccgtttaacgggtcgtacggggaacgaaacccgggttcggaaccgggtttaccgaacgggttgtttacgtaaccggtttgtttaaccggngtaacgacggtaaagtaggtaacngggttaccgaaaccgttcggacgtacccgggaaaggtcccggttaaccgaacccgggggttaccgggg

SEQ ID NO: 120282 - DNA, 742 bp, Homo sapiens
  misc_feature: GYAE6OF01AUFUW.2.38.D05.1.454.CMB.1.raw
  modified_base (579)..(579): a, c, t, g, unknown or other
  misc_feature (579)..(579): n is a, c, g, or t
  modified_base (597)..(597): a, c, t, g, unknown or other
  misc_feature (597)..(597): n is a, c, g, or t
  modified_base (607)..(607): a, c, t, g, unknown or other
  misc_feature (607)..(607): n is a, c, g, or t
  modified_base (632)..(632): a, c, t, g, unknown or other
  misc_feature (632)..(632): n is a, c, g, or t
  modified_base (714)..(714): a, c, t, g, unknown or other
  misc_feature (714)..(714): n is a, c, g, or t
tcagacgctcgacacacgaccggtgctcgatttagtatctgatagttgggtttgggggaagaggaagactgacggtcctgccacaggtggtgctgggcacggtggcactcgacacaacatttgcgctcaactgtcttgtccagtgtgaggtgcagctggtggacggtccgggggagtcttagttcgaggccggtcgggggtccctgacgtactcctccgtgtgccagtccttcgtggtacttcctaccttcgaggtacgtcctacgtaggatcgaccgtaccggttcgggtccccgaccgaacggtcccgtacggaagggggacggtcgttaggtggttacggtctacgtaagtttaagttaagtcggtagaaggtgggacgtaagacgtaacgaacggtccgtaaccggccggtaccgttaccgggaacgggtaccgggaaccctacgttcccaaccgtacgttaccacgaacgaacgtaacccgaaaccgaccgaaacgaccgacgtcgttagtactcgtaacgaactaaagtgaaaccgtgtacgaggaaccgacggtaccggaacggactccggntttagttattaagtacgngtaacggaanaagtacgtacgacgtacagtaccgngggtacccgtcgggaacccctacggtcggttacgggcccgggaaaccgaacccggttcccgtacccgtccccgttacccgtntttacccccgcgtacccccggtaccccg

SEQ ID NO: 120283 - DNA, 754 bp, Homo sapiens
  misc_feature: GYAE6OF01BGZ02.2.38.D05.1.454.CMB.1.raw
  modified_base (155)..(155): a, c, t, g, unknown or other
  misc_feature (155)..(155): n is a, c, g, or t
tcagacgctcgacacacgaccggtgctcgatttagtatctgatagttgggtttgggggaagaggaagactgacggtcctgccacaggtggtgcgtgggcacggtggcactcgacacaactatttgcgctcaacttgtcttgtccagtgtgaggtncagcgtgggtaggacgggtccggggagtcgtttagttcgaggtccggttacggggggtccctaggacgtaccttcctccgttgtgccacgtcctacgtacggtacttccgtaccgttcgaagttacgtaccgtacgtggattcgaccgacggttcgggtcccaacgaaacgcccgtacgggaaggggtacgggtgttgggtaggttcggtactaccgtaagttaatttagtaggtagtaggtaggtagacgacgaacgtagtacccgtaacggcgtaaccgtaggtacggaacggtcctagtacctaacgtccttacgaacgtaacgaacgaaccgaccgactaaacgacgtaacgtcgtagtacttacgtacgtaaactacgtaaacgtaacgttagtaccgagtaacggaacccggtacggaacggaccggtacggttacgtttaacggtttacttacggttactaggtaacgaacgtaaggtacgagttacgagttacagtaccgtgaaccgtcgtaacgtaccggtacggaccggtaccgaaccggttaccgtcccgtaccgttacccaccgttccgtaccgtcccgtaaccccg

SEQ ID NO: 120284 - DNA, 787 bp, Homo sapiens
  misc_feature: GYAE6OF01B2IN0.2.38.D05.1.454.CMB.1.raw
  modified_base (636)..(636): a, c, t, g, unknown or other
  misc_feature (636)..(636): n is a, c, g, or t
tcagacgctcgacacacgaccggtgctcgatttagtatctgatagttgggtttgggggtgggtccaggaggcagaactctgggtgtctcaccatggcctggactccctctacttcctccccctctttcacttctctgacacgaggctctggacggccctctatggacgtctgacacgagcccctacccgttcggtcgtcgacgtccgtaccccgaaggaccaacgggtaccggaccgaaggacctccgaccgttcgaccttgtacgggatacgtcgacctagttacgaaccaaagtactaattacgtcgttcgttttaacgttacggaccgacgtccgaaaacggaccgtaccgacggaccctaccggtccccgttagtcggaccggtttaggactaacttaaaggtaaaggtaaaccgacgtaggtacggaaccggcccggtaccgtaacggacggtaaccgttccgaggaccgtctttacgttccgtacgtccgtacgaccgagttccgaaggacgtactaacggtacgttccgagtacacgtagtacggtaggtacgtacgacggaagacggaagtacggtacggtagacgtactaagttacgttaacgtacctacgtaaccgacgtaaccgngtaaccgacgtaagaccggttacgtaacgggtttccggttagggttttacgggaccgggttaagggtccgggtaacgtaccggtaccggttccggtaccggttaccggtacggttacccgaacccggtaccgaccccggtacgtaccccgg

SEQ ID NO: 120285 - DNA, 845 bp, Homo sapiens
  misc_feature: GYAE6OF01AWNZW.2.38.D05.1.454.CMB.1.raw
  modified_base (204)..(204): a, c, t, g, unknown or other
  misc_feature (204)..(204): n is a, c, g, or t
  modified_base (247)..(247): a, c, t, g, unknown or other
  misc_feature (247)..(247): n is a, c, g, or t
tcagacgctcgacacacgaccggtgctcgatttagtatctgatagttgggtttggggggaagaggaagactgacggtcctgccacaggtggtgctgggcacggtgggcactcgacacaacattttgcgctcaactgtcttgtccagtgtgaggtgcagctggtggagtccgggggaggcttagttcagcctggggggtccctgngactctcctgtgcagcctctggattcaccttcagtagctacgnggatgcacgtcggggtccgccaacgcctaccgaaggggaacgggctggtggtcgggtctcacggtaatttaatagtgagtgggagtagcaacgaacgtcgtaccggcggaccgttcggtagaacgggggccgtaattccgaaccctaacgttccctaccgaaggtaacgaaccctaaacgacccaaaacggaaaccaccggacttagtaacgttctaggtaccaaaagttacggaaaaccctaaggtttccgtagggtaaacggaacggacccggggtaaagggaacccgtaaccggggcccgtttaagggtttacgttaacgttttaaccgttagggtaccgggtaacgtaaaaacgggtaggtaaaacgttaagggacccgaaaggtacccgaagggtaccgggtttaacggggtttaaaccccgggacccccgggttaaaacccgttaaccccgggttacggggggggggtaaaccccccgtaaaccggggggggtaaaaaaccccccccgtttcggggggttaaaccccgttaaccccccgggttaccccgttttacccccccgttccggtaaaaccccgggtaaccccccccg

SEQ ID NO: 120286 - DNA, 774 bp, Homo sapiens
  misc_feature: GYAE6OF01DT3L7.2.38.D05.1.454.CMB.1.raw
  modified_base (206)..(206): a, c, t, g, unknown or other
  misc_feature (206)..(206): n is a, c, g, or t
  modified_base (506)..(506): a, c, t, g, unknown or other
  misc_feature (506)..(506): n is a, c, g, or t
tcagacgctcgacacacgaccggtgctcgatttagtatctgatagctgggttttccttgttgctattttaaaaggtgtccagtgtgaggtgcagctggtggaggtccgggggaggcttagttcagccgtgggggtccctgagactctcctgtgcagcctctggtattccaccttcagtagcttacgtggatgcacgtcgggtcccnccaagcctaccggaagggggaacggggcgtgggtggtacgggttcctacgtaacgttaatttaaactaggtggtaacgtaggggtaagtacggacctaacgaacgtcgtaaccggccggtacctcggtaggaaccgggtcctattccaacctatcctcgaagacgaaccgtaaacgaccaaagaaccgcgtcgttagtacttcgtagaaactaaagtacgaacctagttacgaggacgacggaccggagacgacggtcgtgtttaagtacgtttcgtaggtcaaagaagtagtataccgngtaacgcgaacgtcgttacgggaaccctccggtaccgtacgggtcgggacccgtaacggtacccggtacgttcccgacccttcctacgaacccgtaccgtaccccgtacccgtaaaccgggaccggtcccctaccgttcccccgggttcccttaccccccgggtcgggcccccgttaccgtccggacccgttaccggacggtaaaccccgccggttaacccccgagggacggaaccccgtccgaccggccgggtcccggtccccgggg

SEQ ID NO: 120287 - DNA, 961 bp, Homo sapiens
  misc_feature: GYAE6OF01AR5EU.2.38.D05.1.454.CMB.1.raw
  modified_base (129)..(129): a, c, t, g, unknown or other
  misc_feature (129)..(129): n is a, c, g, or t
tcagacgctcgacacacgaccggtgctcgatttagtatctgatagttgggtttggggggaagaggaagactgacggtcctgccacaggtggtgctgggcacggtggcactcgacacaacatttgcgctnaactgtcttgtccagtgtgaggtgcagctgggtggaggtccgggggaggcttagttcagccgtgggggtcctgacgactctcctgtgcacgtcctcgtggacttccaccttcgagtacgctacgtggacgtgcgtacgtcggggtcccgaccaacggccgtacccggaagggggtaacgggggctttggggttacggttcggggttcctacgtaaccggtttaagtttaaacgttagggttaggtaacggttagggggaagtttaaccggacctaaaaccggtaaaccgggtacccggttaaacccggggtacccggggttaaacccggtttcccggggtaacgggggtaaaaccgggggtaccccgttaaaggtttaccccgaaacccgtacggtttccccgaaacccggaacgggtaaaccggaaacccaaacccgggaacccccgaaaaggtaaaccccgacggtaccgtttacgttaaccgttaccgttaacggtaaacctaaaacggttaccggtaaacgtacggtttacgaacgggaacggaacccgggtacccgggaaaccgggtaaccgtaaccggggttccgtttaggttaacgttttaaacgttttacggtaccggtaaggtaaaccggtaaaggtaaaccggtaggttaaacgccgtaaacggtcggtaccgggttacccgggttaacgggtaaccccggtacccggttaacccgggttaccgggggtacccgggggacccggtaaaccggggttacccccgttcggttaccccgttacccggttaccccttacccgtaccggtacccctaaccccccggg

SEQ ID NO: 120288 - DNA, 775 bp, Homo sapiens
  misc_feature: GYAE6OF01AHLTP.2.38.D05.1.454.CMB.1.raw
  modified_base (138)..(138): a, c, t, g, unknown or other
  misc_feature (138)..(138): n is a, c, g, or t
tcagacgctcgacacacgaccggtgctcgatttagtatctgatagttggggtttgggggtgggtccaggaggcagaactctgggtgtctcaccatggcctggatccctctacttcctccccctcttcactctctgcanaggctcgtgacggcctctatgagctgacacaccgtcccaccgttcggtgtcgtaggtccgtcccgaaggacgacgaccggaccgtaggactccaccgttgtaccgttcggtaggacgtagtcgtactacgttaccgaaccgaaacgactaattactcggttaacgttttacgtacggtaccgagtaacgaaggtaacccgccgaccggtaccgacccggttccgtggtcggtcggtaggtagtaataaagtaacggaaagtcgtaaggtacggacgtaccggtaccctagggtaccgtaccgtacccgtaggtaaccgtcgtttaccttcgtccggtacccgtacgtccgtaacggaccgtaacgacgaaacgtacgtcgttaacgtacgtacaacgtacgtcgtaggtccgaacgtacggagaagacggaagacgtaggacgtactacggttaatacgtcgtaacgtacgtacgtaccgagttaacgagtacgtacggttaacggtttacggtttacgggtttcggttacgggggtaccggttacgggtaaacggtacccggtaacggtcggttaaaccgggtccgttaaccgtcgggtaaccgtaaccggtcccggacccgttcgggtacccccg

SEQ ID NO: 120289 - DNA, 797 bp, Homo sapiens
  misc_feature: GYAE6OF01A3GZL.2.38.D05.1.454.CMB.1.raw
tcagacgctcgacacacgaccggtgctcgatttagtatctgatagttgggttgggggtgggtccaggaggcagaactctgggtgtctcgtaccatggcctggtatcctctacttctcccctcttcgactctctgcacaggctcgtgacggcctcctagtcgacgtctagactacacgtccacccgtcggtgtcaggttcgtccccgaggacctaggacggccaaggactccaccgttggcctcgtaggacgtatcggcagttcgaccaagtgtaatatcgtactttagtacgtaccagacaagtacgccgacggacctacggtccccgtaggtcgtacgttaggtacgtaacgtagtaaacgttaacgacgtacggttacggaacgggtaccggaccgtaccggtaaggggtacccttacccggtacgtaaacggttccgtttaactttcccgtacggttacgggtaacccttaccggaacggtcccgttaaacgggaaccggggtaaacctaaccggtaaacgttcccggtaacgtaccgtaaccgtacgttacggttaacggtacgttaacggtacccgaaggtaacgaaacggtaacgtaacgggttacggaaaccggttacccgtaggtttaaacctttaaccggttaacgttacgtaccggtaaacttcggacgttaacggacggacccgtagtaccggttaacgttcgggttttaccggttcgacgggtaccggacggttaacgacgtagccgtaacgtccgtaacgttacacgtccgaccgtcgtcccgg

SEQ ID NO: 120290 - DNA, 869 bp, Homo sapiens
  misc_feature: GYAE6OF01AVQWC.2.38.D05.1.454.CMB.1.raw
  modified_base (407)..(407): a, c, t, g, unknown or other
  misc_feature (407)..(407): n is a, c, g, or t
tcagacgctcgacacacgaccggtgctcgatttagtatctgatagctgggttttccttgttgctattttaaaaggtgtccagtgtgaggtgcagctgggtggaggtccgggggaggtcttagtcagtccggtggggggtcctggatactctcgtgtgcacgtcctcgtgtacttcctacttgagtacgcttacgtggtatgactacgtcgggtccacgaaggccgtacggtaggggacgggtcgtggttagggtcggttacgtcgtaacgttaattaagtaggtgtaggtgggtacgtacgacgtaacgtacggtccgacggtcggtaccgttacggggaggaaccggtacttcttacccaactgttcccgacgaaaggaacgaaccgaacgtaccgaaagtacccncgtcgttatacttcggaagaaccttaaacgtcaaccgtaggttccgaaaggacggtacccggtaggaacggtacgtcgggtattacggtttaacttacgggtcctaaggggcgtaaaacgtaaggtacgacgttaacggacgtacgtaacggtacggttacccgggtaacgggtacccgtaaccgggtaccggtaaccgggttacgggggaacccggttaaacccgggtcccggtttaccggtaccggtacccctccggttaaccgtccgaaacccgtccccgtaacgggtaacccggtacccggttcctaccgggtttacccccggttaccctccggggcccgggttacctcccgggtacgttacccgggaccgggtaaccggtcccggtccccgttaaaggacccgttaaaccgggaccccgtaagggttaacccggccggggtcccgggtaaaccgggg

SEQ ID NO: 120291 - DNA, 891 bp, Homo sapiens
  misc_feature: GYAE6OF01AYZ7I.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagcttgggttttccttgttgtcttaattttaaaaggtgtccagtgtgaggtgcagcgtggtggaggtccgggggaggtcttaggttcaggtccggtcggggggtccctggacgactctcctgtcgcacgcctcgtggtacttccaccttcagtacgtcttacgtggatgccgtaacggttcggggtaccccgaccgaacggtccgtacccggaagggggaacggggtcggttggggtacgggttcgggttaccgtaccgtaacggtttaaagttaaacgttagggtacggtaaggttagggggtaagtacggtaccgaaaccgaacggtaccgtaacccgggaacccgggtaaccgttacccgggtaacgggtaaaccggggtccccgttaacgttacccgaaacccgtacgttacccgtaacccgtaaaggaacccgtaaacccgaaaacccggtaaccccgaaaaacggtaacccgaacccggtaccgtttaacgtaaccgttaccgtaaccgtaaacgtaaacggttaaccgtaaaccgttaacggttacgtaagggaaccggtaaccgggaacccgggtaaacgggtaaccggtacgggtaccgtttagggttaaccggttaacgtttaccggtagggtaaccggtaaaccggtaaaggtaaaggtacggtaaacggaccgaagggaccgtaacggtacccggttaaccgggtaaccccggtaccggttaaccgggttaacccggggg

SEQ ID NO: 120292 - DNA, 768 bp, Homo sapiens
  misc_feature: GYAE6OF01BYVIK.2.38.D05.1.454.CMB.1.raw
  modified_base (489)..(489): a, c, t, g, unknown or other
  misc_feature (489)..(489): n is a, c, g, or t
  modified_base (583)..(583): a, c, t, g, unknown or other
  misc_feature (583)..(583): n is a, c, g, or t
  modified_base (678)..(678): a, c, t, g, unknown or other
  misc_feature (678)..(678): n is a, c, g, or t
  modified_base (743)..(743): a, c, t, g, unknown or other
  misc_feature (743)..(743): n is a, c, g, or t
  modified_base (753)..(753): a, c, t, g, unknown or other
  misc_feature (753)..(753): n is a, c, g, or t
tcagacgctcgacacacgaccggtgctcgatttagtatctgatagctgggtttcctgtgctaatttaaaggtgtccagtgtgaggtgcagctggtgaggtccggggagtcttaggtcagtccggtcgggggtcctgacgctctccgtgtgcacgcctgtcgtattccaccttgaggttacgcttacgtggtacgttgaccgtacgggtccgggaccacgtaaggccgtaccgggaaggggtaacggggtccttagggtcggtacgggttacctaccgtaagttaagtaaacgtcggtaggtaaggttacggggaattacgacgtaacgtaaggtcccgttaacgggccgtaacgggttccggaagggtaaccggggtacctacttacccggaaaccttcgtacccgtaaccgaaggaacctaacggaaacccacgtaaaaccgaaccgtcgtaccgtacgtacgttagtacacgtaaaagtccggtaanccggttacaaggaacggtaacgacggacggtagtacccggtatttaggacgttactttaacggcggtaacgaacgtagcgtaagcgtacggtanacgtaggtccgtaacgaccggtacacggtacggtcgggacctaccggacggtactacggtccttaccgtccgacgtacctccgaacccggtaacncccgggtacacttccgccccctacggtccgacccgtctaaccggtactggacgactccgaacccngaccggtacngtcccgtgcccgtgg

SEQ ID NO: 120293 - DNA, 754 bp, Homo sapiens
  misc_feature: GYAE6OF01A31AB.2.38.D05.1.454.CMB.1.raw
  modified_base (245)..(245): a, c, t, g, unknown or other
  misc_feature (245)..(245): n is a, c, g, or t
  modified_base (545)..(545): a, c, t, g, unknown or other
  misc_feature (545)..(545): n is a, c, g, or t
  modified_base (630)..(630): a, c, t, g, unknown or other
  misc_feature (630)..(630): n is a, c, g, or t
  modified_base (662)..(662): a, c, t, g, unknown or other
  misc_feature (662)..(662): n is a, c, g, or t
  modified_base (735)..(735): a, c, t, g, unknown or other
  misc_feature (735)..(735): n is a, c, g, or t
tcagacgctcgacacacgaccggtgctcgatttagtatctgatagttgggtttggggggaagaggaagactgacggtcctgccacaggtggtgctgggcacggtggcactcgacacaacattttgcgctcaactgtcttgtccagtgtgaggtgcagctggtggagtccgggggagcttagttcagccgtgggggtccctgagactctcctgtgcagcctctggattcaccttcaagtgctacgnggatcgcacgttcggggtcccgaccaacgtccgtaccggaaggggggtaacggggtccgttggggttacgggttggggtccttaccggaacgtttaagtttaaaagtggtaggtaggttacgggggaagttacgaccaaacgtaacggtaccgttaaccgggtaccggtacccggttaccggtaagggaaccggggtacccgtatttaccgacctaacgttccgtaccgaagtaaccgaaccaacccgaccaaaacggtaaccacgtcttacgtacgtactagaacgtaaatcggtaaanacgggtttaccgagggaaccggacggtaacccgggaacggaccggacggttaccgttgggtttaattaacgtttcgacgggttanaacccgtaaagggcctaagtacggcaagtcgngtccggttacggacccgtaccgtaggtaccgggcgggacccggaacggttcccgacgttcccaaccgttcccnccggcgccccgtaacccgg

SEQ ID NO: 120294 - DNA, 745 bp, Homo sapiens
  misc_feature: GYAE6OF01AR6OZ.2.38.D05.1.454.CMB.1.raw
  modified_base (192)..(192): a, c, t, g, unknown or other
  misc_feature (192)..(192): n is a, c, g, or t
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
tcagacgctcgacacacgaccggtgctcgatttagtatctgatagttgggtttgggggaagaggaagactgacggtcctgccacaggtggtgcgtgggcacggtggcactcgacacaacatttgcgctacaacgtgtcttgtccgagtgtagaggtgccagcgtggtggacggtccgggggagcttagtccncgccggttggggtcctgactactctctgtgcagctgtgcttcaccttnagtcgctagtgatgcncgtcggtaccgcgaacgccgtacggagggacggtcgtcggtggtcggttacctacgtaacgttaagtttaagtgtagtagttagggattaccgaacgaacgaacgtaccggaccggttaccggaccgttaccggtaacgggaaccggtaccgtaacttaccgaacctaacgtcccgttaaccgaacgggaaccgaacccggtaaacgaaccgaaaacccgtaaaccgtcggtacctaacgttactaccggtacaaacgtaacgtaaccgtaacgtaccgtaacgtacggaaccggacgggaaccggtaaccggtaaccggtaaccgttcgttaacgttacgtttactccggttaagtaccgaacgtaagtaaggacttaggacctagacggtccgtacggacccgtaccggtacgtaaccggtacgggaccggtaccgggaacccgtacgttcgtaccccgtaccttccgaaccgtcgcccgtaacccg

SEQ ID NO: 120295 - DNA, 840 bp, Homo sapiens
  misc_feature: GYAE6OF01CR2E1.2.38.D05.1.454.CMB.1.raw
  modified_base (194)..(194): a, c, t, g, unknown or other
  misc_feature (194)..(194): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcacttctctgcacgaggctcgtgacggcccttcctatgagctacgacacgacgccctacccgtcgggtntcgagtccgtaccccgaggaccacggaccggccgaggtactccgaaccgtgtccttcggtgggacgtagtcggtactaagttccgaaaccgtaaaacacctaagttagttcgttacttttagttacggaaccgaggaacgtaaggaaaccgcccggaacggtaccccgacccgggtccccgttagggtccgtcggtaggttagtaaacgtttaaaagttaacgtaaaacggaacgttaagggtaccggggtaaccggtacccggtaccccgtaagggtaaccgggtaacccgtttcccgaacgggttcgttacgtaccctttccggttccgacgggtccccttacggaccggtccgaaacggaacggtaaccgaaacggtcgttaccgtaccggttaccgacctaacgttacgggacgtacgggtacccggtacgaaggacgtaaaggacgaaggttcggacggtacgttaacgtaccgtttaagtttacgtaacgtaacttaacgtaccggagacgaacgagtacgtggtaagggttttcgttttacgggttggggtacccgttaggggccggggttaactacggtccggtacgccggttacccggtacgtacggtaccctaccggaccgttcccgggtaccccg

SEQ ID NO: 120296 - DNA, 929 bp, Homo sapiens
  misc_feature: GYAE6OF01BQ4CB.2.38.D05.1.454.CMB.1.raw
  modified_base (153)..(153): a, c, t, g, unknown or other
  misc_feature (153)..(153): n is a, c, g, or t
tcagacgctcgacacacgaccggtgctcgatttagtatctgatagttgggtttggggggaagaggaagactgacggtcctgccacaggtggtgctgggcacggtggcactcgacacaacatttgcgctcaactgtcttgtccagtgtgaggtncagctgggtggaggtccgggggagtcgttagttcgacggccgttcggggggtccctaggacgtacctcctccgtgtggaccgacgtccttcgtaggtacttaccacctttacagtacgtactacgtggtatacgtccgtacgtcgggtacccgaccgtaagtccgtacgggaacggggtaacgggtcggttgggtcggtacgggttaccttacgtaacggtttaagttaacggtaggttacggtaggttacggggtaagtaaccggaccgtaaacggaacgtaccggttaaccgggaacccggttaaccccggttaccgggtaaacggggtaaccggggtaccgttaaccgttacccgaaaccgttaacccgtttacccgaaccggttaaaacggaacccgggttaaaccgaaaaccccgggtaaacccgaaaacccggtaaaacccgtaccgggttaaccgtttaacgttaccgtacggttaaaccgaaacgttaaaccgtaacgtaaacggttaacggttaccgggaacggtaccggaacgggaacccgggtaacgggaacccgtaacggttacggtttacggtttaacgttaacgtttaacggtcgttaaccggaggaaacggtaaacgtaaggttacgacggtaggaccgtacggtacggtacccgggtaacccggaccggtaaccgttacccggggcgggttaaccccgggaaccggttacccggtacggtacccctacccggttccacccgttcggaaccccgtaccccg

SEQ ID NO: 120297 - DNA, 722 bp, Homo sapiens
  misc_feature: GYAE6OF01D978U.2.38.D05.1.454.CMB.1.raw
  modified_base (201)..(201): a, c, t, g, unknown or other
  misc_feature (201)..(201): n is a, c, g, or t
  modified_base (375)..(375): a, c, t, g, unknown or other
  misc_feature (375)..(375): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctacgtggatgcacgtcgggtccnccaagctccgaggggagggctggtgtgggtctcacgttattaatagtgagtgggatagcacagccgtacgcggactccggtaggaacgggcctattccacctatcctaccaagacgaacaacccgaccaaaagaaccaccgcttgtaacttcgtaggactaaaagtgaaaaccncggttcaggacgacgacggacggacgcggtctgtagtacttcgtggtacgacaaggagtagtagacaaggacgtcggtacggttacgggtaccggtacccggtaccgtaaccgggtccgggggaacccgtaaccggggtaccccgttaccggtccccgtacccgtccctcccgtccgacccgtaccccgtacccgaacccgggtaccggacccccgtacggttccccggttcccccgttcccccgtcccgggtccccgtaccccgtccgtcccgtcccgacgggtcccacccgtaccccgtacccgacgtaccgaccgaacccggtccgggccccgggtccccgggg

SEQ ID NO: 120298 - DNA, 801 bp, Homo sapiens
  misc_feature: GYAE6OF01D6TSH.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctcccctcttcactctctgcacaggctctgacgcctctatgagctgacacacgccctacccgttcggtttacacgttccgtaccccgagggaccgaggaccggaccaagggtactccgaccgtggtcctcggtagggaacgtgtcgctaacgttccgaaccgtaaagactaattacgtcgtacgttttacgttacggtaaccagtacgaacggtaacgacccgagggacccgacggtccccgtaggtcggtcggttaggtacgtaattaacgtaaagttaaacgacggtaggtaggacggtaccggtacccgtacggtaggtacctccgtaggacgtccgttacttccgtcgtacggtcctaccgacgtaccgtacggaccggggaaactaaaccggtacgttacccgtaacgttacgaacccgttagtacggtaggtacgggtacgtacgacggtaacaaggacggtagtaggcgtaacgtacggtacttaacgtttacgactaacgtaacgtaccgtaacgacgtacgaaccgtacggtaccgttagggttttacggtttaacggggtttttcgggtacgggttaccggggtacgggaacgggtaaccacgggttacggtaacccgggtaccgttacggtaaccggtacggacccggtccggtaaaccgtccccggttaccccgg

SEQ ID NO: 120299 - DNA, 819 bp, Homo sapiens
  misc_feature: GYAE6OF01BQTF8.2.38.D05.1.454.CMB.1.raw
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
  modified_base (255)..(255): a, c, t, g, unknown or other
  misc_feature (255)..(255): n is a, c, g, or t
  modified_base (616)..(616): a, c, t, g, unknown or other
  misc_feature (616)..(616): n is a, c, g, or t
tcagacgctcgacacacgaccggtgctcgatttagtatctgatagttggggtttgggggtgggtccaggaggcagaactctgggtgtctcaccatggcctggactcctctaccttcctcccctcttcactctctgacacaggctctgacggccttctagtgancgtnaccgacacgccctaccgtcggtcgtctaggttccgtaccccgaaggacaggtaccgcgtaagactccacgtgaccgttacgaggaagngtcgacttagttaccggaaccaaaagtactaaacttaattaggtaaaccttttaggttaaccggtaacgaacggtaaccgaaacggaacggtacccgtaacgggaaccggtacccggtacccgttagggaccgtaggtacggttagaacgttaaactaagtaaaacgtaccgttaaggaaggaccggttaaccgtccgtaacggaacggccttaaccccggaggtactaacggtttactcccgtaggtctacccgttagcgaacgtaccgggaaacgtaacgaaacgttacggtacgtaacttaccggaacctacgtaccgagggtacgtaaccggtacaaggtaacaaggagttaacggnggtaccgaagttaacgtaactttagtactaacggtaactaagtacggaactacgaaagttacgacgttaccgttaaggtttaccggttttcgggtttagggcccgggttaaacgggggcgtaaaaccgggagttacgtcccgggttaaacttaccccgggtaagtacgtaaacccggtacgtacccggggtaactaccccggg

SEQ ID NO: 120300 - DNA, 714 bp, Homo sapiens
  misc_feature: GYAE6OF01APG5H.2.38.D05.1.454.CMB.1.raw
  modified_base (410)..(410): a, c, t, g, unknown or other
  misc_feature (410)..(410): n is a, c, g, or t
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
  modified_base (686)..(688): a, c, t, g, unknown or other
  misc_feature (686)..(688): n is a, c, g, or t
  modified_base (690)..(691): a, c, t, g, unknown or other
  misc_feature (690)..(691): n is a, c, g, or t
  modified_base (693)..(694): a, c, t, g, unknown or other
  misc_feature (693)..(694): n is a, c, g, or t
  modified_base (697)..(697): a, c, t, g, unknown or other
  misc_feature (697)..(697): n is a, c, g, or t
  modified_base (699)..(704): a, c, t, g, unknown or other
  misc_feature (699)..(704): n is a, c, g, or t
  modified_base (707)..(707): a, c, t, g, unknown or other
  misc_feature (707)..(707): n is a, c, g, or t
  modified_base (709)..(710): a, c, t, g, unknown or other
  misc_feature (709)..(710): n is a, c, g, or t
tcagacgctcgacacacgaccggtgctcgatttagtatctgatagttgggtttgggggagccccgagccctgggattcccagtcttgtttctgcttgctgatcaggactgcacacagagactcactatcggtagttggtctgcgtcgttggtttcttgtctacttaagtttaaggtctcgtgtgtgaggtgctagtcgtggaggtacggtccggggtagtcttagtcgtacgggtccgggtcggggtcctgtacgtcttccgtccgtgtcgacctcggttccttgtacgtcttccgtacgtgtacgttacgcgtacgtgagtcgacgtacggtccggtccaccgtaggtccgtacgggtagggcggtcgtaggtcggtcgtactacgtagttatagtgacggtgtaggancgtatacgtacgcgtcggtacncggtacgaggaccgtntactacctactaccgtactacgaacgtacgaaccgtaaccgaacggtaacctacggtaccgtacttaacgtacccgtaaacgttacggaaaacccctttaaaagggtaaccccgtttaaaacccggggtaaaccggttttaaaaccgggggggaaacccccgggggggttttaacccccccggggggttttaaaaaaaaaacccccggggtaccccccccccccgggggggtttttannntnntnngangnnnnnnacnanngtcg

SEQ ID NO: 120301 - DNA, 713 bp, Homo sapiens
  misc_feature: GYAE6OF01DRY8Q.2.38.D05.1.454.CMB.1.raw
  modified_base (166)..(166): a, c, t, g, unknown or other
  misc_feature (166)..(166): n is a, c, g, or t
  modified_base (180)..(180): a, c, t, g, unknown or other
  misc_feature (180)..(180): n is a, c, g, or t
  modified_base (358)..(358): a, c, t, g, unknown or other
  misc_feature (358)..(358): n is a, c, g, or t
tcagacgctcgacacacgaccggtgctcgatttagtatctgatagttgggtttgggggtgggtccaggaggcagaactctgggtgtctcacatggcctggactccctctacttctccccctcttcactctctgcacaggctctgacggcctctatgagctgacacncgccaccgtcggtntcgagtcgcccgaggacaggaccgccaggactccacctgctcgtaggatatgactagttacgaaccaaagactaatgtagttactttaggttacggtaacgaacgacgaacgaacgaccgacggtacccgacggtccccgttggtcgtcggtggtaatagttaaagtaacgtaaacgngtaggtagacggtacgccgtacggaacggtcctccgagcgtacgttacttcgtcggtcgtaccgtacgacgtcgacggacgaactacgtcgtacgtcgtacgactgacgtggtacgacgtacgaagtaacgagtaacgtagtcggtacgtacttaagtacttaacgttacgtctaacgacgttaacgaccggtagaaacgtcgtaacggtacggttacggggtttttacgttttaacggggtttcggtaacggggtcgggggaaacggttaacgggacctaacgggtacccgttacggttaacccggtaacggttaccgggacctaaaccccgggcggttaacccggtaccccgg

SEQ ID NO: 120302 - DNA, 799 bp, Homo sapiens
  misc_feature: GYAE6OF01AVHXL.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagcttggacacagccaccctcggtagtcagtgtcccaggacaggacgccaggatccgactgactcgtacggagtagtcgactattcgaccgtaaaagacctaattacgtagttcgtttaacgttcggttaacccagaccgtaaggtaaccgtccgtaaccgggtacccgtacggggtccccccgttaggttccggtacggtttacggggtattaacgttaaacttaaacgtaaaacgtaacgtaacgggtaggtaacgggaccggtacccttacgggaacgggtaccgttaccgtacggtaacggtccgttaacgtttccgttccgtacggtcccgtttcgaacggtccgtaacggtaacgggtaaccaaacgtaccggttaccgtaaccggttacgaacccgttaaggtccgtaacgggttcggtaacccgtaccggaacggtaccgtaaaggaacgtacggtacgggtacgtacgtacgtaaccgttaattaaccgtgtactaagtccgaacgtcaacggttacacgggttacgttacggtttcgttaacggtttttcggggtacgggttacggtaccggtacgggtaactcggtacctcggttacccgtacgacgttaccgacggtaaccgcggttacccg

SEQ ID NO: 120303 - DNA, 654 bp, Homo sapiens
  misc_feature: GYAE6OF01BUL5P.2.38.D05.1.454.CMB.1.raw
  modified_base (141)..(141): a, c, t, g, unknown or other
  misc_feature (141)..(141): n is a, c, g, or t
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (401)..(401): a, c, t, g, unknown or other
  misc_feature (401)..(401): n is a, c, g, or t
  modified_base (443)..(443): a, c, t, g, unknown or other
  misc_feature (443)..(443): n is a, c, g, or t
  modified_base (467)..(467): a, c, t, g, unknown or other
  misc_feature (467)..(467): n is a, c, g, or t
  modified_base (626)..(626): a, c, t, g, unknown or other
  misc_feature (626)..(626): n is a, c, g, or t
tcagacgctcgacacacgaccggtgctcgatttagtatctgatagtttggggtttgggggacgccccagccctgggacttcccagctgtttctgcttgctgatcaggactgcacacagagaactcacatggtagtttgggntggacgtcgttcggtttccgttgttgtacttaagtttaaaggtcgtcagtggtgagggtncagtcgtaggtggacggtccggggngtacgttacggtccgaggtccggtcgggggtcctggacgtactctccgtgtccgcgacgtcctcgtagtcgttacctactactaacggtactacgtacgtggatcgacgtacgtccggtccacgtacgtcgtaccggagggtacgcgtaggtcgtgggtactctaggtacttaanggtagtgcggtagacgtacgagacctgacggtctacgtacgngggacccgtaccgtagtacccgtnaccgtcgacgtacgaaccgaacacccgaagaaacgctaaccgtcgttcgtacgtaactcgaactaagaccgtaagtactacggtacaacggtccgacggtacgacgacgttcgtagtagttaccgtataggactagaagtctagacggacacgtcaagngggttacccacggcgtaaccgtccgggg

SEQ ID NO: 120304 - DNA, 1017 bp, Homo sapiens
  misc_feature: GYAE6OF01A3Y1H.2.38.D05.1.454.CMB.1.raw
tcagacgctcgacacacgaccggtgctcgatttagtatctgatagttgggtttgggggagccccagccctgggattcccagcttgtttctgcttgctgatcgaggactgcacacagagaactcaccatggtagtttggctgagtcgttgggttttccttgttagtactttaaagttttaaaaggtcgtacgtagttggtaggtaggtcgcgtaggtcgttgggtgggtacgggtaccgggggtaggttacgtttaggttccgacgggtccgggttccggggggttaccctaggtaaccgtaccgttccgttccgttcgtcggaccgtaccggtccgtttcggtacggttacctttacccttacccgtttacggtaacggttacgtaccgttaacggttacggaacgttcggtaccgtaaccgggttccgggtaccccgaacccgtaaccggtaaccggtaaccggggttaacgggggtaacgggttcggttggggtttacgggttccgggttaccgttaaaccggttaacggtttaaagtttaaacggttagggttacggtaacgggttaaggggtaacgtaacgtaaccgaaacggtaaccggtaccggtaaccgggttaccgggtaaccggttaccggggtaaacgggtaacccgggtaccgttaaaccgttacccgtaaccgttaccgttacccgtaacggaaacggggtaaaccgaaacccccgaaaccggtaaaacccgaaacgtacccgggtaacttagggtttaactacgtaaccgtaaccggaaactaaacgttacgaaagttccggtaacggaacgtaccgggaaccggtaccgggtaacgaccgttagggttcccgttaagttaacgttacgttaagggacggtaaacgtaaaacgggtaaccgttaacggaacgggtaaccgacccggtaaagtacccgggttacggggtccccggttaaaaaccggggtcccccttaaaccgggtacggggttaaaaccccgggg

SEQ ID NO: 120305 - DNA, 811 bp, Homo sapiens
  misc_feature: GYAE6OF01BLVKZ.2.38.D05.1.454.CMB.1.raw
  modified_base (411)..(411): a, c, t, g, unknown or other
  misc_feature (411)..(411): n is a, c, g, or t
  modified_base (515)..(515): a, c, t, g, unknown or other
  misc_feature (515)..(515): n is a, c, g, or t
  modified_base (658)..(658): a, c, t, g, unknown or other
  misc_feature (658)..(658): n is a, c, g, or t
tcagacgctcgacacacgaccggtgctcgatttagtatctgatagttggggtttgggggtgggtccaggaggcagaactctgggtgtctcaccatggcctggactccctctacttcctcccctcttcactctctgcacgcggctctgacgccttcctagtcgacgcgtacgaaccacaccgccccgtacccgtcgggttactcgtaccggttccgaccccgagggaccacggaccgggaccgaaggacctcctaccgtcgtacgtggtggaacgtgtacgctagtacgaaccgaagtactaacgttagtgtacgtttacggttaccggaccgaggaacgaaaggacccgaccggtaccgggaccgacccggtccgtagtcggtacggtacgtaacgtaataaacgttaaanaacggtacggtaggtacggtaaccgggccccggtttaaccgggttacccggtaccgtacccggtaggtaaccgggcttttacgttccggtacccggtcgtaccnccgttaccggacttaaccgggaacggacaacggtactccggtgttacgaccgtaacgtcgtacggtacgggtacgtacggacgtacggagtaacgaacggtaggttaacgtccggtaacgttaactacgtttacgaacgttanaaccgagtaaccgagtaccgaggtaacgtcggttaggttaccgggtttggttaacggtcgggttaacgggcgggttacgaccgtaaccgggtcacccggttaaccggttcgggtaccgacccgtacggtaccccaccgggttcccgtaccccg

SEQ ID NO: 120306 - DNA, 917 bp, Homo sapiens
  misc_feature: GYAE6OF01CZ56W.2.38.D05.1.454.CMB.1.raw
  modified_base (900)..(900): a, c, t, g, unknown or other
  misc_feature (900)..(900): n is a, c, g, or t
tcagacgctcgacacacgaccggtgctcgatttagtatctgatagttgggtttgggggaagaggaagactgacggtcctgccacaggtggtgcgtgggcacggtggcactcgacacaactatttgcgctcaactgtcttgtccagtgtgaggtgcagcgtgggtggacggtccgggggagtcttagttcgacggtccggtgggggtccctgacgacctccttccgtgtcgccacgtcccgttcgtacggtacttcccgtaaccttacgtaacggttacgtaccgttaacggtaggtacgtcgaccgtaccggttacgggtaccccgaaccgtaaacggtcccgtaaccggggaaggggggtaacggggtcggttacggggttgggtacgggttcctaccgtttaaaggttaaacgttttaaaggtacggttaggtaacgggttacgggggtaacgtaacggaccgaaaaccggtaacgtaaccccggttaacccgggaccccgggttaaccggtttacccggggtaacgggtaaaccgggggacccgtttaaaccgttaccccgtaaaccgtttaacccttaaccccgtaaccggaaacgggaaacccgtaaaaccccggaaaccgtaaaccccgaaaaacggtaaccccgtaaccggttacgtacgttaacgtttccgaaaccggtaaactaaacggttaacccgaacggttagtaccggtaaggaaccggtacgggaaccggaccgggaacgtacgggttactttagggttacgtttaacgtcggtaacgtaacgaagtaacgggaagttcgaacgtacgaacgccgtaaggtcgaaccggtaccggtaccgtacggtacccgggacggacccgaccggtacgccgtacccgactccncctaccggcttaccccg

SEQ ID NO: 120307 - DNA, 641 bp, Homo sapiens
  misc_feature: GYAE6OF01EOV5Z.2.38.D05.1.454.CMB.1.raw
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
tcagacgctcgacacacgaccggtgctcgatttagtatctgatagttgggtttgggggaagaggaagactgacggtcctgccacaggtggtgctgggcacggtggcactcgacacaacatttgcgctcaactgtcttgtccagtgtgaggtgcagctggtggaggtccgggggaggcttagttcaggccgtggggggtccctgagactcgtcctgtgcngcctntgattcaccttcagtagctacgtggatgctacgtcgggtcccgaccaagcctaccggaggggagggtctgggtggtcggtctcgtaacgttattaaagtggtacgaggtagggatagccaagagcgtacggccgtacgtcggaggaacggccgattccactntcncaaganacaacgcaagaccngctatatctagactaatagaactagtctaggacgacggacggaacggaccgtcggtcgttgttagttaaccgtttagtcgtagagaaacgtagtaacgtacgactaggacgtacggtcgtaacgggaccggtaacgtaccggttaaccggtacgggggtaaccccggaacggggtaaccctcggggttacccctaccggtaccccgttaccgtacccgtacccgtacccccg

SEQ ID NO: 120308 - DNA, 793 bp, Homo sapiens
  misc_feature: GYAE6OF01DQET9.2.38.D05.1.454.CMB.1.raw
  modified_base (183)..(183): a, c, t, g, unknown or other
  misc_feature (183)..(183): n is a, c, g, or t
tcagacgctcgacacacgaccggtgctcgatttagtatctgatagttgggtttgggggaagaggaagactgacggtcctggccacaggtggtgctcgggacacggtgggcactcgacaacaactatttcgcgctcaactgttcttgtccagtgtcgaggtgcagcgtggtggaggtccggggngtcgttagtcgaggtccggtagggggtccctggacgctcgtcgtagtgacacgtcctcgtggtacttctaccgttagtagttacgcctacgtgtacgtcgcgtacggttccggtaccgaccgtaacgtccgtaccgggaagggggtacgggtcgtgggtcggtcggtctacgttaagttaattaaggtaggtggtaggtacgggtaagacgtacgaacgtaacggtccgtaacgggccggtaaccggtaccggtacgggaaccggtaccgtacttacccgaactacgttccgtaacgaacggaaccgtaaccgaaacccggaacgtaaacggaccgtaaccgtacgttcgttacctacgtacggtaaaactacgtaacgtaacgtaggtaaccgaggaaccgggtaaccggacggaaccggtacgacgggttccctttaagttaacggtttacttaacgggtcgtaggtaaacgaagtaagtacgaagtccgacgtacgacggtaccgttacccgggccgtaaaccggtccgtacggggtcccggtaaaccggaaccccgggttcgtacccggtaccctacccgtcctacccgtcgtaccccgtacccgg

SEQ ID NO: 120309 - DNA, 771 bp, Homo sapiens
  misc_feature: GYAE6OF01CKP4H.2.38.D05.1.454.CMB.1.raw
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (267)..(267): a, c, t, g, unknown or other
  misc_feature (267)..(267): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
  modified_base (501)..(501): a, c, t, g, unknown or other
  misc_feature (501)..(501): n is a, c, g, or t
tcagacgctcgacacacgaccggtgctcgatttagtatctgatagctgggttttccttgttgactaattttaaaaggtgtccagtgtgaggtgcagcgtgggtcggagggtccgggggaggtcttagttcaggtccggtcggggggtccctggatactctccgtgcgcacgtcctcgtaggtaacttcctaaccttacgaggtacacctacgnggtatcgaccncgggtcgggtcccgaccaacggccgacggaagggggtacgggngtgggtgggttcggtactctaaggttaattaagtaggtagtaaggtagggagacgacaagtaacacggtacgacgtacgtacggagggaacgtccaattaccaacntaccgacagaaccaacacacgaaanaccagtctagtactacagaaacaaatcgaacgtacgtaggacgaaggacggacggaaagtcgacgtntacgtattactggttaganaagaggtagacagaganacgtacgacgtacggaaccgaacgtaggaccgggttacgggaacccgggtaaccctaccggtacaaccgtttacccactccgtaaacccgaccccgttaaccccgaaccccgtaaaccgggacccggtacccgttacccgggttcccccgttacccccggtacccgggttccccgaccccggggtacccttcggaaccccggttacggaccgacccgacccggttacccgaacacccggggacacccaccgggcccgggcccgggtccgg

SEQ ID NO: 120310 - DNA, 854 bp, Homo sapiens
  misc_feature: GYAE6OF01CSBXU.2.38.D05.1.454.CMB.1.raw
  modified_base (801)..(801): a, c, t, g, unknown or other
  misc_feature (801)..(801): n is a, c, g, or t
tcagacgctcgacacacgaccggtgctcgatttagtatctgatagttgggtttgggggagcccccagcccctgggattcccagctgtttctgcttgctgatcaggactgcacacagagaactcaccatggagtttgggctgagtcgtttgggtttttccttgtttgactttaaagtttttaaaaggtgtccagttggtgaggtgcagtcgtgggtgggacgggtccgggggagtcgttacgttccgacggtccggtcggggggtccctggacgtactcttccgtgtgacacgtccgtcgttacggtctttacctaccttacgtagttacgtacgttaacgtggtacgtcgaccgtaccgggtccggggttaccccgaccgtaaacggcccgtaacgggtaacggggggtaacggggtccggttggggttcgggttcgggttcctaccgtaacgtttaaagtttaaaggtagggttagggtaagggtcggggtaagtaacgaaccgtaaacggtaacccggtaccgtaccgggtaaccgggtacccggttaccgggaggggtaaacccggtaccgttaccttacccgaaccgtactacccgtaacggacgtaacgaaccccgaaacgaacccgaaacgaaccgtaacgtcgttacgtacctagtaaccggaataaaccggtagaaccgtacggtacgttaacggaccggtaaccgggaccgggtaacggaccggttacgtagggttacgtttaagttacgttaccggtagggtaacgaacggtaaagggactaaggaccggnaccggacgtacggtaccggtacccggaacccggtaccggtacggtacccgggg

SEQ ID NO: 120311 - DNA, 836 bp, Homo sapiens
  misc_feature: GYAE6OF01CT64R.2.38.D05.1.454.CMB.1.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
tcagacgctcgacacacgaccggtgctcgatttagtatctgatagttgggtttgggggaagaggagactgacggtcctgccacaggtggtgctgggcacggtgggcactcgacacaacattttgcgctcaactgtcttgtccagtgtgaggtgcagcgtggtgggaggtccgggggagtcttagttcagccgtcgggggtccctgacgaccttctcctgtncacgtcctcgtgtacttcctacttcgacgtanctacgtggactgccgtacgtcggtacccgaccaacgtccgtaccggaagggggtacggggacgttcgggtggtcgggttcctacgtaacggttaacgtttaaacgtagtaggtaggtaggacgttacgacgaacgtaacggtaccgtacggcccggtaacggtacccggaggaaacccggtaccgttaacgttcccgtaaacctaaccgttccgtaacccgaaggtaaccgaaacccgaaaaccggttaaccgaaaaacggtaaacgccgtcgttaccgttaaacctcggtaaccgaaactaaacggtaaacgtaacccggtaaacgttacgttaaacgggacggtacccggaacccgggtaacggacccggtacggttaccggttacggttaacgttaaccgtttacggttacggtaacgtaaaaccggtagggtaccttaaaggtaccgtaaccgaggaacccgtaacggttacgccggtaaaccgggcccgtaaccggtaccggggtaccgggtaacccggtacccggtaacccgttacgtacccgtacccggtctaacccgtccgtcccgtaacccccg

SEQ ID NO: 120312 - DNA, 869 bp, Homo sapiens
  misc_feature: GYAE6OF01B5BVV.2.38.D05.1.454.CMB.1.raw
tcagacgctcgacacacgaccggtgctcgatttagtatctgataggttgggtttgggggagccccagccctgggattcccagctgtttctgcttgctgatcaggactgcacacagagaactcaccatggtaggtttggctgagtcgttgggttttcttgttgtacttaagttttaaaggtcgtcagtgtgaggtgcagtcgtgggtgggacgggtcgggggaggtcgttagttcgacggtccggttcggggggtccctggacgtaccttccgttccgtggtacgccgtaccggtccgttcgttacggttacctttaccctaaccgttacgtaacggttaaccgtaccgttaacggttaggtacgtacgtaccgtaccgggtccgggttaccccgaaccggaaccggtacccgggtaccggggtaacggggggtacggggtcggtttcggggttacggggttccgggttaccgttaaccgttaacggtttaaagtttaaaggtgggtaaggttaaggggtacggggttacggtaaccggaaaccgaacggtaaccgtaccggttacccgggaccggttacccggtacggtaacggggaacccggtccgttaccgttacccacgtaccgttacgaccgaaccggaacgaaccgtaaaccgaacccgaaaacgtacccgtacgtaacgttacgtacgtaacgtacgaaacgtaagtaacgaacgttacgggtacggtacggaacggaccggacggtacggaaccgtcgttactagttacgttattacggagtaacggacgtaaggtagaacgtagacggaacttcggaacggttcggaacccggtaccggtccggtaacggtaacccggggg

SEQ ID NO: 120313 - DNA, 861 bp, Homo sapiens
  misc_feature: GYAE6OF01A6T71.2.38.D05.1.454.CMB.1.raw
  modified_base (701)..(701): a, c, t, g, unknown or other
  misc_feature (701)..(701): n is a, c, g, or t
tcagacgctcgacacacgaccggtgctcgatttagtatctgatagttgggtttggggggaagaggaagactgacggtcctgccacaggtggtgctgggcacggtggcactcgacacaacatttgcgctcaactgtcttgtccagtgtgaggtgcagcgtgggtggacggtccgggggaggctttagttcaggtccgtgggggtccctgagactctcctgtgcacgcctcgtaggtacttacctaccttcgaaggtacgtccttaacgtggtaactcggaccgtaccggttccggggttacccgaccgtaaaccggtccgtaccgggaacggggggtaacgggggtcgtaggggttcggttacggggtccttacgtaacggttaatttaaggtaggtagtaggttagggtaacgtacgacgaacgaacgtccggtaaccggtccggtaccgttaccggtacgggaacggggtacctaacgtaccgaacctacttcccgtacgaaacggtaaccgaacccgaaaccgaacccgaaacggaaacccgaccgtacgttacggtaactaccgtacgtaacgtaaaattacggaaaccgttacggttacgtaaggaaccgggaaccgggtacccggaaacgggtaaccgttaccgggtaggtttacgtacggtttaactttacgtaggtaacgaacgtaaagggtanaacggtacgacgtaccggacgtacgggtaccggttaaccgggtacccgggtacccggttaaccggttaccgggggtaacccgggtaccgggaaccccgggttaaccgttccggtaccccgacccggtttccgacccgtacccggaccccgttacccccgg

SEQ ID NO: 120314 - DNA, 798 bp, Homo sapiens
  misc_feature: GYAE6OF01BUOXH.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacacgccaccctcggtgtcagtcgtccccaggacagacggccaggactcacctgctctggagatgctagttcgaccaaagcaatatcgtctttaagttcggtaaccagacgaacggaacgccgacggccccgaacgggtcccccgttggtggaccggttggttacgtaactttaagttaaaacgtaaacggaactagggtaggaacggtaccggaccccttacggaacgggtacctcccgtaggacgtacgtactttccgtcgttcggtccctaccgacgtaccgtacggtaaacgggaaccgaaacgtaccggtacgtaaccggtttaccgaacctaagtccggtaacggttacgggaaccgtcccgaagggacgtaacggtaaagggtacgtacggaggttccctaagttaaccgtttaaagtttaccgtacggttaacctaaacggttccgaacgtaccgaaacgtacggacgggtaacgtttacggggttttcggttttaaacgggtttttcggggtaccgggttaccggggaacgggttaaccggggaacgttaccgggtacgttacccgggtaacccggtttaccctaaggggttaccccaaaccgggtacccggtaacgggtacccccg

SEQ ID NO: 120315 - DNA, 801 bp, Homo sapiens
  misc_feature: GYAE6OF01D0HA6.2.38.D05.1.454.CMB.1.raw
tcagacgctcgacacacgaccggtgctcgatttagtatctgatagctgggttttccttgttgctattttaaaaggtgtccagtgtgaggtgcagctggtggaggtccggggaggcttagttcagccgtggggggtccctgagactctcctgtgcagcctctggattcaccttcagtagctatggatgcacgtgggtccgaccaagcctccgaaggggaaggggctggtgtgggtctcacgttataagtagtgagtgggatagcacaagctaacggccggacgtccgtagggaacgggtccgtattaccacctaagttcccaccgaggaacgaaccaaaccggacccaaaaggaaccgaccgtaccttaggtacttaccgtaggaaacctaaaatacggaaacctagtaccgttaggaacgaacgggaccgaacgggtaccgaacggtcttaggtacttacgtttacgtggtagaacgaaaggtagtaagtacgacgtaggacgacggacgttcgggtaaccggacccggtaaccggttacgggtacccgggggaaccgtaacccggggtaaccccgtacggttcccccgtaacccgttacccgttccgtacccgtacccgtaccccgtacccgaacccgggtaaacccggtccccgttaacggttcccccggttccccgttccccccgtccgggtaccccgtcccggttaccgtacccggttacccggaaccgggacccgtccccgaaccccggtaaccgacggtaacccgaccgacccggacggtccccgggtacccggg

SEQ ID NO: 120316 - DNA, 743 bp, Homo sapiens
  misc_feature: GYAE6OF01B1V0L.2.38.D05.1.454.CMB.1.raw
  modified_base (630)..(630): a, c, t, g, unknown or other
  misc_feature (630)..(630): n is a, c, g, or t
tcagacgctcgacacacgaccggtgctcgatttagtatctgatagttgggtttgggggaagaggaagactgacggtcctgccacaggtggtgcctgggcacggtggcactcgacaccaacatttgcgctcaactgtcttgtccagtgtgaggtagccagcgtgggtggacggttccggggagtcgttaagttcacggtccgtgggggtcccctggacgtctcctccgtgtcggcacgccgttcgtaggtacttaccgacctttacgagtacgtctacgtggtatcggcctacggttcgggcccaccgaacgtcccgtacgggaaggggacgggtcgtggggttggtcgggttacctacgtaacgtttaagttaacgtaggtggaaggtgggtaacgtagaccgtaacgacggaccgttacggccggtaacccttacgggaggtaaccgggccttaagtacccaccgttacttcccgaacgaaggacctaaaccgaccgaaccaaacgaaccgacgtcgtagtaccgtacgtacgaactaaacacgaacgtacggtactacggacgccggtaaccggagaaccgtcgcgttaggtattacgtcgtggatacgtaagggactaagcggaacncgtacgaccgtggacccgtaacgaccgttaccgggtacgaccgggggtacccacccgggttaaacccgtcggtacccgttccgtaccgtcccctacggtccccgtaaccccgg

SEQ ID NO: 120317 - DNA, 548 bp, Homo sapiens
  misc_feature: GYAE6OF02IT1CI.2.38.D05.1.454.CMB.1.raw
tcagacgctcgacacacgaccggtgctcgatttagtatctgatagttggggtttgggggtgggtccaggaggcagaactctgggtgtctcaccatggcctggatccctctacttcctccccctcttcactctctgcacaggctctgaggcctcctatgagctgacacagccaccctcggtgtcagtcgtccccaggacagacggccaggatcacctgctctggagatgcattgaccaaagcaatatgcttattggtaccagcagaagccaggccacggcccctgtgctggtgatatataaagacagtgagacggccctgaggggactcccgtggacgcgatttctcgtcggctccagcctcgagggacaacgacgtctacgttacgacctatcgaggtggacgtccgaggcaagaagatggaggctgacttatactgtacaatcagcgagacagactaggttggtttacgtttttgggtggttcggggacgggtaacgggtacaaggccgtagacccggttcgtacggtcgacgcccggaagtcccgg

SEQ ID NO: 120318 - DNA, 528 bp, Homo sapiens
  misc_feature: GYAE6OF02F6LBW.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagatagcagcagctggtacgccgactacgtgggccagggaccctggtcaccgtctcctcacgcctccaccgaacgggcccatccggtccttccccgtggccgccctgcctccgaggacgccaccgtccgacgacgcacgacggccggcccg

SEQ ID NO: 120319 - DNA, 486 bp, Homo sapiens
  misc_feature: GYAE6OF02GYIR5.2.38.D05.1.454.CMB.1.raw
  modified_base (312)..(312): a, c, t, g, unknown or other
  misc_feature (312)..(312): n is a, c, g, or t
  modified_base (440)..(440): a, c, t, g, unknown or other
  misc_feature (440)..(440): n is a, c, g, or t
tcagacgctcgacacacgaccggtgctcgatttagtatctgatagttgggtttggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctnaggggatccctgagcgattctctggctccagctcagggacaacagtcacgttgaccatcagtggagtccaggcagaagatgaggctgactattactgtcaatcagcagacagcagtgtacttttgggngttcggcggaggaccaagctgaccgtcgtaggtcagcccaggtccg

SEQ ID NO: 120320 - DNA, 521 bp, Homo sapiens
  misc_feature: GYAE6OF02IS2SP.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattgaccaaagcaatatgcttattggtaccagcagaagccaggccaggcccctgtgctggtgatataataaagacagtgagacggccctcgaggggactcccgtgagcgtattctctggctcagctcgagggacaacagtcacgttgaccatcagtggagtccgaggcaagaagatggaggctgacttattactgtacaatcagcagacagctagttggtttacgttttgggtggttcgggcggacgggaccaagtcgtacgaccgtccgtaggtccacggacccgaggtcccg

SEQ ID NO: 120321 - DNA, 496 bp, Homo sapiens
  misc_feature: GYAE6OF02ISZ09.2.38.D05.1.454.CMB.1.raw
  modified_base (453)..(453): a, c, t, g, unknown or other
  misc_feature (453)..(453): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaaagcaatatgcttattggtaccagcagaagccaggccaggcccctgtgctggtgatatataaagacagtgaagaggccctcaggggatccctgagcgattctctggctccagctcagggacaacagtcacgttgaccatcagtggagtccaggcagaagatgagctgactattactgtacaatcagcagacagcagtgttacgttttgggtgttcgggnggaggacgaagctaggaccgtcgtaggtcacgcccgaggtccg

SEQ ID NO: 120322 - DNA, 493 bp, Homo sapiens
  misc_feature: GYAE6OF02HAOAM.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcaggggatccctgagcgattctctggctccagctcagggacaacagtcacgttgaccatcagtggagtccaggcagaagatgaggctgactattactgtcaatcagcagacagcagtgttacttttgggtgttcgggcggagggaccaagctgaccgtcgtaggtcaggcccgaaggtcccg

SEQ ID NO: 120323 - DNA, 491 bp, Homo sapiens
  misc_feature: GYAE6OF02GN1Q4.2.38.D05.1.454.CMB.1.raw
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctgagggatccctgagcgattctctggctccagctcgagggacaacagtcacgttgaacctatcgagtggagtccaggcaagaagatgaggctgactattactgtacaatcagcagacagcagttgttattttgggngttcgggnggaggacagctgaccgtctaggcacgccgaagtccg

SEQ ID NO: 120324 - DNA, 489 bp, Homo sapiens
  misc_feature: GYAE6OF02GDWMZ.2.38.D05.1.454.CMB.1.raw
  modified_base (440)..(440): a, c, t, g, unknown or other
  misc_feature (440)..(440): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggccccctgtgctggtgatatataaagacagtgagaggccctcaggggatccctgagcgattctctggctcagctcagggacaacagtcacgttgaccatcagtggatccaggcagaagatgagctgactattactgtcaatcagcagacagcagtgtacgttttgggngttcgggcggagggaccaagctgaccgtcctaggtcagcccgaggtccg

SEQ ID NO: 120325 - DNA, 503 bp, Homo sapiens
  misc_feature: GYAE6OF02IKQ8M.2.38.D05.1.454.CMB.1.raw
  modified_base (313)..(313): a, c, t, g, unknown or other
  misc_feature (313)..(313): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctnagggatccctgagcgattctctggctcagctcagggacaacagtcacgttgaccatcagtggagtccaggcagaagatgaggctgactattactgtcaatcagcagacagcagtgttacgtttttgggtgtttcgggcggtagggaccgtaagcgtacggaccgtcgtaggtcacggcccgaaggtcccg

SEQ ID NO: 120326 - DNA, 523 bp, Homo sapiens
  misc_feature: GYAE6OF02GMQBB.2.38.D05.1.454.CMB.1.raw
  modified_base (428)..(428): a, c, t, g, unknown or other
  misc_feature (428)..(428): n is a, c, g, or t
  modified_base (494)..(494): a, c, t, g, unknown or other
  misc_feature (494)..(494): n is a, c, g, or t
tcagacgctcgacacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaaggccgattcacatctccagagacaacgcaagaacacgctgtatctgcaaatgaacagtctgagagccgaggacacggctgtgtatactgtgcaagagatagcagcagctggtacgccgactacgtgggccagggaaccctggtcaccgtcncctcacgccctaccaaccgaacgggcccagtccggtccttccccgtggccgccctgcctccaggcnccgacctccgagacgcacacggccgcccg

SEQ ID NO: 120327 - DNA, 535 bp, Homo sapiens
  misc_feature: GYAE6OF02G7TYR.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagatagcagcagctggtacgccgactacgtgggccacgggaccctggtccaccgtcctcctcacgcctccaccgaacggcccacgtccggtccttccccgtcggccgccctcgcctccgaggacgccaccgtccgacgacgcacgacggccgtcccgg

SEQ ID NO: 120328 - DNA, 496 bp, Homo sapiens
  misc_feature: GYAE6OF02HQXT3.2.38.D05.1.454.CMB.1.raw
  modified_base (314)..(314): a, c, t, g, unknown or other
  misc_feature (314)..(314): n is a, c, g, or t
  modified_base (399)..(399): a, c, t, g, unknown or other
  misc_feature (399)..(399): n is a, c, g, or t
  modified_base (452)..(452): a, c, t, g, unknown or other
  misc_feature (452)..(452): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaaagcaatatgcttattggtaccagcagaagccaggccaggcccctgtgctggtgatatataaagacagtgagaggccctnagggatccctgagcgattctctggctcagctcgagggacaacagtcacgttgaccatcagtggagtccaggcaagaagatgaggntgactatactgtcaatcagcagacagcagtggttactttttgggtgttcgggnggagggacaaggctggaccgtcgtaggtcacgcccgaaggtccg

SEQ ID NO: 120329 - DNA, 662 bp, Homo sapiens
  misc_feature: GYAE6OF02JTNDJ.2.38.D05.1.454.CMB.1.raw
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
  modified_base (382)..(382): a, c, t, g, unknown or other
  misc_feature (382)..(382): n is a, c, g, or t
tcagacgctcgacacacgaccggtgctcgatttagtatctgatagcgttgggttttccttgttgctattttaaaggtgtccagtgtgaggtgcagctggtggagtccgggggaggcttagttcagcctggggggtccctgagactctcctgtgcagcctctggattcaccttcagtagctactggatgcactgggtccnccaagcctaccaggggaagggctggtgtgggtctcgacgtattaatagtgagtgggagtagcacagctacgcgactcgtgacgggcatcaccntctccagacgacacgccaagacacgctagtatcgtgacaaatgaacagttcagagacggccgaggacacggtctggttgtaatttaccgnggtagacaaagagatacgacgagtacgagtcgtacggtaccgaccggaaccgtacggtcggggacccaacggggaaccccttgggtaaccctacccggttacctacccgtaccgaccgaccccttacccgaaccggtaaccgggcccctaacggtcccggttaccccgtttacccccgagggtccccgtacccgtaccggtcccttaaccggacgggtacccgacccgtacccggtacccggaacggccggacccaaccggaccgggcccgggtacccgg

SEQ ID NO: 120330 - DNA, 536 bp, Homo sapiens
  misc_feature: GYAE6OF02F6YC3.2.38.D05.1.454.CMB.1.raw
  modified_base (379)..(379): a, c, t, g, unknown or other
  misc_feature (379)..(379): n is a, c, g, or t
  modified_base (480)..(480): a, c, t, g, unknown or other
  misc_feature (480)..(480): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagngatagcagcagctggtacgccgactacgtggggccagggaaccctggtcaccgtctcctcacgccctccaccgaacgggcccagtccggtccttcccccgnggccgccctcgcctccgaggacgccaccgtccgacgacgcacgacgccggtcccgg

SEQ ID NO: 120331 - DNA, 528 bp, Homo sapiens
  misc_feature: GYAE6OF02IFEEB.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctgggggtccctgagactctcctgtgcagcctctggattcaccttcagtagctactggatgcactgggtccgccaagctccgaggggaaggggctgggtgtgggtctcacgtattaatagtgatgggagtagcacaagctacggcggactccgtagaacgggccgattcaccatcctccagacgacaacgccaaagacacgctgtatctagacaaatcgaaacagtctaggaagacgccggaaggaccacgggctggtgtatttactgtgacaaggagatagcagcaggctagggacgccgatacgg

SEQ ID NO: 120332 - DNA, 551 bp, Homo sapiens
  misc_feature: GYAE6OF02GC6ET.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaaagcaatatgcttattggtaccagcagaagccaggccaggcccctgtgctggtgatataataaagacagtgagacggccctcgagggactccctgacgcgatttctcgtggcctccagctcgagggacaacagtcacgttcgaaccatcagtggagtccgaggacaagaagagtggaggctagactattactgtacaatcgaagcaagacagcgtaggttggtttacgtttttggggtacgtttcgggacgggtaagggaccgtaaggtcgtacggaccgttccgtaagggttccacggaccccgtaaggtccccg

SEQ ID NO: 120333 - DNA, 518 bp, Homo sapiens
  misc_feature: GYAE6OF02IOU8O.2.38.D05.1.454.CMB.1.raw
  modified_base (440)..(440): a, c, t, g, unknown or other
  misc_feature (440)..(440): n is a, c, g, or t
  modified_base (509)..(509): a, c, t, g, unknown or other
  misc_feature (509)..(509): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaggtgtccagtgtgaggtgcagctggtggagtccgggggaggcttagttcagccgtgggggtccctgagactctcctgtgcagcctctggattcaccttcagtagctactggatgcacgtgggtcccgccaagctccgaggggaggggctggtgtgggtctcacgttattaatagtgagtgggagtagcacaagctacgcggactccgtgacgggccattcaccatctccagagacaacgccaaagacacgctgtatctgacaaatcgaaacngtcagagagccgagacacggctagtagtattactgtgacgaagagatagcaagcaggtcgtaggtaccnccgatacgg

SEQ ID NO: 120334 - DNA, 536 bp, Homo sapiens
  misc_feature: GYAE6OF02IGEHG.2.38.D05.1.454.CMB.1.raw
  modified_base (525)..(525): a, c, t, g, unknown or other
  misc_feature (525)..(525): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaaatgaaacagtctgagagccgaggacacggctgtgtattactgtgcaagagatagcagcagctggtacgccgactacgtggggccagggaccctggtcaccgtctcctcagccctccaccgaacgggcccacgtccggtccttccccgtggcccgccctgccctccgacggacgccaccgtccgacgacgcacncggccggcccg

SEQ ID NO: 120335 - DNA, 510 bp, Homo sapiens
  misc_feature: GYAE6OF02GIHGU.2.38.D05.1.454.CMB.1.raw
  modified_base (483)..(483): a, c, t, g, unknown or other
  misc_feature (483)..(483): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcacctttcagtagctactggatgcactgggtccgccaagctccgagggaaggggctgggtgtgggtctcacgtattaatagtgatgggagtagcacaagctacgcggactccgtgagggccgattcaccatctcagagacaacgcaagaacacgctgtatctagacaaatcgaaacagtctgagacgccgaggacacggctgtgtattactgtgacaagganatagcagcagctaggacgccgatacgg

SEQ ID NO: 120336 - DNA, 665 bp, Homo sapiens
  misc_feature: GYAE6OF02FV6RJ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtgtccccaggacagacggccaggatcacctgctctggagatgcattgaccaaagcaatatgcttattggtaccagcagaagccaggccacggcccctgtgcgtggtgatataataaagacagtgagacgccctgagggactcccgtgacgcgtatttctcgtacggtctccgagtcgtacgaaggggaaccaaacgtacggtaccgtaaccggtttcggaaccctaagtccgtaaggttacgggtacgttcccgaagggaccaaggaaacggagttaggacggtctaggaacctttaattacgtagtaacctaattccgaacgacgtaagaaccgagaccgtaagggtttacggtttaaccgggtttttttggggtacggtttacgggggaccgggtaacggggtaacccgtaagggtaccgttacggtacccggttaccggttaacggggtacccaccgggtaccccgaagggttccccg

SEQ ID NO: 120337 - DNA, 547 bp, Homo sapiens
  misc_feature: GYAE6OF02H4J5B.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgcaagctccagggaagggctggtgtgggtctcacgtattaatagtgatgggagtagcacaagctacgcggactccgtgaaggccgattcacatctccagagacaacgccaagaacacgctgtatctgacaaatgaacagtctagagagccgaggacacggttgtgtattactgtgcaagagatagcagcagctggtacgcgactacgtgggaccgacggaacccgtcggtaccaccgtctcctcacgcctccaccgaacgggcccagtccggtccttccccgtcggccgtcccgtcgcctccgacggacgcctacccgtccgacgacgccacgacggccggcccgtcggg

SEQ ID NO: 120338 - DNA, 506 bp, Homo sapiens
  misc_feature: GYAE6OF02GMLYM.2.38.D05.1.454.CMB.1.raw
  modified_base (260)..(260): a, c, t, g, unknown or other
  misc_feature (260)..(260): n is a, c, g, or t
  modified_base (319)..(319): a, c, t, g, unknown or other
  misc_feature (319)..(319): n is a, c, g, or t
  modified_base (362)..(362): a, c, t, g, unknown or other
  misc_feature (362)..(362): n is a, c, g, or t
  modified_base (433)..(433): a, c, t, g, unknown or other
  misc_feature (433)..(433): n is a, c, g, or t
  modified_base (461)..(461): a, c, t, g, unknown or other
  misc_feature (461)..(461): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccnccaagctccagggaagggctggtgtgggtctcacgtattaatagtgatgggagtagcanaagctacgcggactccgtgaaggccgattcaccatctccaganacaacgccaagaacacgctgtatctgacaaatgaacagtctgagagccgaggacacggctgtagtattacngtgacaagagatagcagcagctggtacncgactacgtcgggaccagggaccctggtcaccgtctctcacgccc

SEQ ID NO: 120339 - DNA, 755 bp, Homo sapiens
  misc_feature: GYAE6OF02HL272.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtgtccccaggacagacggccaggatcacctgctctggagatgcattgaccaaagcaatatgcttattggtaccagcaagaagccaggccacggcccctgtgctggtgatataataaagacagtgagacggccctgagggtactcccgtgacgcgtatttctcgtcggcctccgagtcctacgaacggggaaccaaacgtacggttaccgtaacggtttacggaaccctaagttaccgaagggtacgggtaaccgttcccgaaacggggaccgaaagggaaaaggaacgttacggggaacgggtaccgttacgggtaacctttaacgtttaaccgttaggttaacctaaaacgttaccgaaacggtaccgaaacgggaaccgtaacggtacccgtaagggttttacgggttttaaccgggtttttttttggggggtacgggtttttaccgggggtaacgggggtaaccggggtaacccgtaaaacgggttcccggttaacgggttaacccccgggttaccggttaacggggttacccggtaaccgggtacccccggtaaagggttcccccgg

SEQ ID NO: 120340 - DNA, 494 bp, Homo sapiens
  misc_feature: GYAE6OF02INXBJ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggcctcaggggatccctgagcgattctctggctccagctcagggacaacagtcacgttgaccatcagtggagtccaggcagaagatgagctgactattactgtcaatcagcagacagcagtggttacttttgggtgttcgggcggagggaccaagcgtggacccgttcgtaggtcaggcccaggtccg

SEQ ID NO: 120341 - DNA, 749 bp, Homo sapiens
  misc_feature: GYAE6OF02HAX85.2.38.D05.1.454.CMB.1.raw
  modified_base (405)..(405): a, c, t, g, unknown or other
  misc_feature (405)..(405): n is a, c, g, or t
  modified_base (644)..(644): a, c, t, g, unknown or other
  misc_feature (644)..(644): n is a, c, g, or t
tcagacgctcgacacacgaccggtgctcgatttagtatctgatagctggtttccttgttgtctattttaaaggtgtacctagtgtgaggtgcagctggtggagtccggggaggcgttagttcagtccgtgggggtccctggacgacgtctcctgtcgcagcctctggattcaccttcagtagctactggatgcactgggtccgccaagctccaggggaagggctgggtgtgggtctcgacgtattaaagagtgagtgggatagcacaagctagcggactcgtggaacggccgattcaccgtatcctacagagaccaaacgccaaaagaccacggctagtaactcgtagacctaaaaagtcgaaacagtccgtagaagtacggccgaaggaacaacggtctaggtnttaaccgtttaaatcggttacggacaaaggaaaggtaagtacggaaccgtaagaccgaaggacgttaagggtaaccggacccgtaaacgtaaccgttcggggggacccgaaaaccgggtacccgttaacgggttccctaaaccgggtccttacccgacccggaaccgttccccgtaccccgaaaaccggttaacccgggaccgaaccccgtttaaacgggtcccccgttttacccccgngggtccccgacccccggtccgtacccgtaccccgtaccggaccggaacccgtacccccgtcggtaaccccggagtaacccgaccgaacccgggtccccggaccgg

SEQ ID NO: 120342 - DNA, 545 bp, Homo sapiens
  misc_feature: GYAE6OF02H6HGB.2.38.D05.1.454.CMB.1.raw
  modified_base (341)..(341): a, c, t, g, unknown or other
  misc_feature (341)..(341): n is a, c, g, or t
  modified_base (359)..(359): a, c, t, g, unknown or other
  misc_feature (359)..(359): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtcccgccaagctccgagggaaggggctggtgtgggtctcacgtattaatagtgatgggagtagcacaagctacgcggactccgngaaggccgattcacatcncagacgacaacgaccaagaacacgctagtatctgacaaatgaaacagtctgagacgaccggaaggacacggcttgtagtacttacgtgtagacaaagagatagcagcagctacggtacgccgactacggtcggggacctaacgggacccgttcggccgtaccggttcctaccgttcgacgtacccc

SEQ ID NO: 120343 - DNA, 552 bp, Homo sapiens
  misc_feature: GYAE6OF02H25WI.2.38.D05.1.454.CMB.1.raw
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (514)..(514): a, c, t, g, unknown or other
  misc_feature (514)..(514): n is a, c, g, or t
tcagacgctcgacacacgaccggtgctcgatttagtatctgatagctaggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaagggggctgggtgtgggtctcacgtattaatagtgatggggagtagcacaagctacgcggactccgtgaagggccgattcaccatctccagagacaacgccaaagaacacgctgtatctgcaaatgaaccaccctgacgagccgaggacacggccatctattattgtgcgaaggacagtaggggccggcggcgggagcgaatgacttcgtggggccagggaccctggtccaccgtctcctcacgccctccaccgagggcccagttccgtccttccccgnggccnccctgcctccgacggacnccaccgtccgagacgccacgacggccggcccgtgggcc

SEQ ID NO: 120344 - DNA, 514 bp, Homo sapiens
  misc_feature: GYAE6OF02JCG8Z.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcgagggatccctgagcgattctcgtggctccagctcagggacaacagtcacgttgacctatcagtggagtccaggcaggaagatgaggctagacttattactgtacaatcagacagacagctaagttggttacgttttgggtgttcgggcggacggaccgaagcgtcgaccgttccgtaggtccgacggcccgaaggtcccg

SEQ ID NO: 120345 - DNA, 554 bp, Homo sapiens
  misc_feature: GYAE6OF02GWBFJ.2.38.D05.1.454.CMB.1.raw
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccattcaccatctccagagacaacgccaagacacgctgtatctgcaaatgaacagtctgagagccgaggacacggctgtgtattacngtgcaagganatagcagcagcgtggtaccgccgactacggtcgggaccgaacgggaccctggtaccgaccgtcctcctcacgccctaccgaaccgaacggccctagtccgtcccttccccgtggcccgcccgtcgcctaccgaggacgcctaccgtccgacgacgaccacgacggcccggtcccgg

SEQ ID NO: 120346 - DNA, 516 bp, Homo sapiens
  misc_feature: GYAE6OF02H9E08.2.38.D05.1.454.CMB.1.raw
  modified_base (297)..(297): a, c, t, g, unknown or other
  misc_feature (297)..(297): n is a, c, g, or t
  modified_base (468)..(468): a, c, t, g, unknown or other
  misc_feature (468)..(468): n is a, c, g, or t
  modified_base (505)..(505): a, c, t, g, unknown or other
  misc_feature (505)..(505): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtggggggtccctgagactctcctgtgcagcctctggattcacctttcagtagctactggatgcactggggtccncaagctccgaggggaaggggctggtgtgggtctcacgtattaatagtgatgggagtagcacaagctacgcggactccgtgaagggccattcaccatctccagagacaacgaccaaagaacacgctgtatctagacaaatgaacagtctagagagccgaggacacggctgtntattctgtgacgaagagatagcagcagcctagggacncccgatacggg

SEQ ID NO: 120347 - DNA, 509 bp, Homo sapiens
  misc_feature: GYAE6OF02JJN0N.2.38.D05.1.454.CMB.1.raw
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
  modified_base (455)..(455): a, c, t, g, unknown or other
  misc_feature (455)..(455): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgatttcnctggctcgagctcgaggacaacngtcagttcgaccatcaggtggagtccaggcaagaagatggaggctagactatactgtacaatcagcaagacagcagttgtacgttttgggtgttcggngggtaaggaccaagtccgtaggacccgttcgacggtcgacgtacccgaggtccg

SEQ ID NO: 120348 - DNA, 517 bp, Homo sapiens
  misc_feature: GYAE6OF02F4H1L.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcgagggatcccgtgagcgattctctggctcagctcagggacaacagtcacgttgacatcagtgagtccaggcagaagatgagctgactattactgtacaatcagcagacagcgagttggttacgtttttggggtcgttcgggcgggtacgggaccgaaggtcgtacgtacccggttccgtaggtccacggaccccgaaggtcccg

SEQ ID NO: 120349 - DNA, 482 bp, Homo sapiens
  misc_feature: GYAE6OF02GWQ80.2.38.D05.1.454.CMB.1.raw
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggcctcagggatccctgagcgattctctggctccagctcagggacaacagtcacgttgaccatcagtggatcaggcagaagatgagctgactatactgtcaatcagcagacagcagtgtacttttgggngttcggnggaggacaagctagaccgtcgtaggtcacgccgaggtccg

SEQ ID NO: 120350 - DNA, 538 bp, Homo sapiens
  misc_feature: GYAE6OF02JFUZH.2.38.D05.1.454.CMB.1.raw
  modified_base (336)..(336): a, c, t, g, unknown or other
  misc_feature (336)..(336): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacgccaggatcacctgctctggagatgcattgccaaagcaatatgcttatggtaccagcaagaagccaaggccaaggcccctgtgctggtgatataataaagacagtgagacgcctagagggactccgtgagcgattcnctaggctcagctacgaagggtacaacgagtcacgttacgaacctatcaaggtggactcgaggcaagagagtgagctagattagtactgacaatcagcaagtangtanagttaggttacgttttggtcggtacggcgggtacggacgtaagtccggttacgacccggtttactagggtaccgacggtacccggtaaggtcccg

SEQ ID NO: 120351 - DNA, 521 bp, Homo sapiens
  misc_feature: GYAE6OF02IRDQT.2.38.D05.1.454.CMB.1.raw
  modified_base (385)..(385): a, c, t, g, unknown or other
  misc_feature (385)..(385): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
  modified_base (469)..(469): a, c, t, g, unknown or other
  misc_feature (469)..(469): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagcctccgaggggaggggctgggtgtgggtctcacgtattaatgtgagtgggatagcacaagctacgcggactccggtgaagggccattcaccatctaccagagaacaacgccaaagaaccncgctagtatctgacaaatgaacagtctgagagccgagacgcgctgtntattcgngtgacaagngaatagcagnagctagggacnccgaactcggcggggaccacgggaccctggccaccgtcctacctcacgtccc

SEQ ID NO: 120352 - DNA, 534 bp, Homo sapiens
  misc_feature: GYAE6OF02G1OEC.2.38.D05.1.454.CMB.1.raw
  modified_base (379)..(379): a, c, t, g, unknown or other
  misc_feature (379)..(379): n is a, c, g, or t
  modified_base (476)..(476): a, c, t, g, unknown or other
  misc_feature (476)..(476): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccaggggaaggggctggtgtgggtctcacgtattaatagtgatgggagtagcacaagctacgcggactccgtgaagggccgattcaccatctccagagacaacgccaagacacgctgtatctgcaaatgaacagtctgagagccgaggacacggctgtgtattactgtgcaagngatagcagcagctggtacgccgactacgtgggccagggaccctggtcaccgtctcctcacgccctccaccgaacggcccagtccggtccttccccgnggccgccctcgcctccgaggacgccacccgtccgacgacgccacgacggccgtcccgg

SEQ ID NO: 120353 - DNA, 511 bp, Homo sapiens
  misc_feature: GYAE6OF02HRYC8.2.38.D05.1.454.CMB.1.raw
  modified_base (322)..(322): a, c, t, g, unknown or other
  misc_feature (322)..(322): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (463)..(463): a, c, t, g, unknown or other
  misc_feature (463)..(463): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccgagggaaggggctgggtgtgggtctcacgtattaatagtgatgggatagcanaagctacgcggactccgtgaagggccattcaccatctcagagacaacgccaagaacacgctgtatctgacaaatgaacagtctgagagccgaggacacggctgtntattacngtgacaagagatagcagcagctgggaccnccgactacgtggggccagggaccctggtccaccgtctcctcgcgtccc

SEQ ID NO: 120354 - DNA, 491 bp, Homo sapiens
  misc_feature: GYAE6OF02GCOWY.2.38.D05.1.454.CMB.1.raw
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
tcagacgctcgacacacgaccggtgctcgatttagtatctgatagttgggtttggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaaagcaatatgcttattggtaccagcagaagccaggccaggcccctgtgctggtgatatataaagacagtgagaggccctcagggatccctgagcgattctctggctcagctcagggacaacagtcacgttgaccatcagtggagtccaggcagaagatgaggctgactattactgtcaatcagcagacagcagtggtactttttgggngttcggnggaggaccgaagcgtagaccgtctaggtcaggtcccaaggtccg

SEQ ID NO: 120355 - DNA, 532 bp, Homo sapiens
  misc_feature: GYAE6OF02IYCPW.2.38.D05.1.454.CMB.1.raw
  modified_base (257)..(257): a, c, t, g, unknown or other
  misc_feature (257)..(257): n is a, c, g, or t
  modified_base (386)..(386): a, c, t, g, unknown or other
  misc_feature (386)..(386): n is a, c, g, or t
  modified_base (428)..(428): a, c, t, g, unknown or other
  misc_feature (428)..(428): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccggggagcttagttcagcctgggggtccctgagactctcctgtgcagcctctggattcaccttcagtagctactggatgcactgggtccnccaagctccagggaaggggctggtgtgggtctcacgtattaatagtgagtggggagtagcacaagctacgcgactccgtgaggccattcacatctccagagacaacgccaagaacacgctgtatctganaaatgaacagtctgagagccgagacacggctgtgtatttacngttgacaaggagaatagcgagacgagcgtaggtacgcccggaacttacgtcgggggaccacggggaacccctgggtccaccggttcctccctacgcgtaccccg

SEQ ID NO: 120356 - DNA, 521 bp, Homo sapiens
  misc_feature: GYAE6OF02FL9AP.2.38.D05.1.454.CMB.1.raw
  modified_base (446)..(446): a, c, t, g, unknown or other
  misc_feature (446)..(446): n is a, c, g, or t
  modified_base (513)..(513): a, c, t, g, unknown or other
  misc_feature (513)..(513): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaaagaacacgctgtatctgacaaatgaacagtctagagagccgaaggacacggctgtgtattactgtagcaagngatagcagcagctaggacgccgactacgtggggcccaaggggaaccctggtaccacccgtctccctnacgtcccc

SEQ ID NO: 120357 - DNA, 525 bp, Homo sapiens
  misc_feature: GYAE6OF02H4W8K.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcacctttcagtagctactggatgcactgggtccgcaagctccgagggaaggggctggtgtgggtctcacgtattaatagtgatgggatagcacaagctaacgcggactccggtgaagggccattcaccatcctccagagacaacgccaagaacacgctgtatctgacaaatgaaacagtctgagagccgaggacacggctgtgtattactgtagcaagagatagcagcagctaggtaccgccgaactaccgtggggaccaaggggacccctgggtccacccgttctccctcagtcccc

SEQ ID NO: 120358 - DNA, 534 bp, Homo sapiens
  misc_feature: GYAE6OF02JODV8.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaaagcaatatgcttattggtaccagcagaagccaggccaggcccctgtgctggtgatataataaagacagtgagaggccctcagggatcccgtgagcgattctctggcctccagctcagggaacaacgagtcacgttgaccatcgagtggagtcaggcaaggaagatgagctgaacttataactgtacaattcagtcaggaccagacgagttgggttacttttggggtcgtttcgggacgggtagggacaaaggtcgtacggtaccgttccgtacggtcaacggttaccccgaaggtcccg

SEQ ID NO: 120359 - DNA, 1016 bp, Homo sapiens
  misc_feature: GYAE6OF02G8PZE.2.38.D05.1.454.CMB.1.raw
tcagacgctcgacacacgaccggtgctcgatttagtatctgatagttgggtttgggggtggtccaggaaggacagaacttctcggtgtactacacccagtggcctggatccctctacttctccccctcttcgacttcgtcctggcgtaccaggtctcgtggacggcctcctatgagcgttgaccactaccgccgacccctcgggttggtcgacgtagttcccccaggggaccaggaccgggtccgaagggactccgaccgttcgtccgttcgtaggggtacgtacttggccaagtttcgtacccaaaagggaccgtaaattaaccgttcgaccgttttaacgtttacggttaacccgtaggttaccaaaggttaacgggccccgaacggggaccccggaaccgggtcccccccgttagggttacggtaaccggttccggggtttaggaaacgttaggttaaagttaaaaggggaaccggtaaggttacgggtaaccggtaacggggtcccccgtttacggaacgggggtaaccttacccccgtaacggtaaccggtaccgtaacgttttaccggttaccgtttaccggggtacccggttaccccgaagggtaccccgttaaccggaaacccgggggtaacctaaaacccggaccgggtttaacccgtaaaacccgggtttttaaccggaaacccctaacggtttaaccggttaaacgggttaccggggtaacgggttacccggtaacgggtaccgaaaacggaaacggtaaccgtttagggaccggtacgttacgtaacggttaacgttaccggtacggttacttaaccgttaccgtacgtacgtaacggaccgaaggtacgttaacggtttacgtttaacggtttttacggggttcggtttaccgggtccgggtttaaccgggtttaacccgtaaccggttcccgttttaacggtaccccggtttaccggtacgggtacccgtaacccggtacccggtaacccgggtacccccgg

SEQ ID NO: 120360 - DNA, 538 bp, Homo sapiens
  misc_feature: GYAE6OF02I8V39.2.38.D05.1.454.CMB.1.raw
  modified_base (380)..(380): a, c, t, g, unknown or other
  misc_feature (380)..(380): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaaccacgctgtatctgcaaatgaacagtctgagagccgaggacacggctgtgtattactgtgcaagngatagcagcagctggtacgccgactacgtggggccacgggaccctggtccaccgtctcctcacgcctccaccgacgggcccagtccggtccttccccgtggccgcccgtcgcctcccgaggacgccacccgtccgacgacgccacgacgccggtcccg

SEQ ID NO: 120361 - DNA, 535 bp, Homo sapiens
  misc_feature: GYAE6OF02I1T4U.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagaagccaggccaggcccctgtgctggtgatataataaagacagtgagagccctcgagggactcccgtgagcgattctctggctccagctcgagggacaacagtcacgttgacctatacgaggtggagtccgaggacaaggaagagtaggaggtctagaacttatttacgtcgtacaatcagcagacagcagttgtttacgttttgggtgttcgggacggtacgggacaagtcgtacggaccggttccgtaggtccgacggtacccgaaggtcccg

SEQ ID NO: 120362 - DNA, 499 bp, Homo sapiens
  misc_feature: GYAE6OF02HGWFX.2.38.D05.1.454.CMB.1.raw
  modified_base (397)..(397): a, c, t, g, unknown or other
  misc_feature (397)..(397): n is a, c, g, or t
  modified_base (418)..(418): a, c, t, g, unknown or other
  misc_feature (418)..(418): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggcctcagggatccctgagcgattctctggctcagctcagggacaacgagtcacgttgaccatcaagtggagtccaggcagaagatgaggntgactattactgtcaatcgancaagacagcaagttggttacttttgggtgttcgggcggagggacaagccgtagaccgttccgaggtcgacgccgaggtccg

SEQ ID NO: 120363 - DNA, 545 bp, Homo sapiens
  misc_feature: GYAE6OF02I9XHI.2.38.D05.1.454.CMB.1.raw
  modified_base (378)..(378): a, c, t, g, unknown or other
  misc_feature (378)..(378): n is a, c, g, or t
  modified_base (399)..(399): a, c, t, g, unknown or other
  misc_feature (399)..(399): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccaccaagctccagggaaggggctgggtgtgggtctcacgtattaatagtgatgggagtagcacaagctacgcggactccgtgaagggccattcgccatctcagagacacgccaagaacacgctgtatctgacaaatgaacagtctgagagccgaggacacggctgtgtattactgtgcaagngatagcagcagctgggtaccnccgactacgtggggccacgggaccctggtaccaccgtctcctcgacgccctaccaccgacgggccctagtccggtcccttccccgtggcccgcccgtcgcctccgaggaccgccaccgtccgagacgccacgacggccggtcccgg

SEQ ID NO: 120364 - DNA, 516 bp, Homo sapiens
  misc_feature: GYAE6OF02GEL8E.2.38.D05.1.454.CMB.1.raw
  modified_base (439)..(439): a, c, t, g, unknown or other
  misc_feature (439)..(439): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggagtagcacaagctacgcggactccgtgaaggccgattcacatctccagagacaacgcaaagaacacgctgtatctgacaaatgaacagtctgagagccgaggacacggctgtgtattactgtganaagagatagcagcagctggacgccgactacgtcggggaccagggaaccctggtacacccgttctccctcgacgtccc

SEQ ID NO: 120365 - DNA, 587 bp, Homo sapiens
  misc_feature: GYAE6OF02I8CYT.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacaatctgagagccgaggacacggctgtgtattacgtgtgcaagagatagcagcagctggtacgccgactacgtcggggaccacgggacccgtggtccacccgtcctccctcgacgccctaccgaccgaacgggccccacgttcccggttccgttcccccgtcggcccgtccccgtcgcccgttacccgacgggtaccgacccgtacccgttaccggacggaccgaccgaaccggacggcccggtccccggg

SEQ ID NO: 120366 - DNA, 587 bp, Homo sapiens
  misc_feature: GYAE6OF02F6U4Z.2.38.D05.1.454.CMB.1.raw
tcagacgctcgacacacgaccggtgctcgatttagtatctgatagttgggtttgggggaaagaggaagactgaccggtcctgcccacaggtggtgctgggcacgggtgggcactcgacacaacatttgcgctcaactgtcttgtccagtgtgaggtgcagctgggtggagtccgggggaggcttagttcagcctggggggtccctgagactctcctgtgcagcctctggattcaccttcagtagctactggatgcactgggtccgccaagcctccgagggaaggggctgggtgtgggtctcacgttattaatagtgatgggagtagcacaagctacgcggactccgtgaggccgattcaccatctaccagagacaacgccaaagaaccacgctgtatctagacaaatgaaacagtctgagacgaccgaggacacggctgtagtattacgtgtagacgaagagaataggactaggacagcgttacgggtaccgacccggtaacgttaccggtacgggggcccgtaaacggggtaaccccgttgggtaccccgtacccggttaccgtccccgtacgacccgtacccccg

SEQ ID NO: 120367 - DNA, 579 bp, Homo sapiens
  misc_feature: GYAE6OF02HSBVW.2.38.D05.1.454.CMB.1.raw
  modified_base (284)..(284): a, c, t, g, unknown or other
  misc_feature (284)..(284): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccacccctcggtgtcagtgtccccaggacagacggccaggatcacctgctctggagatgcattgaccaaaagcaatatgcttattggtaccagcagaagccaggccacggcccctgngctggtgatataataaagacagtgagacggtccctgaggggactcccgtgacgcgtatttctcgtggcctccgagctcgagggacaacgagtcacgttcgaccatcagtggagtccgaggcagaagatgaggctagacttattactgtacaatcgaacgtcaagacaggtacgaggtttagggtttaccgttttttgggggtcggtttaccggggacggggtaccgggtaaccgtaaggtccgttacggtaacccggttccgtacgggtacctacggaccccggtaaggtccccg

SEQ ID NO: 120368 - DNA, 510 bp, Homo sapiens
  misc_feature: GYAE6OF02GQVWY.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaagggccattcacatctcagagacaacgccaaagacacgctgtatctgacaaatgaaacagtctagagagccgaggacacggctgtgtattacgtgtgacaagagatagcagcagctggacgccgaactacgtggggaccagggaccctggtccaccgtctcctcagtcccc

SEQ ID NO: 120369 - DNA, 532 bp, Homo sapiens
  misc_feature: GYAE6OF02GU5W4.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctggtgctggtgatataataaagacagtgagacggccctcgagggactcccgtgacgcgattctcgtggcctcagctcgaagggacaacgagtcacgttgaccatcgagtggagtccgaggcagaagagtgagctagactattactgtacaatcgagcagacagcgtagttgttacgttttgggtcgttacgggcgggaaggaccgaaggtccgtacggtacccgtccgtaggtaccgacggtacccgaggtcccg

SEQ ID NO: 120370 - DNA, 507 bp, Homo sapiens
  misc_feature: GYAE6OF02GBYVY.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcgagggatccctgagcgattctctggctccagctcagggacaacagtcacgttgaccatcagtggacgtccaggcaagaagatggagctagactattactgtacaatcgagtacagacagcaagtggttattttgggtgttcggcgggtaggacgaagcgtcggaccgtctaggtcacggaccccgaaggtcccg

SEQ ID NO: 120371 - DNA, 481 bp, Homo sapiens
  misc_feature: GYAE6OF02GU90V.2.38.D05.1.454.CMB.1.raw
  modified_base (439)..(439): a, c, t, g, unknown or other
  misc_feature (439)..(439): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggcctcagggatccctgagcgattctctggctccagctcagggacaacagtcacgttgaccatcagtgagtccaggcagaagatgaggctgactattactgtcaatcagcagacagcagtggtatttttgggngttcggcggaggacagctgaccgtcgtagtcagccgagtccg

SEQ ID NO: 120372 - DNA, 547 bp, Homo sapiens
  misc_feature: GYAE6OF02IDNPQ.2.38.D05.1.454.CMB.1.raw
  modified_base (450)..(450): a, c, t, g, unknown or other
  misc_feature (450)..(450): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgacaaatgaaacagtctgagagccgaggacacgggctggtagtattactggtacgcaagagatagcagcagcgtgggtacgccgactacgtggggccacggggaaccctggtcaccgtctccncacgcctccaccgacgggccctagtccggttcctccccgtggccgtcccgtcgcctccgaggccgaccacccgtcgacgacgcacgacggcggcccg

SEQ ID NO: 120373 - DNA, 744 bp, Homo sapiens
  misc_feature: GYAE6OF02IHSM5.2.38.D05.1.454.CMB.1.raw
  modified_base (126)..(126): a, c, t, g, unknown or other
  misc_feature (126)..(126): n is a, c, g, or t
  modified_base (611)..(611): a, c, t, g, unknown or other
  misc_feature (611)..(611): n is a, c, g, or t
  modified_base (633)..(633): a, c, t, g, unknown or other
  misc_feature (633)..(633): n is a, c, g, or t
tcagacgctcgacacacgaccggtgctcgatttagtatctgataggttggggtttgggggtgggtccagggaggcagaactcgtgggtgtctcacagtggcctggactccctctacttcctccctnttcactctctgacacagactcgtggacgtcctactagtggacgctacgaccacgaccgccctaccggttgggtcgtaccgtacggttcccggaaccccggaagggacgaccgggaccggtacgaaggcttccgaccgttggaccgttcggtaggggaatcgttacgaacctacggtaacgaaaccgaaagtactaaagtttacggtcttacgttacggtaaccggacgaggaacgtaacggacgccggtacggtacccgtccggtcgtggagtcgtaggaataataagtaaacgacgaggtacggacggacggtaccgtcgtagggacgtccgtacgtaggtaccggtattccgttcgtacggtaccgtccgtaacgcgtacggaacgggacaactacgtacgttacgtacgtacacgtaggtacggtaggtcggaacgaggaacgaagaggacgtaggcgtaagtctaacgttatagtacgtanacaacgcgtaacgacgtaacgngttaaggttggttacgtttagggttcggttacgggacggttacggaacggtacttcggaacggtttacgaccggtacgtacggaccgaaccgccggtacgtccggtccccg

SEQ ID NO: 120374 - DNA, 653 bp, Homo sapiens
  misc_feature: GYAE6OF02JKHHX.2.38.D05.1.454.CMB.1.raw
  modified_base (526)..(526): a, c, t, g, unknown or other
  misc_feature (526)..(526): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacacgacggccgaggactccacctgctcgtaggagatgctattcgaccaaagacaatatgcttagttcggtaccagcaagaacgccaggccacggccctgtcgcgtggtgatataataaagcagtgaagcggccctgaacgggtactccgagtacgcgtactttcgtcgtcggcctacgacgtccgtacgaaggtaaccaacgtacgtccgaacgttcgaacctagtcgaagggtcggtacgtaccgaggacctaaggaacggtacgtaggacggtcgtagtaacctttagttaccgtaacgttactaactacggaaacgcgaacgtaaccnggtaatacgggtttggttttacccggttttggggtacggtacgggtaacggggtaacgtaacgtaacgtcggtaccgttaccggttaccggtacggtccgaaccgggttacccggtacggtacccgg

SEQ ID NO: 120375 - DNA, 540 bp, Homo sapiens
  misc_feature: GYAE6OF02IJ36H.2.38.D05.1.454.CMB.1.raw
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (437)..(437): a, c, t, g, unknown or other
  misc_feature (437)..(437): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccagggagggctggtgtgggtctcacgtattaatagtgatgggagtagcacaagctacgcggactccgtgaaggccattcaccatctcagagacaacgccaagacacgctgtatctgacaaatgaacngtcngagagccgaggacacggctgtgtattctgtgacaaagngatagcagcaagctagggtaccgccgaacgtacggtcgggggacccaacgggggaaccccttgggtaccctaacccggttccttacccgtccgacggtccccc

SEQ ID NO: 120376 - DNA, 583 bp, Homo sapiens
  misc_feature: GYAE6OF02G2JSB.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccggggggaggcttagttcaggccgtggggggtccctgagactctcctgtgcagcctctggattcaccttcagtagctactggatgcacgtgggtcccgcaagcctaccgaggggaaggggctgggtggtgggtctcgacgtattaagtagtgagtgggagtagcacaagctacggcggtactcgtaggaacgggccgtattccacactcctccgaagacgaacaccgaccaaagacacgctagtactctagaacaaagtgaaacctgtccaggaagacgaccgaggaccgacggtctggtatattacgtgtacgacaaggagtaatcggacgtaggactacggccgttaacgggtacccggacccgtaggttaacccgggg

SEQ ID NO: 120377 - DNA, 645 bp, Homo sapiens
  misc_feature: GYAE6OF02HB3KD.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaggtgtccagtgtgaggtgcagctggtggaggtccgggggaggcttagttcagccgtggggggtccctgagactctcctgtgcagcctcgtggattcaccttcagtagctactggatgctacgtgggtcccgccaagcctccgaggggaagggcgtggtgtgggtctcgacgtattaagtgtgagtgggagtagcacaagctacggcggtactccgtaggaacggccgtattcaccgtatccgtaccaagacgaacaaccgaccaaagaaccacgcttagtaactcgtacgaacgtaaatcgaaacaggtacttaggaaacggacgtcccggaaggtaacccgaacgggtccttaggttacggttactttaccgtagggtacgaccggtaaaggtaagtacgaacggtaccgaaggacccgtaagggtcccgttaacggggttaacccggacccggttaacccggttaacccgggggg

SEQ ID NO: 120378 - DNA, 506 bp, Homo sapiens
  misc_feature: GYAE6OF02GVIEG.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcgagggacaacagtcacgttgaccatcagtggagtccaggcagaagatgaggctgactattactgtcaatcagcagacagacagttggttacgtttttgggtgtttcgggcggaggtacgaagcgtacgaccggtcctaggtccacggcccgaaggtcccg

SEQ ID NO: 120379 - DNA, 537 bp, Homo sapiens
  misc_feature: GYAE6OF02F71KK.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccaggggaaggggctggtgtgggtctcacgtattaatagtgatgggagtagcacaagctacgcggactccgtgaagggccgattcaccatctccagagacaacgccaagaacacgctgtatctgcaaaatgaacagtctgagagccgaggacacggctgtgtattactgtgcaagagatagcagcagctggtacgccgactacgtggggccagggaaccctggtcaccgtctcctcacgccctccaccgaagggcccagtccggtccttccccgtggccgccctcgcctccgacgggacgccacccgtccgagacgcaccgagccggtcccg

SEQ ID NO: 120380 - DNA, 525 bp, Homo sapiens
  misc_feature: GYAE6OF02F6NSR.2.38.D05.1.454.CMB.1.raw
  modified_base (313)..(313): a, c, t, g, unknown or other
  misc_feature (313)..(313): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctnagggatccctgacgcgattctctggctcagctcagggacaacgagtcacgttgaccatcagtggagtccaggcagaagatgaggctgactattactgtcaatcagctagacagctagtggttacgtttttgggtcggttcgggtcgggtaacgggaccgaaggtccgtaggtacccggttcgtaaggtccgacggtaccccgaaggtccccg

SEQ ID NO: 120381 - DNA, 806 bp, Homo sapiens
  misc_feature: GYAE6OF02IF328.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtgggggtccctgagactctcctgtgcagcctcgtggtacttccaccttcgagtacgctacgtggatgctacgtggtcccgacagctaccgagggagggcgtggtggtggtctcgacgttataagtagtgagtgggagtagacacgaagtcgtacggacggtaccgttccggtacggaacggggacccgtaacgttacccgaacccgtacgttacccgtaccgaaacggaacgtaaccccgaaacccggtaacccgaaaaacggaacccgaaccggtccctttaaggttaaaccttcccgttaaggaaacccgtaaaaagtttaccggaaaacccgtagggtttacccgtaaagggaaacggggtaaccccgggaaccccgggaaacggggtaaccccgtaacccgggggttacgtttaaggggtttaaccgttttaaccgttttaacggttcgggttaaccggtaaaccggaaaaaggtaacgtaaacggttaaccggccgtaaaaccgggtcgaaaccggggttaccggtttacccggggggtaaccccctacccccgggttaaccggttaaccccgggggg

SEQ ID NO: 120382 - DNA, 810 bp, Homo sapiens
  misc_feature: GYAE6OF02JS9ET.2.38.D05.1.454.CMB.1.raw
  modified_base (144)..(144): a, c, t, g, unknown or other
  misc_feature (144)..(144): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (436)..(436): a, c, t, g, unknown or other
  misc_feature (436)..(436): n is a, c, g, or t
tcagacgctcgacacacgaccggtgctcgatttagtatctgatagttgggtttgggggtaaggtaggaaggacgtggacggtccgtgccgacaggtggtgcgtgggcacggtgggcgacgtcggacgaacaacattttgcgctnaacctgtccttgtccagttgtgaggtgcagctggtggagtcccgggggaggtcttagttcaggccgtgggggtcctgagcttcgtcctggtgcnggctcnggtnttcaccgttnagtagctacgtggngtcncgtacgtcggtccgtccgaacgtctccggaaggggtacgggcgtacgggttggtcggggttctccgtaccggttaagttacgtacgttgtaagttgggaggttagcgtaacgtaaacgcgtaaccggtcgggaccgttccggtacggacggggtaaccgngttaaccgtaccgaccgttctacccgaggtaaacggtacaaaaccccggagtaaaccggaaacaccggtacgtacggttaacttccgtaaagacccgtaaagtaacggaacgttaacggaccttaagggacggtaaaccgaccggggaacggaccggtaaccgggcttaacggttacgttaacgtttacttaggtacgggtaacctaaagggacgggttaactaacgggtactaacggtaacccgtaagggtccgtttaacggggtaccgacccggttaacccggttagggaacccgggggttacccgaaccggggttaaccgtaaccggggtccttaccccggtacgttaccccgttccggaacgtcccccgg

SEQ ID NO: 120383 - DNA, 652 bp, Homo sapiens
  misc_feature: GYAE6OF02IY7GC.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctcctatgagctgacacagcccaccctcggtgtcagtcgtccccaggacagacggccaggatcacctgctctggagatgcattcgaccaaagcaatatgcttattaggtaccagcaagaacgccaggccacggcccctgtgcgtggtgataatataaagacgagtagaggacggtccctcgaggggtactcccgtgacgcgtattctcgtggcctccgagctacgacgggaaccaacgtacgtcgtaccgttgaacccagtactaggtgggacgtccgacgggacaaggaagagttaggaggtctaggtaacttagtttacgtcgttaactaatcgaagcgaagaccaacggtacgtaaggtttcgggtttttaacggttttttcgggggttacggtttaccgggggtacggggtaaccgggaaacccgtaaggtcccgttacgggttaaccccggtaccgtttagggtacccgaaccgggtaccccgtaacgggtcccccgg

SEQ ID NO: 120384 - DNA, 526 bp, Homo sapiens
  misc_feature: GYAE6OF02JAJAX.2.38.D05.1.454.CMB.1.raw
  modified_base (399)..(399): a, c, t, g, unknown or other
  misc_feature (399)..(399): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcgagggactcccgtgagcgattctctttggctccagctcgagggacaacgagtcacgttgaccatcgagtggacgtcaggcagaagntgaggctgtactattacgtgtactaagtcagacacgacagcgagttaggtttacgttttgggtgttcgggcggtacgggtaaccgaagcgtacggtaccgtcgttaggcacggtacccgaggtcccg

SEQ ID NO: 120385 - DNA, 596 bp, Homo sapiens
  misc_feature: GYAE6OF02J3K3A.2.38.D05.1.454.CMB.1.raw
  modified_base (199)..(199): a, c, t, g, unknown or other
  misc_feature (199)..(199): n is a, c, g, or t
  modified_base (319)..(319): a, c, t, g, unknown or other
  misc_feature (319)..(319): n is a, c, g, or t
  modified_base (343)..(343): a, c, t, g, unknown or other
  misc_feature (343)..(343): n is a, c, g, or t
  modified_base (389)..(389): a, c, t, g, unknown or other
  misc_feature (389)..(389): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccnccaagctccgaggggagggctgggtgtgggtctcacgttattaatagtgagtgggatagcacaagctacgcgactccgtgaagggccattccaccatctccagacgacaacgccaagacncgctgtactctgacaaatcgaacngtcaggacgacgaccggaggaccacggtcttagtacgtattaccgngtacgacaagagatacgcagcgtagcgtacggaccgccgtacgtacgggtcgggaccgaacgggtaccctcggtccaccgtcctccgtacgcccgtaccctacccgaaccggacggtcccacgttccccgtacccttccccgnggtcccncccgttcgcccgtcgacggaccgtccaccgtcgagccgacaccgacggcccggtccg

SEQ ID NO: 120386 - DNA, 489 bp, Homo sapiens
  misc_feature: GYAE6OF02HOL69.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaaagcaatatgcttattggtaccagcagaagccaggccaggcccctgtgctggtgatatataaagacagtgagaggcctcagggatccctgagcgattctctggctcagctcagggacaacagtcacgttgaccatcagtggagtcaggcagaagatgagctgactattactgtcaatcagcagacagcagtgtattttgggtgttcggcggaggaccaaggtcaggtaccgtcgtaggtcaggcccgaaggtccg

SEQ ID NO: 120387 - DNA, 576 bp, Homo sapiens
  misc_feature: GYAE6OF02GIFN3.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaaggccaggcccctgtgctggtgatataataaagacagtgagacggccctcgaggggactcccgtggagcgatttctctggctccagctcgaagggacaacgacgtacacgtttcgaacctatcgaggttgggacgtccagggaccaggaaagagtaggaggtcgtagacttaattaccgtgtacaagttccagaccagacagcgtagttaggtttacgtttttggggtgttcggggacgggtagggaacccaaggtaccgttacggtacccggttcgttaacgggtccaacgggtacccgaaggtccccgg

SEQ ID NO: 120388 - DNA, 596 bp, Homo sapiens
  misc_feature: GYAE6OF02H5I6N.2.38.D05.1.454.CMB.1.raw
  modified_base (392)..(392): a, c, t, g, unknown or other
  misc_feature (392)..(392): n is a, c, g, or t
  modified_base (432)..(432): a, c, t, g, unknown or other
  misc_feature (432)..(432): n is a, c, g, or t
tcagacgctcgacacacgaccggtgctcgatttagtatctgatagttgggtttggggggaagaggaagactgacggtctgccacgaggtggtgctcgggcacggtgggcactcgacacaacatttgcgctcaactgtcttgtccagtgtgaggtgcagctggtggagtccggggaggcttagttcagcctggggggtccctgagactcctcctgtgcagcctctggattcaccttcagtagctactggatgcactgggtccgccaagctccgagggaaggggctggtgtgggtctcagtattaatagtgatgggagtagcacaagctacgcggactcgtgaaggccgattcactatctccaagacgacaacgccaaagacacgctgtactcngacaaatgaaactagtctagagtagccgtagacagtcggntggtagtaattacgtgttacgacgaaaggtacgtaagtacggacgaagacgaagccgttaacgggtacccgacccggtaacgttaaccgggtcggggaccccgaacggggtaaccccttcggggtaccccttaaccccggtttcttaccccgtacgtaccccgg

SEQ ID NO: 120389 - DNA, 690 bp, Homo sapiens
  misc_feature: GYAE6OF02GMHD9.2.38.D05.1.454.CMB.1.raw
  modified_base (540)..(540): a, c, t, g, unknown or other
  misc_feature (540)..(540): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagcttagttcagcctgggggtccctgagactctcctgtgcagcctctggattcaccttcagtagctacgtggatgcacgtcgggtccgaccaagcctaccggaaggggaacggggcgtgggtggtcgggttcctacgtaacgttaagttaagtaggtgagtggggagtagacaacgaacgctacggccggtacgtccggtaggaacgggccgtaattccaacctactcctaccgaagacgaacaaccgaccaaagaaccaccgtactagtactcgtagaacctaaagtcgaaactgtactaggaacgacggtaccggaaggaccacgggtcttaggtacttaatttaccgtggtacgacgaaaaggngtaacgttacgaccgtaaggacctaggtccgttacggggtacccgtacccgtaacggttaccgggtaccggggggaacccctaaacggggttaacccccgttgggtcccctaacccggtttcccttacccgtacgaccccggtacccccg

SEQ ID NO: 120390 - DNA, 496 bp, Homo sapiens
  misc_feature: GYAE6OF02I4DFB.2.38.D05.1.454.CMB.1.raw
  modified_base (311)..(311): a, c, t, g, unknown or other
  misc_feature (311)..(311): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagagccctnagggatcctgagcgattctcgtggctccagctcagggacaacagtcacgttgaccatcagcgcgaccagctatggatgagctgactatactgtcaggcgtgggacaggcaggcgttggtagttcgggcggacgggaccaaggcctggacccgtccgtaggtcacgcccaaggctccgcccctcgg

SEQ ID NO: 120391 - DNA, 536 bp, Homo sapiens
  misc_feature: GYAE6OF02JJFHO.2.38.D05.1.454.CMB.1.raw
  modified_base (261)..(261): a, c, t, g, unknown or other
  misc_feature (261)..(261): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccnccaagctccagggaagggctggtgtgggtctcacgtattaatagtgatgggatagcacaagctacgcggactccgtgaggccgattcaccatctccagagacaacgccaaagacacgctgtatctgacaaatgaacngtcnganagccgaagacacggctgtntattacngtgacaagagatagcagcagcctgggtaccgaccgtacgtacggtcggggacccaacggggtaaccctgggtacctacccggttctcccgtaccacggtaccccg

SEQ ID NO: 120392 - DNA, 544 bp, Homo sapiens
  misc_feature: GYAE6OF02ILMP1.2.38.D05.1.454.CMB.1.raw
  modified_base (328)..(328): a, c, t, g, unknown or other
  misc_feature (328)..(328): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagaagccaggccaggcccctgtgctggtgatatataaagacagtgagacggccctacgagggactcccngagcgattctctggctccagctcgagggacaacagtcacgttagacctatcagtggagtccgaggcaagaagagtaggagctgacttattactgtacaatcgagcaagacgagtcgaagttggttacgtttttgggcgtttacgggcgggtaacggtaccgaacggtccgttacggacccggttaccgtagggtaccacggtacccgaaggtcccg

SEQ ID NO: 120393 - DNA, 542 bp, Homo sapiens
  misc_feature: GYAE6OF02GN6R5.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgttattactgtgcaagagatagcagcagcgtggtacgccgactacgtcggggaccacgggaccctggtccaccgtctcctcacgccctccaccgacggcccagtccggtccttccccgtggccgccctcgcctccgacggcgaccacccgtccgacgacgccacgacggccggtcccgg

SEQ ID NO: 120394 - DNA, 708 bp, Homo sapiens
  misc_feature: GYAE6OF02IXQXR.2.38.D05.1.454.CMB.1.raw
  modified_base (286)..(286): a, c, t, g, unknown or other
  misc_feature (286)..(286): n is a, c, g, or t
  modified_base (648)..(648): a, c, t, g, unknown or other
  misc_feature (648)..(648): n is a, c, g, or t
tcagacgctcgacacacgaccggtgctcgatttagtatctgatagttgggtttgggggagccccagccctgggattcccagctgtttctgcttgctgatcgagctgcacacagagactcacagtggtagttggctgagtcgttcggttttcttgttcgctttaaagttttaaaaggtcgtaccgtagttgtggaggtcgcgacgtcgttgggtggtacgggtccgggggagtcgtttagttcgacgtccgggttcggggtccctggacgtctcctccgtgtcgacncgtcctcgtggtcttcctaccttcagtcgtacctacgtgtatcgcgtacggtcgggtcccacgaacgtccgtacgggaaggggacggtcggtgggtcggttcggtcctacgtaacgtttaatttaagtcggtagtagggtaggtaagtaacgacaaacgtaacgtccgtaacggcggtaaccgttccgggaaggaacgggtccttacttacccgaacttacgtccgtaaccgaaggaccgaacgaaacccgacgaaaacgaacccgacgttacgttacggtacttcgtagaaactaaagtacgaactgttcgaagaacggcggtaccgaagtaccggcgtgtacgttagtaccttgtggaanacgtaaggacttagaacgtagagcgagttaccggttaggacccgtacgtccgtaacgggg

SEQ ID NO: 120395 - DNA, 576 bp, Homo sapiens
  misc_feature: GYAE6OF02HAZJ7.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctacgagggactcccgtgagcgtattctcgtggcctcagtctcagggacaacgagtctacggttcgaccatcaggtggacgtaccgaggacaaggaagagtgaggctagacttattacgtgtacctaattccgaagacctagaacagtacagggttacgtttacgtttttggggtggtttaccgggacgggtaacgggtaccgaaggtccggttacggtaccccggttacggtacgggtccgaaccggtcccggtaagggtccccg

SEQ ID NO: 120396 - DNA, 513 bp, Homo sapiens
  misc_feature: GYAE6OF02FS7BP.2.38.D05.1.454.CMB.1.raw
  modified_base (448)..(448): a, c, t, g, unknown or other
  misc_feature (448)..(448): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaaagcaatatgcttattggtaccagcagaagccaggccaggcccctgtgctggtgatatataaagacagtgagaggccctcaggggatccctgagcgattctctggctccagctcagggacaacagtcacgttgaccatcagtggagtccaggcagaagatgaggctgactattactgtacaatcagcagacagcagttggttacgtttttgggngtttcgggcggagggaccgaagtccgtaggacccgttccgtaggtccgacggcccgaaggtcccg

SEQ ID NO: 120397 - DNA, 517 bp, Homo sapiens
  misc_feature: GYAE6OF02GKRWX.2.38.D05.1.454.CMB.1.raw
  modified_base (260)..(260): a, c, t, g, unknown or other
  misc_feature (260)..(260): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccnccaagctccgagggaagggctggtgtgggtctcacgtattaatagtgatgggagtagcacaagctacgcggactccgtgaagggccgattcacatctcagagacaacgccaaagaacacgctgtatctgacaaatgaacagtctagagagccgaggacacggctgtgtattactgtgacgaagagatagcagcagctaggtacgccgaataccgtcggggaccagggacccctggtccaccgtcctcctcacgtccc

SEQ ID NO: 120398 - DNA, 581 bp, Homo sapiens
  misc_feature: GYAE6OF02H1A13.2.38.D05.1.454.CMB.1.raw
  modified_base (363)..(363): a, c, t, g, unknown or other
  misc_feature (363)..(363): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagcttagttcagcctggggggtccctgagactctcctgtgcagcctctggattcacctttcagtagctactggatgcactgggtccgcaagctccgagggaagggctggtgtgggtctcacgtattaatagtgatgggatagcaacaagctacgcggactccggtgaacgggccattcacatctccaganacaacgccaaagacacgctatatctagacaaatcgaaatagtctagagacgaccggaaggaccacggcttggtagtacgtttacctggttagacgaaagagtaatagacaagccagtcgttacgggtaccgcccggtaacttaacggtcggggaacccgtaacggggtaaccccttgggtacccaacccggtttcctaccctaccgaccgtacccccg

SEQ ID NO: 120399 - DNA, 639 bp, Homo sapiens
  misc_feature: GYAE6OF02H4SWB.2.38.D05.1.454.CMB.1.raw
  modified_base (568)..(568): a, c, t, g, unknown or other
  misc_feature (568)..(568): n is a, c, g, or t
  modified_base (585)..(585): a, c, t, g, unknown or other
  misc_feature (585)..(585): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggtttccttgttgctatttaaaggtgtcagtgtgaggtgcagctggtggaggtccggggagcttagttcagccgtggggggtcctggagacgtctccgtgtgcacgcctcgtggacttccaccttcgagttacgcttacgtggatggcacgttgggccgccaagcctacgagggaggctggtgtggtctcgagtattaatagtgagtgggtaagtacgactaacgaagtacctacggacgggacttccgggaggaaacgggcccgtattacgaacccgtatcccgtaccgaaggaacgaaccaaccggaccaaaagacccaacgtcgttagtactaccgtagaactaaagtacggaacctaggtacaagggaccacgggacccggaaaggacccgtaacggcgttgttaagttaacttaccggngtaacgaagaaaggtanagaacgcgtaacgtcggacggtccgttacggggtacacccggtaacgtccgggg

SEQ ID NO: 120400 - DNA, 541 bp, Homo sapiens
  misc_feature: GYAE6OF02JK586.2.38.D05.1.454.CMB.1.raw
  modified_base (198)..(198): a, c, t, g, unknown or other
  misc_feature (198)..(198): n is a, c, g, or t
  modified_base (377)..(377): a, c, t, g, unknown or other
  misc_feature (377)..(377): n is a, c, g, or t
  modified_base (439)..(439): a, c, t, g, unknown or other
  misc_feature (439)..(439): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccnccaagctccagggaaggggctgggtgtgggtctcgacgttattaatagtgatgggagtagcacaagctacgcggactccgtgaaggccgattcaccatctcagagacaacgccaaagacacgctgtatctgcaaatgaacagtctagagagccgagacagtggctgtgtattactggtnacaagagagtagcagcagcgtggacgccgactacgtgggccagggaccctggtccaccgtcncctcacgcctccgaccgtaacgggcccacgtccgtcccttccccgtgcccgcccgtcgcctccgacggacgaccgacccgtccgacgacgcacgcggcccgg

SEQ ID NO: 120401 - DNA, 709 bp, Homo sapiens
  misc_feature: GYAE6OF02FI6SK.2.38.D05.1.454.CMB.1.raw
  modified_base (569)..(569): a, c, t, g, unknown or other
  misc_feature (569)..(569): n is a, c, g, or t
  modified_base (615)..(615): a, c, t, g, unknown or other
  misc_feature (615)..(615): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcccgtgtcgcacgcctcgtggtcttcctaccttcgagtacgctacgtggtacgtcgacctacggtcgggtcccgaaccgaacgtccctaccggaaggggggtaacggggtccgttgggttgggttcgggttcctccgaacggtttaatttaaacgtaggtagtaggttagggtagtacgacaacgaacgtaccgtaccgggacggtaccgttccggtagggaaccggggccgttacttaccgaacctacttccctaccgaaggaaccgaaccgaaccgaccgaaacgaaccgaccgtctaggttactcgtacgaactaaagtacgaaactcgtcgtaggacgacgacggagaccgcggtntggtattaacttcgtggtacgaacgaaggtagtatacgactacggnacggtcgttacggaccgaccgtaactacgggaccggggaccgtaaccgggacccgttggacccgtaccccgtctacccgcgacccgtacccccg

SEQ ID NO: 120402 - DNA, 520 bp, Homo sapiens
  misc_feature: GYAE6OF02G8QK4.2.38.D05.1.454.CMB.1.raw
  modified_base (457)..(457): a, c, t, g, unknown or other
  misc_feature (457)..(457): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaaagcaatatgcttattggtaccagcagaagccaggccaggcccctgtgctggtgatatataaagacagtgaagaggccctcagggatccctgagcgattctctggctccagctcaggacaacagtcacgttgaccatcagtggagtccaggcagaagatgaggctagacttatactagtcaatcagcagacagctagtgttacgtttttgggtagttccgggngggtaacgggacctaaggcgttacggacccgttccgtacggtacacggtacccgaaggtcccg

SEQ ID NO: 120403 - DNA, 545 bp, Homo sapiens
  misc_feature: GYAE6OF02FYCOS.2.38.D05.1.454.CMB.1.raw
  modified_base (340)..(340): a, c, t, g, unknown or other
  misc_feature (340)..(340): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaaccacgctgtatctgacaaatgaacngtctgagagccgaggacacggctgtagtattacgtgtgacaaaggagatagcagcagcgtggacgccgactacgtgggaccgagggaccctggccaccgtctcctcacgccctccaccgacggcccagtccggtcccttcccgcggccgtccctggcctccgacggactccacccgtcgacgacgccacgacggcccggtcccgg

SEQ ID NO: 120404 - DNA, 534 bp, Homo sapiens
  misc_feature: GYAE6OF02HRL8I.2.38.D05.1.454.CMB.1.raw
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagaagccaggccaggcccctgtagctggtgatataataaagacaggtgagacggccctcgaggggtactcccgtgacgcgtatttctcgtggcctccgagctcgaagggacaacgtagtcacgttgacccatacgagtcggagtccgagggcaaggaagagtggagctagactattacgtgtacaatcgancagacngacaggttgttacgttttgggtgttcgggcggaggaccaggtcgtacggaccgtacgtaggtcacggccgaggtcccg

SEQ ID NO: 120405 - DNA, 567 bp, Homo sapiens
  misc_feature: GYAE6OF02I0W73.2.38.D05.1.454.CMB.1.raw
  modified_base (294)..(294): a, c, t, g, unknown or other
  misc_feature (294)..(294): n is a, c, g, or t
  modified_base (415)..(415): a, c, t, g, unknown or other
  misc_feature (415)..(415): n is a, c, g, or t
  modified_base (438)..(438): a, c, t, g, unknown or other
  misc_feature (438)..(438): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccnccaagctccgagggaaggggctggtgtgggtctcacgtattaatagtgatgggagtagcacaagctacgcggactccgtgaacgggccattccactatcctccagagacaacgcaagaacncgctgtatctgacaaatcgaacngtctaggacgaggccgaaggaccgacgggtcttggttacgttattaacctggtacgaccgtaaaggaagtaattaacggcgtaaggaccaagggccgttaggggaaccgtcccggaacgttaaccgggg

SEQ ID NO: 120406 - DNA, 551 bp, Homo sapiens
  misc_feature: GYAE6OF02FWD4F.2.38.D05.1.454.CMB.1.raw
  modified_base (359)..(359): a, c, t, g, unknown or other
  misc_feature (359)..(359): n is a, c, g, or t
  modified_base (403)..(403): a, c, t, g, unknown or other
  misc_feature (403)..(403): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctctggattcaccttcagtagctactggatgcacgtgggtccgccaagcctccgaagggaaggggctgggtgtgggtctcacgtattaatagtgagtgggagtagcacaagctacgcgactcgtgaacggcatcacatcncagagacaacgcaagacacgctgtactctagacaaatcgaaacngtctaggagacgccgaggaccacggctgtgtattacngtnacaagagatagcagcagctagggtaccgccgtaacgtacggtcggggaccctaacggggtaaccccttgggtacccacccggttcctcccgttaccgacgtacccccg

SEQ ID NO: 120407 - DNA, 517 bp, Homo sapiens
  misc_feature: GYAE6OF02G0C7Z.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaaagcaatatgcttattggtaccagcagaagccaggccaggcccctgtgctggtgatatataaagacagtgagaggcccctcgaggggatccctgagcgattctctggctccagctcagggacaacagtcacgttgaccatcagtggagtccaggcagaagatgaggctagacttattactgtacaatcagacgagacaacgctagttggttacgtttttgggtggtttcggcgggtaagggaccgaagctaggacccgtcgttacggcacggacccaggtccg

SEQ ID NO: 120408 - DNA, 610 bp, Homo sapiens
  misc_feature: GYAE6OF02GMP74.2.38.D05.1.454.CMB.1.raw
  modified_base (261)..(261): a, c, t, g, unknown or other
  misc_feature (261)..(261): n is a, c, g, or t
  modified_base (362)..(362): a, c, t, g, unknown or other
  misc_feature (362)..(362): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagccgtgggggtccctgagactctcctgtgcagcctctggattcaccttcagtagctactggatgcacgtgggtccnccaagctccgaagggaagggctggtgtgggtctcgacgtattaatgtgagtggagtagcaacaagctacgcgactccgtagaacggccgattcgaccatcnccgagagacaacgaccaagaacacgactgtatctagacaaatcgaacagtctagaagacgaccgaaggaccacggtctgttagtaactttacgtggtacgacgaaagagtaagtacgacaagcaacggtccttagggtacccgaccggtaaccgttaaccggtcggggggaaccccaaagggggtaacccccttcggggttaccctaaccccggttccgttaccccgtaccgtaaccggtaccccccg

SEQ ID NO: 120409 - DNA, 558 bp, Homo sapiens
  misc_feature: GYAE6OF02IPTDQ.2.38.D05.1.454.CMB.1.raw
  modified_base (504)..(504): a, c, t, g, unknown or other
  misc_feature (504)..(504): n is a, c, g, or t
  modified_base (528)..(528): a, c, t, g, unknown or other
  misc_feature (528)..(528): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaagggctggtgtgggtctcacgtattaatagtgatgggagtagcacaagctacgcggactccgtgaaggccgattcaccatctccagagacaacgccaagaacacgctgtatctgacaaaatgaaacagtctgagagccgaggacacggctgtgtaattactgtgacaagagatagacagcagctggtaccgccgtacgtacgtcggggaccaacggggaaccctgggtacccaccgtcctccctcgacgccctaccaaccgaacgggcccctagtccggttcccttccccgnggcccgccctcgcctccgacggcnccaccgtcgacgcgccacgcggccgtcccg

SEQ ID NO: 120410 - DNA, 555 bp, Homo sapiens
  misc_feature: GYAE6OF02HLU5T.2.38.D05.1.454.CMB.1.raw
  modified_base (260)..(260): a, c, t, g, unknown or other
  misc_feature (260)..(260): n is a, c, g, or t
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccncaagctccgagggagggctggtgtggtctcacgtattaatagtgagtgggatagcanaagctacgcggactcgtgaaggccattcacntccncagagacaacgccaaagaaccacgctgtatctgacaaatgaaacagtctagagagaccgaggacacggcttagtcgtattacgtgtacgacgaagagatacgacgagcgagcgtaggtaccggacccgtaacgtaccggtacggggacccaacggggtaaccccttcggtacccacccggttcctccctacgaccgtaccccg

SEQ ID NO: 120411 - DNA, 582 bp, Homo sapiens
  misc_feature: GYAE6OF02F4J99.2.38.D05.1.454.CMB.1.raw
  modified_base (261)..(261): a, c, t, g, unknown or other
  misc_feature (261)..(261): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
  modified_base (405)..(405): a, c, t, g, unknown or other
  misc_feature (405)..(405): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtgggtccnccaagcctccgaggggaagggctggtgtgggtctcgacgtattaatagtgagtgggagtagcacaagctacggcggactccgtgaacgggccatcacatctcaganacaacgaccaagaacncgctgtatctgacaaatgaacngtctgagacgccgagacacggcttgtagtattacgtgtagacgaaagtacgaagttacgcaagccgaagtccgtagggtaccgacccggtaacgttaaccggtcggggggaaccctaacgggggaacccctttgggacccctaacccggttcctaccccgtacgacccggtcccccg

SEQ ID NO: 120412 - DNA, 544 bp, Homo sapiens
  misc_feature: GYAE6OF02J1RO9.2.38.D05.1.454.CMB.1.raw
  modified_base (444)..(444): a, c, t, g, unknown or other
  misc_feature (444)..(444): n is a, c, g, or t
tcagacgctcgacacacgaccggtgctcgatttagtatctgatagttgggtttgggggaaggaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctctggattcaccttcagtagctactggatgcactggtccgccaagctccgagggagggctggtgtgggtctcacgtattatgtgatgggatagcacaagctaacgcggactccgtaggaacgggccgattcacctatcctccagagaccaacgccaaagacacgctgtatctgacaaatgaaactagtctagagacgccgaagacgacggctgtcgtattcgngtacgacaagagatagcagcagtctggtacgccgtacgtacgtcggggaccgtaacgggaacccttgggtaccacccggttctcccgtcgaccgtccccg

SEQ ID NO: 120413 - DNA, 490 bp, Homo sapiens
  misc_feature: GYAE6OF02ILMPY.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatcctgagcgattctctggctcagctcgaggacaacagtcacgttgaccatcagtggagtccaggcagaagatgaggctgactattactgtacaatcgagcagacagctagtgttacgttttgggtgttcggcggaggacagcgtaggccgtcgtaggcacgcccgagtccg

SEQ ID NO: 120414 - DNA, 563 bp, Homo sapiens
  misc_feature: GYAE6OF02JZYNF.2.38.D05.1.454.CMB.1.raw
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (415)..(415): a, c, t, g, unknown or other
  misc_feature (415)..(415): n is a, c, g, or t
  modified_base (524)..(524): a, c, t, g, unknown or other
  misc_feature (524)..(524): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccggggaggcttagttcagcctggggggtccctgagactctcctgtgcagcctctggattcaccttnagtagctactggatgcacgtgggtccnccaagctccaggggaagggctagggtgtgggtctcgagctattgatggtgttctgttcgcccanctacgcgcctcgngaacggccgttcaccatcgtaccagacgacaagttacgaaaacncgtctagtactctagacaaattcgaaccacccgtagacgacgccgaaggaccacgggcctattcctattagtgtacgacgtaagcaaggtacggggccgcggacgggancgtaagtcggaacgttcggaggggccctagggtaccccg

SEQ ID NO: 120415 - DNA, 759 bp, Homo sapiens
  misc_feature: GYAE6OF02JC0JH.2.38.D05.1.454.CMB.1.raw
  modified_base (173)..(173): a, c, t, g, unknown or other
  misc_feature (173)..(173): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggaggtcggggngcttagtcagccggtgggggtccctggacgacttctcctgtcgcacgcctcgtggtacttcctaccttacaacgtagctacgtggatcgactacgtgggtcccgacaacgtcctccggaaggggacgggtccgtgggtggtcgggtcctacgtaacgttaattaagtaggtgagttaggggaagtagaccaacgacgtaccgttacggccgtacctcggtaggaacgggcctaacgtccaacctatcccgtaccaaggaaccgaaccgtaaaccggaccaaaacggaacccaccggtacttagtacttaccgtacgaaactaaaagtacggaaacgtacgttcgtaaggaacggaacggtaccgggaaacggaccgtaaccggtcgttggttaacgttaacttacgttggacggtaacaaacggtaagtacgttaacgcggacgtaacggacgttccggttacgggtaacccgacccggttaacggttaccgggtacccggggggaacccgtaacggggttaacccccgttgggttaacccggtaacccccgttccgttacccgtaccggtacccgtaacccccgg

SEQ ID NO: 120416 - DNA, 625 bp, Homo sapiens
  misc_feature: GYAE6OF02J1K73.2.38.D05.1.454.CMB.1.raw
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagtcaccctcggtgtcagtgtccccaggacagacggccaggatcacctgctctggagatgcattgaccaaagcaatangcttatggtaccagcagaagccaggccaggcccctgagcgtggngatatataaagacagtgagacggccctagaggggtactccgtgagcgtattctcgtgggctaccagctacgacgggtaccaacgtcgtacacggttcgacctatcgaggtcggacgtaccgaggtcgaagaacgagtaggacggtcgttacggaacttagtttaactcggttaccaaattccgaaggactaacggaaagtacgaccggttaaggttacgggttttaccgttttgggggtacgggtttccggggaacggggttaacgggtacccgaaagtccggtaacgtaccgggttaccgggtaggttaccggaaccgggtcccggtaggttacccgg

SEQ ID NO: 120417 - DNA, 576 bp, Homo sapiens
  misc_feature: GYAE6OF02IWEBA.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattcgaccaaagcaaatatgtcttattggtaccagcaagaagccaggccacggcccctgtgcgtggtgatataataaagacagtgagacggccctgagggactcccgtgagcgtattcctctggcctcagcctcgacgggacaacgagtcgtacgttacgacctatcgaggtcgggacgtccgaggtacaaggaagagttaggacggtactaggaacttaattactcgtacaatcgagacagacaagctagttcggtttacgttttgggttggttcgggacgggtaccgggtaacaacggtcgtacggacccgttacgttacgggtaccacggtacccgacggtcccgg

SEQ ID NO: 120418 - DNA, 525 bp, Homo sapiens
  misc_feature: GYAE6OF02I7FVE.2.38.D05.1.454.CMB.1.raw
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (422)..(422): a, c, t, g, unknown or other
  misc_feature (422)..(422): n is a, c, g, or t
  modified_base (429)..(429): a, c, t, g, unknown or other
  misc_feature (429)..(429): n is a, c, g, or t
  modified_base (459)..(459): a, c, t, g, unknown or other
  misc_feature (459)..(459): n is a, c, g, or t
  modified_base (509)..(509): a, c, t, g, unknown or other
  misc_feature (509)..(509): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctactgtgcagcctctggattcaccttcagtagctactggatgcactgggtccgccaagctccagggaagggctggtgtgggtctcgacgtattaatagtgatgggatagcacaagctacgcggactcgngaaggccgatcacatcncaganacaacgcaaagacacgntgtatctgacaaatgaacagtactgacgagccggagacacggctgtntattacngtagacaaagcgatagcagcagctggtacnccgtaacgtacgtcgggggaacccagggtaaccctgggtccacccgttcncccgtacgagtccccg

SEQ ID NO: 120419 - DNA, 578 bp, Homo sapiens
  misc_feature: GYAE6OF02G5XKV.2.38.D05.1.454.CMB.1.raw
tcagacgctcgacacacgaccggtgctcgatttagtatctgatagttgggtttgggggtgggtccaggaggcagaactctgggtgtctcaccatggcttggatccctctacttctccccctcttcactctctgcacaggctctgaggcctcctatgagctgacacagccaccctcggtgtcagtgtccccaggacagacggccaggatcacctgctctggagatgcattcgaccaaagcaatatgcttattggtaccagcaagaacgccaggccaggcccctgtgcgtggtgatatagtaaagacagtgagacggccctcgaggggactcccgtgacgtcgtattctcgtggtcctccgagctacgagggaacaacgagtccgtaacgttgaacctatcgaaggtcgggaacgtccgaagggacaaggaaagagtaggaggtctagtacttaagttacgtgtacaatcgagacgagacagactaggttcggtttagttttgggtggtttacgggcgggtacgggtaccaaggtcgtacggtacccgttcgtaggtaccacggtacccgaagggtcccg

SEQ ID NO: 120420 - DNA, 687 bp, Homo sapiens
  misc_feature: GYAE6OF02G1XSI.2.38.D05.1.454.CMB.1.raw
  modified_base (182)..(182): a, c, t, g, unknown or other
  misc_feature (182)..(182): n is a, c, g, or t
  modified_base (228)..(228): a, c, t, g, unknown or other
  misc_feature (228)..(228): n is a, c, g, or t
tcagacgctcgacacacgaccggtgctcgatttagtatctgatagttgggtttgggggtgggtccaggaggcagaactctgggtgtctcaccatggcctgggactccctctacttctccccctcttcactctctgcacaggctctgaggcctcctatgagctgacacagcccaccctcggtntccagtgtccccaggacagaccggccaggatccacctgctctgganatgcattcgaccaaagctaaatatgtactttagttcggtaccagacaagaacgccgaaggacccgaacggcccctggtcgccgtggtgaattaactaagtaaacgactaggtacgaagaccggtaccctacggacggggtacctcccgtacggacgtaccgtacgtttccgtacgtcgggtccttccgagtacctacgaacgggaccaaacgtacgtcctaacggttcaacctagtacgaggtcggtacgtaccgaggtaccgaagaagtagtaggacgctagtaacttacgtttacgtactaactaactctaagtacgaactacgacgtacgtaggttacggtttaccgttttggggttacggttcggggtaacgggtaaccgggtaaccgtaacggtaccggttacggtaccggttaccggttaacggtccgaaccggttacccggtacggttcccg

SEQ ID NO: 120421 - DNA, 648 bp, Homo sapiens
  misc_feature: GYAE6OF02GGUZ4.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacgccaggatcacctgctctggagatgcattgaccaaagcaatatgcttattggtaccagcagaagccaggccaggcccctgtgctggtgatataataaagacagtgagacggccctcgagggactcccgtggacgcgattctcgtggcctcagctcgaaggggaccaaacgacgtccacggttacgaaccctatcgaggtcgggacgtaccgagggtacaaggaaagtacgttgggaacggtcgtaacgtaacttaagtttaccgtagtacgtaaacgtcgaagacgaacgtaacgaagtacgttaaagggttcgggttttaacggttttttggggtacgggtttaccgggggacgggtaacggggtaacccgtaacgggtaccgttaccgggtaacccggttccggttaacgggtaccgtaaccggtacccggtaacgggtccccgg

SEQ ID NO: 120422 - DNA, 672 bp, Homo sapiens
  misc_feature: GYAE6OF02JWRA2.2.38.D05.1.454.CMB.1.raw
  modified_base (201)..(201): a, c, t, g, unknown or other
  misc_feature (201)..(201): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
tcagacgctcgacacacgaccggtgctcgatttagtatctgatagctgggtttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtgggtcccnccaagctccgaggggaaggggctgggtgtgggtctcgaacggtattaagtaggtgagtggggagtagcacaagctaacggcggactccggtaggaacgggccgatcaccgtatctaccagacgacaacgccaagacncgntgtatcngacaaatcgaaacagtcaggagacgaccgaggaccaggctggtataattacgtggtacgacgaaagagagtacgacagcgagtccgtaggtaccgaccgtacgtacggtaggggaccggtaacggaacccgttgggtaccacccgtccgtaccgtaccgacggcccctaccgaacccggaacgggtcccctaacgttcccggtacccgtttccccgacgggtccccggtacccctcggaccccgttccggaccggggacccgccctaacccggtccccgtaacggaccgtaacccggaccggtaccggccccgggggtaccccg

SEQ ID NO: 120423 - DNA, 618 bp, Homo sapiens
  misc_feature: GYAE6OF02JTKLH.2.38.D05.1.454.CMB.1.raw
tcagacgctcgacacacgaccggtgctcgatttagtatctgatagttgggtttgggggtagccccagccctgggattcccagctgtttctgcttgctgatcaggactgcacacagagaactcaccatggagtttgggctgagctgggttttccttgttgctatttaaaggtgtccagtgtgaggtgcagctggtggagtccggggaggcttagttcaggccgtggggggtccctggagactcgtcctgtgcagccttcgtggacttcgaccttcagtagcttaactggatgcacgtcgggtccgcctaaacgcctccgaggggaacgggcgtgggtggtgggtctcgtacgtaattaagtagtgagtgggagtagacagaagcgtacgcggtactccggtagacgggtccagtccaccatcctacaagacgacgaaccgacaaagaaccacggtactcgtattactcgtaacaaaggtacgaaactagtccgttaggaacggtacggaaccgcggaaccgaccgacgttaggttacgttaacttacgtagtcggtaaccgaaaggtaccgataacggcaagccgtaggccgtagggtaaccgcccgtaaggtaccggg

SEQ ID NO: 120424 - DNA, 701 bp, Homo sapiens
  misc_feature: GYAE6OF02G4QRE.2.38.D05.1.454.CMB.1.raw
  modified_base (179)..(179): a, c, t, g, unknown or other
  misc_feature (179)..(179): n is a, c, g, or t
tcagacgctcgacacacgaccggtgctcgatttagtatctgatagtggtttggggtgggtccaggagcagtaacgtcctgggtggtacctcaccgaatcggcctggatcctctacttctcccctcttcactctctgcacaggctctgagctctattgagctgacacagccacctcggtntcagtcgtccccaggacgagacggccacggactccacctgctcgtcggagatgactattcgacccaaaagtcctaagtactggtacctttaaagttaaccggtaccgacgtacgaacgtaaccgccgacggccctacggtccccttaggtcgtcgtcggtcgtaataactaacgtaaacggactaggtagacgacgccctaggacggtactcccgtaggtacgcgtattcgtcgtacggtccgtaccgtaacgtccttacgaacggaccaacgtacgtactacggttacgaaccctagtacgtaacgtacggtacgtaccgacggtactaaggtaataacgttagtacgtctacgtaacttacgtaacgttcgtaaccgtacgtcgtacgtaccgacgtacgtacggacgtaagggttcgttacggttttgggtacggttacgggacggtaacgggtaaaccgtacggtcgttacgggtacccgttacggtacggtaccgtacggtacccgtaacggtcccg

SEQ ID NO: 120425 - DNA, 572 bp, Homo sapiens
  misc_feature: GYAE6OF02G1CLZ.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtcccgccaagctccagggaagggctggtgtgggtctcacgtattaatagtgatgggatagcacaagctacgcggactccgtgaggcattcacatctcagagacaacgccaagaacacgctgtatctgacaaatgaacagtctagagacgccggaaggaccacggctggtcgttaattacctggtacgacgaaagagaatagcgagcgagtctcgggtaaccgcccggtaacgttaccggttcgggggacccctaagggggtaacccccgttgggtacccgaacccggttcccgtcccgtaccgaccgtacccccg

SEQ ID NO: 120426 - DNA, 528 bp, Homo sapiens
  misc_feature: GYAE6OF02F3IVI.2.38.D05.1.454.CMB.1.raw
  modified_base (344)..(344): a, c, t, g, unknown or other
  misc_feature (344)..(344): n is a, c, g, or t
  modified_base (405)..(405): a, c, t, g, unknown or other
  misc_feature (405)..(405): n is a, c, g, or t
  modified_base (432)..(432): a, c, t, g, unknown or other
  misc_feature (432)..(432): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtgggtccgccaagctccgaagggaaggggctgggtgtgggtctcgacgttattaatagtgagtgggagtagcacaagctacgcggactcgngaaggccgatcacatctcagagacaacgcaaagacacgctgtatctagacaaagtgaaacngtctagagagccgaagacacggctgtntattactgtgacaagagatacgcagcagcgtaggtacaccgaactacgtggggcccaaggggaaccctggtccacccgttctcccgtacacgtccc

SEQ ID NO: 120427 - DNA, 694 bp, Homo sapiens
  misc_feature: GYAE6OF02JD5QM.2.38.D05.1.454.CMB.1.raw
  modified_base (295)..(295): a, c, t, g, unknown or other
  misc_feature (295)..(295): n is a, c, g, or t
  modified_base (346)..(346): a, c, t, g, unknown or other
  misc_feature (346)..(346): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggatcacctgctcgtgggagatgctattcgaccaaagcaatatgcttattggtaccagcagaagccaggccaggcccctgtcgctggtnatatataaagacagtgagaggccctcgagggactcccgtgacgcgatttcnctggcctccagcctcgagggacaacgtagtacctacggtttcgaaccctagtaccgaggtcgggacgttaccgagggtaccaaggaacgagttaggacgggtacttaacggaaccttaagtttaccgttcggtaactaaacgttcgaacggaccgtaaggaaaccgtaggtaccgttaaggggtttacgggttttaaccgtttttttcggggggttacggtttacccgggggtacgggggtaacggggttaaccccgtaagggtacccgtttaccgggtaaccccgggttttacccgttaaaccgggggttccctaaccggggtacccccggtaagggttccccccgg

SEQ ID NO: 120428 - DNA, 573 bp, Homo sapiens
  misc_feature: GYAE6OF02H1G7V.2.38.D05.1.454.CMB.1.raw
  modified_base (373)..(373): a, c, t, g, unknown or other
  misc_feature (373)..(373): n is a, c, g, or t
tcagacgctcgacacacgaccggtgctcgatttagtatctgatagctgggttttccttgttgctattttaaaaggtgtccagtgtgaggtgcagctggtggagtccgggggaggctttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactcgtgaaggccgattcaccatctccagagacaacgccaaagaacacgctgtatctgacaaatgaacagtcagagagccgaggacacggctgtgtaattacngtgacaagagatagcagcagctggtacgccgacgtacgtcggggaccgacgggaacccgtcggtcaccgtcctccgtcgacgtccctacccgaacccgaacgggcccacgtccggtccttccccgtcggcccgtccccgtcggccctacccgacggaccgccgacccgtaccgacgacgaccgacgacggccggtcccgg

SEQ ID NO: 120429 - DNA, 600 bp, Homo sapiens
  misc_feature: GYAE6OF02GNFR9.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggatcacctgctcgtggagatgctattgaccaaagcaaatatgtcttattggtaccagcagaagccaggccacggcccctgtgcgtggtgatataataaagacagtgagacgcctgaggactccgtgagcgtattctctggctccgagctacgacgggacaacgacgtctacgttcgaacctagtcaaggtggacgtccgaggacaaggaagagtaggaggtctacgtaacttattactgtactaagtcgaagacgacgaacacgacgtaaggtttacggtttacggtttttggggtcggtttaccggggacgggtaacgggtaaccgtaaggttccgttaccgggtacccgttcggtaaccggtccggaaccggtacccggaacggtccccgg

SEQ ID NO: 120430 - DNA, 519 bp, Homo sapiens
  misc_feature: GYAE6OF02I7P7E.2.38.D05.1.454.CMB.1.raw
  modified_base (408)..(408): a, c, t, g, unknown or other
  misc_feature (408)..(408): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (466)..(466): a, c, t, g, unknown or other
  misc_feature (466)..(466): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggatagcacaagctacgcggactccgtgaaggccattcacatctcagagacacgaccaagaacacgctgtatctgacaaatgaacagtctaggagngaccgaggaccaggctgtgtattacgtgtanacgaagngatagcagcagcgtggaccnccggactcggtgggccgacgggaccctggccctaccgtcctccttcacgtccc

SEQ ID NO: 120431 - DNA, 616 bp, Homo sapiens
  misc_feature: GYAE6OF02J1UYJ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattgaccaaagcaatatgcttattggtaccagcagaagccaggccaggcccctgacgctgggtcatatacgtaagactggtagacgacgccctgagggacttcccgaggacgcgtacttccgtcgtggcctcggactctacggaagggactaacaggtacctacgttacgactacttcgacgggtgacgttccgaggtacaaggaagagttcgggaagccggttagaacttaacgttacgtacggttacaacgtacgtacggacaacgtacagtaaccgttaggttacgggttttacgttttcgggttggttaccggggcgggtaacggaccgtaaggtccgtacggtacccggtacgtacggtccgaacggtcccgtaaggtccccgg

SEQ ID NO: 120432 - DNA, 492 bp, Homo sapiens
  misc_feature: GYAE6OF02F6T8W.2.38.D05.1.454.CMB.1.raw
  modified_base (314)..(314): a, c, t, g, unknown or other
  misc_feature (314)..(314): n is a, c, g, or t
  modified_base (441)..(441): a, c, t, g, unknown or other
  misc_feature (441)..(441): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaaagcaatatgcttattggtaccagcagaagccaggccaggcccctgtgctggtgatatataaagacagtgagaggccctnaggggatccctgagcgattctctggctccagctcagggacaacagtcacgttgaccatcagtggagtcaggcagaagatgagctgactattactgtcaatcagcagacagcagtgttacttttgggngttcgggcggaggaccaagtcgtgacccgtctacggtcacgccaaggtccg

SEQ ID NO: 120433 - DNA, 607 bp, Homo sapiens
  misc_feature: GYAE6OF02IMASR.2.38.D05.1.454.CMB.1.raw
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (345)..(345): a, c, t, g, unknown or other
  misc_feature (345)..(345): n is a, c, g, or t
  modified_base (409)..(409): a, c, t, g, unknown or other
  misc_feature (409)..(409): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactggggtccgcaagctccgaggggaaggggctggtgtgggtctcacgttattaatagtgatgggagtagcacaagctacgcggactccgtgaaggccattcaccntcncagagacaacgccaagaaccacgctgtatctagacaaatgaacagtcnggagacgccggaaggacacggctgtcgttaatttactggtcgactaagagatagacaggcaggngtacgggtaccgccgaaccgtacggtcgggggacccgacggggaacccgttggtacccgtacccgtccgtccctccgaccgtccctacccgaacccgaaccgggcccctacgttcccggttcccttcccccgtcggcccgcccgtcggccctccgacggccgaccacccgtccgacgacgccgacgcgcccggtcccg

SEQ ID NO: 120434 - DNA, 647 bp, Homo sapiens
  misc_feature: GYAE6OF02JESY2.2.38.D05.1.454.CMB.1.raw
  modified_base (495)..(495): a, c, t, g, unknown or other
  misc_feature (495)..(495): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcttgggttttccttgttgcttaattttaaaaggtgtccagtgtgaggtgcagctggtggaggtccgggggaggtcgttagttcgagccgtggggggtccctggagtactctccgtgtgcacgcctgtggacttccaccttcgagttacgcgtactggatcgctacgtcggggtcccaccgaagcctaccggaagggaggggctgggtcgtgggtctacgaacgttaagttaagtaggtgtaggtaggggagtaggactaacgaagtaccgtacggacggtactacccggtggaacgggcctaacgttacacccgtatccgtacaggtaacgaaccaacgaccaaagaactacgntagtatcgagaacaaatcggaaactcgtgtaggacgacggaccggagaccgacgtgtacgtagttaacttacgtgtacgaacgtaaggaagtactaacgggacagtaccgtacgtaccggtacggtaaccccggtaccgtaccgtaacgggg

SEQ ID NO: 120435 - DNA, 614 bp, Homo sapiens
  misc_feature: GYAE6OF02IR1YJ.2.38.D05.1.454.CMB.1.raw
  modified_base (333)..(333): a, c, t, g, unknown or other
  misc_feature (333)..(333): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatccacctgctctggagatgcattcgaccaaagcaatatgtacttattggtaccagcaagaagccaggccacggcccctgtcgcgtggtgataatataaagacagtgaggacgcctgaggactccgngagcgtattcctcgtggtcctcgagtcctacgaacgggaccaacgacgtaccgacgttacgacctatacgaggtgggacgtccgacggacgaaggaagtagttggaggtaccgtagtacttactacgttagtactaacgtccgaagtacaacgacgacgtacgttaaggttcggttttaccggttttggggtacggtttacgggacgggtaacgggtaaccgtaaggtcccgttacggacccggttcgtacggtaccgaccggtacccgaacgggtccccg

SEQ ID NO: 120436 - DNA, 693 bp, Homo sapiens
  misc_feature: GYAE6OF02F4T4H.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggatcacctgctctggagatgcattgaccaaaagcaaatatgtcttattggtacagcaagaagccaggccacggcccctggtgcgtggtgatataataaagacagtgagacggccctagagggactcccgtgacgacgtactttcgtcgtacggtcctccgagccgtacgaacgggtaaccaaacgtacgtaccgtaacgtttacggaacctacgtacgtaagggttagggtacgtaccgtaacgggaacgaaaggaaagtaggttacggaacgggtcgtacgttaacgttaatttaccgttagtaacctaaatacgaacgtacgaacgtacgtaacgtacgtaagggtttaccgggttttacggttttttcgggggttacgggttaccggggtacggggaaaccggggtaaccgtaacggtccgtaccgggtacccgttacccgggttaacggtaccgacccggtacccggtaaccggttccccgg

SEQ ID NO: 120437 - DNA, 561 bp, Homo sapiens
  misc_feature: GYAE6OF02GNCDU.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgccaagctccgagggaagggctggtgtgggtctcacgtattaatagtgatgggagtagcacaagctacgcggactccgtagagggccgattcacatctcagagacaacgccaaagaaccacgctgtatctgacaaatgaaactgtactaggaagacgaccggaaggaccgacgggcttaggtacgttaagttaccgttgtacgaccgtaaaggacgtaagtagacaggccgaacggtccgttagggaccgacccggtactaccgggg

SEQ ID NO: 120438 - DNA, 531 bp, Homo sapiens
  misc_feature: GYAE6OF02G8MO7.2.38.D05.1.454.CMB.1.raw
  modified_base (356)..(356): a, c, t, g, unknown or other
  misc_feature (356)..(356): n is a, c, g, or t
  modified_base (382)..(382): a, c, t, g, unknown or other
  misc_feature (382)..(382): n is a, c, g, or t
  modified_base (410)..(410): a, c, t, g, unknown or other
  misc_feature (410)..(410): n is a, c, g, or t
  modified_base (504)..(504): a, c, t, g, unknown or other
  misc_feature (504)..(504): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaagggctggtgtgggtctcacgtattaatagtgatgggagtagcacaagctacgcggactccgtgaagggccattcaccatctccagagacaacgccaagacacgctgtatctgacaaatgaacagtctagagagccgaggacncggctgtgtattactggtgacaaggngatagcagcagctggacgccgactacgngggccacgggaccctgggtccaccgtcctcctcacgcctaccgacgacggcccagtcccggtcctccccgcggccgccgtcgcctccgaggccncacccgtcgagacgcacgcgccgtccg

SEQ ID NO: 120439 - DNA, 625 bp, Homo sapiens
  misc_feature: GYAE6OF02IB3ZZ.2.38.D05.1.454.CMB.1.raw
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (406)..(406): a, c, t, g, unknown or other
  misc_feature (406)..(406): n is a, c, g, or t
tcagacgctcgacacacgaccggtgctcgatttagtatctgatagttgggtttgggggagccccagccctgggattcccagctgtttctgcttgctgatcaggactgcacacagagaactcaccatgggagtttgggctgagctgggttttccttgttgctattttaaaggtgtccagtgtgaggtgcagctggtggaggtccgggggaggcttagttcagccgtggggggtccctgagactctcctgtgcagcctctggattcaccttnagtagctactggatgcncgtgggtcccnccaagcctaccggagggggaaggggcgtgggtggtgggtctacgtacgtaattaataggtgagtgggagtgcacagctacggcgactcgtagacggctatcacatccncagacacaacgcaaagacacgtctagtactctagacaaatcgaactagttcgaggaagaccggaccggaagggacccgtacgggtcgtttaaggtcgtttaactttaccggtggttaaggaccgaaaaagggtagtaaacgtaccggactaaccgggtaccaacggggtcccgttaacggggtacccggtaaccccgggtacgtttaaacccggggggg

SEQ ID NO: 120440 - DNA, 646 bp, Homo sapiens
  misc_feature: GYAE6OF02ITM9E.2.38.D05.1.454.CMB.1.raw
  modified_base (487)..(487): a, c, t, g, unknown or other
  misc_feature (487)..(487): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttggctgagcgtggttttccttgttgcttaattttaaaggtgtccagtgtgaggtgcagcgtggtggaggtccggggaggtcttagtcgagccgtgggggtcctgagactctcctgtgcagcctcgtggattccaccttcagtagctactggatgaccacgtcgggtcccgaccgaagtccgtaccgaaggggaacgggtcgtgggttaggtcgggttcgtacgtaacggttattaaagtaggtaggtaagtggggaagtaggacaacgaagccgtacgcggtaccgtcggtagacgggcctattccgacctatccgtaccgaagacaacaacgacgaaagaccacgtctagtacncgtagaacaaagtcgaactagttcgaggaagaccggtaaccgaagggtaacctcgggtcttaggtttaacgtaactttacgtggtaagaacggaaagtaacgtaagtcgacgataccggacggtaccgtacggggtaaccacccggttaagtacggggg

SEQ ID NO: 120441 - DNA, 726 bp, Homo sapiens
  misc_feature: GYAE6OF02GEZ7E.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctcctatgagctgacacagcccaccctcggtgtcagtcgtccccaggacagacggccaggatcacctgctctggagatgctattcgaccaaagcaaatatgtcttatcggtaccagcaagacgccaggccacggcccctgtcgctggtgatataataaagacagtagaggacggccctaggacgggtactcccgtgacgtcgtatttctcgtcggccttccgaagtccgtacgaacgggaacctaaaccgtacgtaccgtaacgtttacgaaccctatacggtaaggtagggtaccggttaccgaacgggaccgaaaggtaaacggtaacggttacgggaaaggtccggtaagtaaacctttaacgtttaacgttcggttaaacctaacgttacggaaacgtacgaaacggaacctaaggtaccgttaaggggtttacgggttttaaccgttttttagggggtaccggtttaccgggggtacggggaacgggttaacccgtaaacgggtcggttaaccggtacccgggttaccggtaacggggttacccgaaccggtaccccggtaaaggtccccgg

SEQ ID NO: 120442 - DNA, 508 bp, Homo sapiens
  misc_feature: GYAE6OF02FRZYK.2.38.D05.1.454.CMB.1.raw
  modified_base (418)..(418): a, c, t, g, unknown or other
  misc_feature (418)..(418): n is a, c, g, or t
  modified_base (451)..(451): a, c, t, g, unknown or other
  misc_feature (451)..(451): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttatggtacagcagaagccaggccaggcccctgtgctggtgatatataaagacagtgagaggccctcgaggggactcccgtgagcgtattctcgtggctccagctcgaggacaacagtacacgttgaccatcagtggagtccgaggcagaagataggagctagacttattacgngtacaatcgagcagacagcagtgttgtttgggngttcgggcggaggtaccaaggctagaccgttcgtaggacgacgtacccgaggtcccg

SEQ ID NO: 120443 - DNA, 630 bp, Homo sapiens
  misc_feature: GYAE6OF02I16RN.2.38.D05.1.454.CMB.1.raw
  modified_base (441)..(441): a, c, t, g, unknown or other
  misc_feature (441)..(441): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcgtggtttcgtgtagctatttaaagtgtcagtgtgaggtgcagctggtggagtccggggagcttagttcagccgtgggggtccctgagactctcctgtgcagcctctggattccaccttcagtagctactggtatgcacgtgggtcccgaccgaagccgtaccgaagggggtaacgggcgttgggtggtgggtcctacgtaacgttaattaataggtgtagtgggagtagcaacaagcgtacgcggacgtccgtagacggctatcacatctaccagacaccaacgactaaagaccacgtntagtactcagaacaaagtcgaaactgtcgtagagacggacccgaggaccgacgggtcttaggtacgttaactttacgtggtacgaacggtaaacgtacggtaagtaacgggaccaagggtcccgtaacgggttacccgtttaacggggtaaacccccggtacccgggtaacccgtttaaacccgggggg

SEQ ID NO: 120444 - DNA, 743 bp, Homo sapiens
  misc_feature: GYAE6OF02HPPEL.2.38.D05.1.454.CMB.1.raw
  modified_base (240)..(240): a, c, t, g, unknown or other
  misc_feature (240)..(240): n is a, c, g, or t
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
  modified_base (356)..(356): a, c, t, g, unknown or other
  misc_feature (356)..(356): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctggagactctcctgtgcagcctcgtggtacttccaccttcgagtacgctacgtggatgcacgtgggtccgacaagcctccgagggagggctgggtgtggtcncgacgtattaatagtgagtgggagtncagaagctacgcggactcggtggaacggccntcaccatcgtaccgagagacaacgccaagaacncgctagtactcagctaaagtgaaacngtcaagaggacgccgaagaccgacgacgtggtagtattacgtaggtcgaacgtaagaagtagtacgagacgggtaaccagggtactacggggtaaccgcccggtaaacgttacccgggcgggggaacccgtaaccggggaacccctttggggtacctaaccccgggttcccgttaccgtacccggaacccggttcccccgtaacccaaaccccgggtaaaccgggcccctaaccgggttcccggttaacccccgtttccccccggcggggtacccccgtcccccggttgggtacccccgttaccggaaaccgggtcccgaccccccgttacccgtaaccgggtaacggaccggtaaccccgacgacccgggtccccggtccccgggg

SEQ ID NO: 120445 - DNA, 707 bp, Homo sapiens
  misc_feature: GYAE6OF02JODLK.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattcgaccaaagcaaatatgtctttatcggtaccagaccaagaacgccaaggcccaacggcccctggtgcgttaggtagacttaataagtaaaagcctaaggtagaacgacgggtcccctagaaggggtacctccccgtggaacgtcgtaatttccgcgttacgggcctaccgaacgtctacgaacgggaacaacgtacgtactaacggttacgaacctacgtacgaaggtcggaacgtaccgaacggaccgtaagaaaggtatacgggaacggtactaggtaactttagttaacgtcgtaacgtaacttacgaagaccgtaactaaccgtacggtaccgtaaggtttacgggtttacgttttttacggggtcggtttaccggggaccgggttaacgggtaaccgtaacgggtacgttaccggtaaccccggtttacggtaacggttacccggaacggtacccccggtaagggtcccccg

SEQ ID NO: 120446 - DNA, 588 bp, Homo sapiens
  misc_feature: GYAE6OF02JBXUI.2.38.D05.1.454.CMB.1.raw
  modified_base (368)..(368): a, c, t, g, unknown or other
  misc_feature (368)..(368): n is a, c, g, or t
  modified_base (437)..(437): a, c, t, g, unknown or other
  misc_feature (437)..(437): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtcgggtccgccaagctccgagggaggggctggtgtgggtctcacgtattaataggtgagtggggatagcaacaagctacggcggtactccgtggaacgggcctattccacatcncagacgacaacgccaagacacgctgtatctagactaaatgaaactgtctaggagacgccggaaggaccncggcttagtacgtaacttacgtggtagacgaagagacgtaggctaggcaggtccgtaggttaccggccggtaacttaccgggtacgggggaccctaaccggggtaacccgttcggtacccgtacccgttccgtccctacggaccctccccg

SEQ ID NO: 120447 - DNA, 794 bp, Homo sapiens
  misc_feature: GYAE6OF02F6H8V.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgcttaattttaaaaggtgtccagtgtgaggtgcagctggtggaggtccggggagcttagtcagccgtgggggtcctgagactctccgtgtgcagcctcgtggtacttcctacctttcaagttacgtccttaacgtggaattcggacctaaccggttcggggtaccccggacccgaaaggtcccgttacccgggaaggggggaacggggggtccgtttagggggttgggttacgggggttacctaccggtaacggtttaaattttaaaagtagggttagaaggttagggggtaagttaaggccgtaaacgaacggtccgttaaccgggaccggggtaaccgttacccgggtaacgggaaacggggccccggtaatttacccgaacccgtacttcccgtaaccgaacggaaacgaaaccgaaaccggacccaaaaagggaaacccaaccggtaccgttaggttaactccgtagaactaaaacgttacgaaactaggtactaggaacgtacggaccggaaaggaccgaccggtctggttaacgttaagttacgtggtacgaacgtaaaggaacgtataacggtaccgaagtcgaacgggtccgttaagggtacccggtaccggtaacggttaacccgggg

SEQ ID NO: 120448 - DNA, 577 bp, Homo sapiens
  misc_feature: GYAE6OF02ICVLJ.2.38.D05.1.454.CMB.1.raw
  modified_base (366)..(366): a, c, t, g, unknown or other
  misc_feature (366)..(366): n is a, c, g, or t
  modified_base (396)..(396): a, c, t, g, unknown or other
  misc_feature (396)..(396): n is a, c, g, or t
  modified_base (521)..(521): a, c, t, g, unknown or other
  misc_feature (521)..(521): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccggggggaggcttaggttcagccgtggggggtccctgagactctcctgtgcagcctctggattcaccttcagtagctactggatgcacgtgggtccgccaagctccgaagggaggggctggtgtgggtctcgacgttattaatagtgagtgggagtagcacgaagcgtacgcggactcggtagaaggccattcacatcncagagacaacgccaaagacacgtctgtacnctagacaaatgaacagtcagagacgaccggaaggacacggtctaggtcgttaagttactgtaggaccaaaggtaagacgttaaggaccaagccgaagccgtaggtaccgacccgaacttaccggnggggtaacccaagggaaccccttgggtccctaccggtcctcgtaccgacgtccccg

SEQ ID NO: 120449 - DNA, 529 bp, Homo sapiens
  misc_feature: GYAE6OF02GT9LE.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgagacacggctgtgtattactgtagacaagagatagcagcagcgtggtaccgccgaacgtacgtcgggggaccaaggggaaccccttggtacccacccgttctcccgtcgacgtcccc

SEQ ID NO: 120450 - DNA, 557 bp, Homo sapiens
  misc_feature: GYAE6OF02F3WH3.2.38.D05.1.454.CMB.1.raw
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgccacgtgggtccgccaagcctccgagggaagggctggtgtgggtctcacgtattaatgtgagtgggagtagcaacaagctacgcggactccgagaacggccatcacntctcaganacaacgccaagacncgctgtatctgacaaatgaacagtctagagacgccggaagacacggcttgtatattactgtacgacgaaagagatacgcagccaggtcctagggtaacccgccgtaactaccgggtcggggacccgtaacggggaaccccgttgggaccctacccggttcctccccgtacaccgtcccc

SEQ ID NO: 120451 - DNA, 680 bp, Homo sapiens
  misc_feature: GYAE6OF02HS7WB.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctcccctcttcactctctgcacaggctctgaggcctcctatgagctgacacacgcccaccctcgggtgtccagtcgtcccccaggacacggacggccaggatcacctgctcgtgggagatgctattgaccaaagcaatatgcttatcggtaccagcagaacgccgaggcctacggcccctggtcgctggtgatataataaagcagtagagacgggtcctacggacggtatccccgtaggaacgtcgtaactttctcgtcgggactccacggtcctacgaggggtaaaccaacgtcggtacctaacgtttcgaacccagtccgaggtacgggattcccggaaggcgaacgtaaacgagtaggtaacgggtccttaaggtacttaacgtttacacggttactaaaacgttcgaacaccggtaacggtacacgggacttaagggttcgtttaaccgggtttttggggttacgggtttacgggaccgggggtaacgggtaaccggtaacggtaccgttccggaaaccggttcccggttaaggttaccgaccgtacccgaacgggttcccg

SEQ ID NO: 120452 - DNA, 621 bp, Homo sapiens
  misc_feature: GYAE6OF02IS19G.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggccccctgtcgctggtgatatataaagacaggtgagaggccctcgaggggatcccctggacgcgtatttcctcgtggcctccgagctcgacgggaacaacgagtacacggtttacgaccatccaggtcggacgtaccgaggccaaggaaagtagtaggacggtctaggaacttaacttacgttgtacctaagtcgaagcaacggaccacggtacgtagggtttcggttttaacggttttttgggggtcggttttaccggggcgggtaacggggaaccctaagggtccgttacgggtacccggttcccggttaacgggtcccgaacggtaccccggtaagggtcccccgg

SEQ ID NO: 120453 - DNA, 613 bp, Homo sapiens
  misc_feature: GYAE6OF02IZPSH.2.38.D05.1.454.CMB.1.raw
  modified_base (226)..(226): a, c, t, g, unknown or other
  misc_feature (226)..(226): n is a, c, g, or t
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
tcagacgctcgacacacgaccggtgctcgatttagtatctgatagttgggtttggggggaaggaggaaggactgacggtcctgccacaggtggtgctgggcacggtgggcactcgacacaacatttgcgctcaactgtcttgtccagtgtgaggtgcagctggtggagtccgggggaggcttagttcagccgtggggggtccctggagactctcctgtgcagcctntggattcaccttcagtagctacgtggatgcacgtgggtccgccaagctccgaggggaaggggctggtgtgggtctcgtacggtattaagtagtgatggggagtagactagaagctacggcgactcggagaacggcgatcacntctcagcacaacgccaacgaancgctacgtatccgtagaccaaaatgaaacgagtactaggaacgaggacccgagggaccgacggcttacggtagtaactttagtaggtcgaacgaaaggtgaacgtagaccgagcgaacggtcgtacgggttaccgacccggtattaccggggcggggtacccaacgggggtaaccccttggtacccgtaacccgtcttacccccggtacgtaccggtaccccg

SEQ ID NO: 120454 - DNA, 587 bp, Homo sapiens
  misc_feature: GYAE6OF02I8DIV.2.38.D05.1.454.CMB.1.raw
  modified_base (367)..(367): a, c, t, g, unknown or other
  misc_feature (367)..(367): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtgggtccgccaagcctccgagggaaggggctggtgtgggtctcacgtattaatagtgagtgggatagcacaagctacgcggactccggtgaacgggccgatcaccatctcaganacaacgccaagaaccacgctgtatctagacaaatgaaactgtctagagacggccgaaggaccacgggcttggtagttaacttacgtgtacgacgaagaagtagtagacgtacgacgagccgtacgggtaccgacccggtaacgttaccgggtcgggggacccgaacggggtaaccccgttggtaccctacccggttctacccgtaccgaccggtaccccc

SEQ ID NO: 120455 - DNA, 715 bp, Homo sapiens
  misc_feature: GYAE6OF02JHL3L.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtcccaggacagacgccaggatcacctgctctggagatgctagttcgaccaaagcaatatgcttattcggtacagacaagtaacgccgaggccacggcccctggtcgcgttggtacgtaatattaaataaacgacaggtagaacggacggtccctaggacgggtaactcccgtaggacgtacgtacgtttctcgtcggtcctaccggacgtaccgtacggaaacggggtaacctaaacgtacggttaccgtaaccggtttacggaaccccttaagtccgtaaacgggtacgggtacggtaccgaagggtacgaaacggaaaggtacgttagggacggttactacgttaacgttacgtttaacgtacggttaacaacgttacgaacggacctaacgaacgtacggtacgttaaacggggtttagttttaccgggttttcgggtagtttccgggggaacgggtaacggacgtaacggtccgtaaggtacccggttaccgtacgggtacctaacggtacccggaaggttcccgg

SEQ ID NO: 120456 - DNA, 544 bp, Homo sapiens
  misc_feature: GYAE6OF02F27HU.2.38.D05.1.454.CMB.1.raw
  modified_base (360)..(360): a, c, t, g, unknown or other
  misc_feature (360)..(360): n is a, c, g, or t
  modified_base (396)..(396): a, c, t, g, unknown or other
  misc_feature (396)..(396): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctgagggactccctgagcgattctctggctccgagctcgagggacaacgngtcacgttgaccatcaggtgagtccaggtcagaagntagagctgaacttattactgtacaatcgagacacgacgtagacgtagttaggtttacgttttggggtcgttcgggcgggtaagggaaccgtaacggtcgttacggacccggttccgtaaggttccgaacggtccccgaagggtccccg

SEQ ID NO: 120457 - DNA, 563 bp, Homo sapiens
  misc_feature: GYAE6OF02G5AFZ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattgaccaaagcaatatgcttattggtaccagacagaagccaggccgacggcccctggtcgcgtggtgatataataaagacagtgagacggccctagagggactccgtgagcgtatttctcgtggctaccgagctacgagggaaccaaacgcggtacacggttgaaccctagtacgaaggtcggacgtccgaagggacaaggaacgtattagggaggtactagtaacttagtttacagtacaatcgagacagacagctagttcggtttagttttgggcggttcgggacggaacggactagcgtacgaccgtactaggtacgaccgaccgagtcccg

SEQ ID NO: 120458 - DNA, 669 bp, Homo sapiens
  misc_feature: GYAE6OF02G9HV5.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccggggggaggcttagttcagccgtggggggtccctgagactctcctgtgcagcctctggattcaccttcagtagctactggatgcacgtgggtccgccaagctccgaggggaaggggctgggtgtgggtctcgacgttattaatagtgagtgggagtagcaacagcgtacgcggacctccggtaggaacgggccgattccacctatcctacccgagacgaaccaaccgaccaaaagaaccaccgcttagtaactcgtagaacctaaaatcggaaactagtctaggaacggacggaccggtaaggaaccgccgggtcttgtaggtttaactttaccgtgggtacgaacgtaaaggagtaatacggactacggcgtaagtccggttacggggtaccgacccggtaacgttaccgggtacggggggaccccgtaaaccggggtaaccccgttcggggttaacccaccccggttcccttaccccttaccggacccggtacccccg

SEQ ID NO: 120459 - DNA, 510 bp, Homo sapiens
  misc_feature: GYAE6OF02F039W.2.38.D05.1.454.CMB.1.raw
  modified_base (280)..(280): a, c, t, g, unknown or other
  misc_feature (280)..(280): n is a, c, g, or t
  modified_base (399)..(399): a, c, t, g, unknown or other
  misc_feature (399)..(399): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgngctggtgatataataaagacagtgagaggccctcgagggactcccgtgacgcgattctctggctccagctcgaggacaacgagtcacgttgaccatcgagtggacgtcgaggcagaagntgaggctgactattactgtacaatcgagcagacagcagttgttacgttttgggtgtcgggcggaggaccgaagtctaggaccgtccgtaggtccgacgtcccgaggtcccg

SEQ ID NO: 120460 - DNA, 602 bp, Homo sapiens
  misc_feature: GYAE6OF02H7QVM.2.38.D05.1.454.CMB.1.raw
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
  modified_base (382)..(382): a, c, t, g, unknown or other
  misc_feature (382)..(382): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggagggctggtgtgggtctcacgttattaatagtgagtgggagtagcacaagctacgcggactcgngaaggcatcacntctcanacgacaacgccaagacacgctgtatcagacaaatgaacngtctgaagacgccgaggaccacggctgttagtattacgtgtgacaaagngtagtacgacgagcagtcgtagggtaccgccgtaacgtacggtcggggaccgtaacgggtacccgtcgggtacccacccggttcctcccgtccgaccgccctacccaccgacgggccctacgtccgttcccttccccgcggcccgtccccgtagccctaccggacggaccgacccgtacccgtaccggaacgaccgaccgtaccgcggacccggtcccgg

SEQ ID NO: 120461 - DNA, 761 bp, Homo sapiens
  misc_feature: GYAE6OF02GFE5T.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactcctctgtgcacgcctcgtagtactcctaccttacgagtacgacttacgtggtatcgactacggtccgggtcccgaccgaacgtcctaccggaagggggtaacgggtcgttgggtggttcgggttcctacgtaacgttaattaagtacggtagtagggtagggtaaggtacgacgtaacgaacgtaccgtaaccgggtaccggtaccgtccggtaaggggaaccggggtacccgttaacgtttacccaaccgtaccgttaccgtaaccgaaggtaacgtaaaccgaacccgaaccgaaacgaacccgaccgtacgtagttaactcgacgaaactaaagtacgaatacgtcgtaggaagaccggccggaacgaccggtcgtagttgtagtttaaccttgtagacgaacgaaagttaggaacgttacggaactcgacgacgtcgggttacggacccgacccgttaacggttaccgggtccgggggaacccgttaacccggggtacccgtttcggtacccgtaaccccggttctaaccccgtacgcccggtaacccccg

SEQ ID NO: 120462 - DNA, 562 bp, Homo sapiens
  misc_feature: GYAE6OF02IFG8P.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattcgaccaaagcaatatgcttattggtaccagcagaagccaggccaggcccctgtgctggtgatatataaagacagtgaggacggccctacgaggggactcccgtggacgcgtatttctctggctccagtctcgagggacaaacgagtcacgttacgaaccatcgagtggacgtcgaggcaggaagatagaggctagactatactgtacaatcagcagacagacgtagttggttacgtttttggggtggtttcgggacgggtacgggaaccgtaaggtaccgtacggtacccggttaccggttaacggtaccgtacggtaccccgaaggtcccgg

SEQ ID NO: 120463 - DNA, 749 bp, Homo sapiens
  misc_feature: GYAE6OF02J0ER6.2.38.D05.1.454.CMB.1.raw
  modified_base (222)..(222): a, c, t, g, unknown or other
  misc_feature (222)..(222): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctgganatgcattgaccaaagcaatatgcttattggtaccagcagaagccaggccaggcccctgtgcgtggtgatatataaagacaggtgagacggccctcgaggggactccccgtgacgtcgtattctcgtcggcctccgagctacgagggacaacacgtacacgttacgaccatcgagtcggacgtccgaggacaagaaaggagttacggacgggtactacggtaacgttaacgtttaaccgtacgttaccgtaaacgtaccgtaaacgtaccgaacggtaaccgtaacggtaaccggttaaacgggttttaacggggttttaaccgggtttttttacgggggtttaccggggttttaacccgggggtaaccggggggttaaaccgggggttaacccgttaaaccggggttaccccgggttttaacccggggttaaaccccccgggttttaacccgggtttaaaccccgggggtttaccggtaaaacccccggggttaacccccgggtaacccggggtttaaccccccggg

SEQ ID NO: 120464 - DNA, 596 bp, Homo sapiens
  misc_feature: GYAE6OF02HWZE1.2.38.D05.1.454.CMB.1.raw
  modified_base (223)..(223): a, c, t, g, unknown or other
  misc_feature (223)..(223): n is a, c, g, or t
  modified_base (369)..(369): a, c, t, g, unknown or other
  misc_feature (369)..(369): n is a, c, g, or t
tcagacgctcgacacacgaccggtgctcgatttagtatctgatagttgggtttgggggaaggaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagccctntggattccaccttcagtagctactggatgcactgggtccgccaagctccgagggaagggctggtgtgggtctcacgtattaatagtgatggggagtagcacaagctacgcggactccggtgaacgggtcatcaccatctaccaganacaacgaccaagaacacgctagtatcgtgacaaatagaactagtctagagacgaccgaggacacggctagtgtattacgtgtacgtacaaagagtagtagacgagacgacgtcgttagggtaccggacccggtaaccgtaccgggtacggggtaccccggaaacgggtaacccccgttgggttaccccgaacccggtttcccttacccgttacccgacgtacccccg

SEQ ID NO: 120465 - DNA, 564 bp, Homo sapiens
  misc_feature: GYAE6OF02G1IVK.2.38.D05.1.454.CMB.1.raw
  modified_base (527)..(527): a, c, t, g, unknown or other
  misc_feature (527)..(527): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaggtgtccagtgtgaggtgcagctggtggaggtccgggggaggcttagttcagccgtggggggtccctgagactctcctgtgcagcctctggattcaccttcagtagctactggatgcacgtgggtccgccaagcctccgagggaagggctgggtgtgggtctcgacgtattaagtgtgagtgggagtagcacgaagctacgcgactccgtaggaacgggccgattccaccatcctaccgagaagaccaacgccaaagaaccacgcctagtaactctagactaaagtcgaaacctgtctaggaacggacgaccggaaggaccgacgggtcttggtagtacttacgtgtgacgaagagtanacgcgagcgagccgtaggtaccgcccggtataccggg

SEQ ID NO: 120466 - DNA, 619 bp, Homo sapiens
  misc_feature: GYAE6OF02IOPYU.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgccacgtcgggtccgccaagcctccgaggggaacgggctgggtgtgggtctcacgtattaagtagtgagtgggagtacgcaacgaacgctacgcggactccggtaggaacgggccgtattccgaacctattcctcaaggaacaccaacgccaaagaaccacgctagtactcgtagacaaatgaaactagtacgtagaacgtacggccggtaaggaccgtacggcgttagtcgttaacttacgtgtacgacgaaagagtaagtagacgagcgagtcggtgaccgtccggtaacccttacggacgggggtacccaacgggttaaccccgtggggttaccctacccggttcctaccgtccgaacgtacccccg

SEQ ID NO: 120467 - DNA, 532 bp, Homo sapiens
  misc_feature: GYAE6OF02GZ4S4.2.38.D05.1.454.CMB.1.raw
  modified_base (392)..(392): a, c, t, g, unknown or other
  misc_feature (392)..(392): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctatggagatgcattgccaaagcaatatgcttattggtaccagcagaagccaggccaggcccctgtgctggtgatatataaagacagtgagaggccctgagggatccctgagcgattctctggctccagctcagggacaacgagtcacgttgaccatcagtggagtccaggcagaagntgaggctagactattactgtacaatcagcagacagcagttaggttacgttttgggtacgttcgggcgggtaacgggaccgtaaggtcctacgggtacccggttaccgtagggtaccgtacggtaccccgaaggtccccgg

SEQ ID NO: 120468 - DNA, 629 bp, Homo sapiens
  misc_feature: GYAE6OF02IKXU6.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggatccacctgcctcgtggagatgctattgaccaaagcaatatgtcttagttggtaccagacaagaagccgaggccacggcccctgtgcgtggtagatataataaagacaggtgaggacggccctagacgggactcccgtagacgcgtattctcgtcggcctccgagtctacgaacggaacaacgacgtacacgttagacccatacgaggtggacgtaccgaggacgaagaaggtagtaggaggtacgagtaacgtttaactacttagtactaagtaccgaagtacgacgtaaccaggacgttaagggttacggttttacggtttttggggtaggtttcccggggacgggaacgggtaaccgtaaggtaccgttacggtacccgttaccggtaggtacccacggacccggtacggtaccccgg

SEQ ID NO: 120469 - DNA, 518 bp, Homo sapiens
  misc_feature: GYAE6OF02F34RR.2.38.D05.1.454.CMB.1.raw
  modified_base (294)..(294): a, c, t, g, unknown or other
  misc_feature (294)..(294): n is a, c, g, or t
  modified_base (394)..(394): a, c, t, g, unknown or other
  misc_feature (394)..(394): n is a, c, g, or t
  modified_base (457)..(457): a, c, t, g, unknown or other
  misc_feature (457)..(457): n is a, c, g, or t
tcagacgctcgacacacgaccggtgctcgatttagtatctgatagttgggtttgggggagccccagccatgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccnccaagctccgagggaaggggctggtgtgggtctcacgtattaatagtgatggagtagcacaagctacgcggactcgtgaagggccatcacatcctcaganacaacgccaagaacacgctgtactctgacaaatgaacagtctagagagccgaaggacacggtntagtagtattacgtgtcgacgaaagagtatagcagcaggcgtacgggtaccgcccgtaacg

SEQ ID NO: 120470 - DNA, 612 bp, Homo sapiens
  misc_feature: GYAE6OF02GIEM0.2.38.D05.1.454.CMB.1.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctatttaaaaggtgtccagtgtgaggtgcagctggtggaggtccggggagcttagttcagccgtgggggtccctgagactctcctgtgcagcctntggattcaccttcagtagctacgtggatgcacgtgggtccncgaagctccgagggaacgggctggtgtggtctcgagtattagtagtgagtgggagtagcaacgagcgtacgcggtactcggagacgggccgtattccactagtcctaccgaggacgaaccacgaccaaagaccacgtctagtaatcgagaacaagtcgaactggtctaggagacgaccgaaggaccacgggcttaggtagtttaacgttaccgtgggtaacgacgtaaacgggtagtaaacgtcgggaaccctaagggacccgtaaggggtcccgtttaacgggtaaccccggtcccgggttaaaccgttacccgggg

SEQ ID NO: 120471 - DNA, 605 bp, Homo sapiens
  misc_feature: GYAE6OF02GV1ZJ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatataataaagacagtgagacggcccgtcgaggggactccccgtgaacgcgtaactttcgtcgtagggcctccgagcctcgaaggggtaaccaaacgtacgtacctacggttacgaaccctaagtcgaggtcgggacgtccgaagggctaaggaagagtggaacggtctagaacttattacgtgtactaatcgacgtacaagacagacgtaaggttcggtttacgtttttggggtcggttacggggacgggtaacgggtaccgtaacgtaccgtaggtacccgttcggttaggtaccgacggtacccgtaggtcccgg

SEQ ID NO: 120472 - DNA, 589 bp, Homo sapiens
  misc_feature: GYAE6OF02JGSGW.2.38.D05.1.454.CMB.1.raw
  modified_base (299)..(299): a, c, t, g, unknown or other
  misc_feature (299)..(299): n is a, c, g, or t
  modified_base (382)..(382): a, c, t, g, unknown or other
  misc_feature (382)..(382): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgagtgggagtagcacaagctacggcggactccgtgaacgggccgattcaccatcnccagagacaacgccaagacacgctgtatctagacaaatgaacagtcagagacgccggaaggacacggctggtagtatttacgnggtcgacaaggagatagcagcagcgtggacgccgactacggcgggccgacgggacccgtcggcctaccgtcctccgtcgaccgcccgtaccgaaccgtaccgggccctacgtccggttcccgttccccgtcggcccgcccgtcgtcccgtcccgacggtccgccgacccgtaccggacggaccgaccgaccgacggcccgtcccggg

SEQ ID NO: 120473 - DNA, 634 bp, Homo sapiens
  misc_feature: GYAE6OF02IPFZQ.2.38.D05.1.454.CMB.1.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
tcagacgctcgacacacgaccggtgctcgatttagtatctgatagctgggtttccttgttgtctattttaaaaggtgtcctagtgtgaggtgcagctggtggagtccggggaggcttagttcagccgtgggggtccctggagacgtctcctgtgcagcctctggattccaccttcagtagctacgtggatgcactgggtccncaagcctccgaggggacgggctggtgtgggtctcgacgtattaatagtgagtgggatagcaanagctacgcggactcgtgaagggccattcaccatctaccagagacacgccaaagaaccgcctagtactacacaactaagacaacgtctagagaacgacgacggacgacggactcgtagttaacttactaggcgtaccgaaagtagtaacgtaagtacgaacggacacggtacgtacggtacggtaccgaaccggtacgtacgggaccggacggtaaccgacgtacgaccgtccgtcctacgtacgacccgtacctaccgaccggtaccgaccgtccggttacccgtccccgtacgcccgtccgtccgtccgtccgaccggtacgacccgtacccgccgtacgacgccacgtaccgaccggcccgtaccgg

SEQ ID NO: 120474 - DNA, 656 bp, Homo sapiens
  misc_feature: GYAE6OF02IXO2S.2.38.D05.1.454.CMB.1.raw
tcagacgctcgacacacgaccggtgctcgatttagtatctgatagttgggtttgggggtgggtccgaggaggcagaactctgggtgtctcaccatggcctggatccctctacttctcccctcttcactctctgcacagctctgaggcctcctatgagctgacacagccaccctcggtgtcagtcgtccccaggacaggacggccaggactccacctgctcgtggagatcgcattcggaccaaaagcaaatatgtactttagtacggtaccagacaaggaacgccgacggccacggccccgtggtcgctggtgactaataagtaaagacagtgaagacggccctagagggtactcccgtaggaacgtcgtaacttccgtcgtacggcccttcgaacgtcgtacggaacgggaccaaacgtacgtccgtaacgtacgaacctaacgtacgtaggtacggtacgtaccgtaacgggacgaacggaagtaacgtaggacgtacgtacgtaaacgtagttaccgtagtactaacgtacgacgacgaacgacagtacgttaaggtacggtttacggttttgggtacggtttacgggacgggtaacggtacgtaacggtcgtacggtaccgtcggtaacggtacgaccgtaccgacggtaccg

SEQ ID NO: 120475 - DNA, 553 bp, Homo sapiens
  misc_feature: GYAE6OF02IM0YY.2.38.D05.1.454.CMB.1.raw
  modified_base (407)..(407): a, c, t, g, unknown or other
  misc_feature (407)..(407): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagccgtgggggtccctgagactctcctgtgcagcctctggattcaccttcagtagctactggatgcactggtccgccaagcctccgagggaagggctggtgtggtctcacgtattaatagtgagtgggatagcacaagctacgcggactccgtgaacggccgatccaccatcctccagacgacaacgccaaagaacacgctagtactctagacaaatgaaacngtcagagacgccgaagacacgntgtagtattacngtgacaagagatagcagcgagtcgtacggtacccgaccgtaacgtaccggtcggggacccgaacggggtaacccgtggtccctaacccgttcctcccgtacgacgtaccccc

SEQ ID NO: 120476 - DNA, 541 bp, Homo sapiens
  misc_feature: GYAE6OF02H8DEX.2.38.D05.1.454.CMB.1.raw
  modified_base (221)..(221): a, c, t, g, unknown or other
  misc_feature (221)..(221): n is a, c, g, or t
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
tcagacgctcgacacacgaccggtgctcgatttagtatctgatagttgggtttggaggtgggtccaggaggcagaactctgggtgtctcaccatggcctggatccctctacttctccccctcttcactctctgcacaggctctgaggcctcctatgagctgacacagccaccctggtgtcagtgtccccaggacagacggccaggatcacctgctctgganatgcattgaccaaagcaatatgcttattggtaccagcagaagccaggccaggcccctgngctggtgatatataaagacagtgagaggccctnagggatcccgtgagcgtattctctggctcagctcgagggacaacgtagtacacgttgaccatcagtggagtccgaggcaagaagagtggagctagactattactgtacaatcagcagacagctagttcgttacgtttttgggtggtttccgggaacggtacggggaacctaacggtcgttacggtacccggttccgtaacgggtaccgtaccggtacccgtaaccggg

SEQ ID NO: 120477 - DNA, 751 bp, Homo sapiens
  misc_feature: GYAE6OF02IXG05.2.38.D05.1.454.CMB.1.raw
tcagacgctcgacacacgaccggtgctcgatttagtatctgatagttgggtttgggggtggtccaggaggcagaactctgggtgtctcaccatggcctggatccctctacttctccccctcttcactctctgcacaggctctgaggcctcctatgagctgacacagccacctcggtgtcagtcgtcccaggacagacggccaggatcacctgctcgtggagatcgacagttcgaccaaaaagctaaaattatagtactttaacgttggttaacccaagaccgaacggaaacgacccgaaggcccgaaccgggtccccctggttcggcggttagggtagtaattaaagtaaagtaaaaacggaaccgtaagggttaggaacggaaccgggtaccccgtacgaacggggtacctcccgtaggacggtacgtacgtttcctcgtcggtacgtcgagtcctacgaacggacaaacgtacggtactacggttacaccgtacgtacgaggtacggacgtacgaggacgtaagaaagtgtagtagctaacggtaacttaacttacgtagtaccgaattacgaacgaccgaagtaccgaaggtacgttaacgggtttaggttttaccgggttttttacgggttacggggttttaccgggaacgggggtaaccgggaaacccgtaacggttaccgtaaccggttacccgggttacccgtttaacgggacccgtaacggaccccgggtacggtaccccggg

SEQ ID NO: 120478 - DNA, 551 bp, Homo sapiens
  misc_feature: GYAE6OF02ISUSR.2.38.D05.1.454.CMB.1.raw
  modified_base (260)..(260): a, c, t, g, unknown or other
  misc_feature (260)..(260): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagccgtgggggtccctgagactctcctgtgcagcctctggattcaccttcagtagctactggatgcactgggtccnccaagctccgagggaaggggctggtggtgggtctcgacgttattaagtagtgatgggatancanaagctacgcggactccgtagaacggccattccgacatccgtaccaagagaacaaccgaccaaagaacacgctgtatcngacaaatgaacngtcagaganccggagaccagctagtnattgtgngacaagatatagcagcgagccgtaggtaccgccgtaacgtacgtcgggaccctaacgggaacccgtcggtacccgtaccggttcctcccagtcccggtaccccg

SEQ ID NO: 120479 - DNA, 527 bp, Homo sapiens
  misc_feature: GYAE6OF02I04O0.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctgagggactcccgtgagcgattctcgtggctccagctcgagggacaacagtcacgttcgaccatcaggtggagtccgaggcaaggaagagtggagctgacttattactgtacaatcgagcaagacagcgagttgttacgttttgggtgttacgggcggtacgggaccgtaaggtcgtacggacccgttacgtaggtccgacgtcccgaaggtcccg

SEQ ID NO: 120480 - DNA, 743 bp, Homo sapiens
  misc_feature: GYAE6OF02J0DLN.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacacgccaccctcggtgtcagtcgtccccaggacagacggccaggatccacctgctctgggagatgctattcggaccaaaaggccaaatatcgtcttaagttggtaccagcaagaagccgaggccaggcccctgtgcgtggcgaatataagtaagacaggtgagacggccctagagggtactcccgtagacggtcgtaacgtttctcggttacgggtacccttccgaacggtccttaccggaaggggtaacctaaaccgagttaaccgtaccggtttacgaacctaacgttacgtaagggtacgggtaacgtacccggtaagggtaccaacggggaaaacgtacgggttagggaacccgggtacgttaacggtaaccgttaaggtttaacccgtttaggttaaccgtaaaacctttcgaaaccggtacgaaccggtaactaaggaccgttaaagggttttacgggttttaaccggttttggggttacggtttaccgggtaccgggggtaacggacgtaaccggttaccgtcgggtaacccgttcggtaccggtacggaacggtaccccggtaaggtccccg

SEQ ID NO: 120481 - DNA, 531 bp, Homo sapiens
  misc_feature: GYAE6OF02HBM5I.2.38.D05.1.454.CMB.1.raw
  modified_base (397)..(397): a, c, t, g, unknown or other
  misc_feature (397)..(397): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaaagcaatatgcttattggtaccagcagaagccaggccaggcccctgtgctggtgatatataaagacagtgagaggccctcaggggactccctgacgcgattctctggctccagctcgagggacaacagtcacgttgaccatcagtggagtccaggcagaagntgaggctagacttatactgtacaatcagcaagacagctaagtggtttaccgtttttgggtcggtttcgggcgggtaacgggacctaaaggcgttacggacccggttcgtaggtccacggtacccgaaggtcccg

SEQ ID NO: 120482 - DNA, 718 bp, Homo sapiens
  misc_feature: GYAE6OF02I2FC4.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcaggcctgggggtccctgagactctcctgtgcagcctctggattcaccttcagtagctactggatgcacgtggtcccgcaagctccggaagggaggggtctgggtgtcgggtactaccgtaacgtaagtttaaagtggtacggagttaggggaagtagctaaccgaagtcctacggcggtaacctccggtaggaaacggcccgtaattaccaccgtaatccgtcgaaagacggaaccaaccgaccaaaggaccacgtactgtaaactcgtagaaccgtaaaatcgaaactcggttactggaacggtaaccggaccggtaacgggaacaccgggtacttggttagtttaacgttacgtggttaacggagaaaggtaacgtaataacggtcaaacgcggtaaccggttaccgttaggggtaacccgtacccggttaaaccgggtaacgggtccgggtaaccccggaaacgggggttcccccttaacgggttccccgtaaccgttccccggttccctacggaaccccgtttaccccgg

SEQ ID NO: 120483 - DNA, 510 bp, Homo sapiens
  misc_feature: GYAE6OF02HW75R.2.38.D05.1.454.CMB.1.raw
  modified_base (402)..(402): a, c, t, g, unknown or other
  misc_feature (402)..(402): n is a, c, g, or t
  modified_base (433)..(433): a, c, t, g, unknown or other
  misc_feature (433)..(433): n is a, c, g, or t
tcagacgctcgacacacgaccggtgctcgatttagtatctgatagttgggtttgggggtgggtccaggaggcagaactctgggtgtctcaccatggcctggatccctctacttctcccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagaagccaggccaggcccctgtgctggtgatataataaagacagtgagacggcctgagggactccctgagcgtattctcgtgctccagctcgagggacaacagtcacgttcgacatcagtggagtccaggcagaagatgagntgactattactagtcaatcagcagacgaganagttagttagtttttgggtgttcgggcggacggaccgaagtcgtgtaccgtcgtacgtacgacgtaccgacggtccg

SEQ ID NO: 120484 - DNA, 605 bp, Homo sapiens
  misc_feature: GYAE6OF02HFONL.2.38.D05.1.454.CMB.1.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccnccaagctccgagggaggggctggtgtgggtctcacgttattaatagtgatggggagtagcacaagctacgcggactccgtgaacggccgattcacatcnccagagacaacgcaagacncgctgtatctgacaaatgaacngtcagagcgcgagacncggctgtntattactggtgacaagagatagcagacacgcgtagggtacgccgtactacggtcggggaccaccggggtaccctggtccaccgtctccgacgtacgccctaccgacccggaacggtaccccaggttcccgttcccgttcccccgtgggccccgtcccgtcgtcccgttacccgaacgggtcccgtaccccgtacccgtcccgggaacgaccggccaaccccggtacgggccccgtaccccggg

SEQ ID NO: 120485 - DNA, 652 bp, Homo sapiens
  misc_feature: GYAE6OF02H5CDY.2.38.D05.1.454.CMB.1.raw
  modified_base (305)..(305): a, c, t, g, unknown or other
  misc_feature (305)..(305): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctctggattcaccttcagtagctactggatgcactgggtccgcaagctccgaggggaagggctggtgtgggtctcacgtattaanagtgatgggatagcaacaagctacgcgactccggtgaaggccattcaccatcctacagagacaacgccaagaacacgctagtaactctagacaaatcgaaacagtcctagacggacgacccggaaggtaaccgacggtcttaggtacggtttaaactttccgttaggtacgaccgtaaaagggacgtaagttacggaccgaaaggccgtaagtccggtaacgggttacccggaccccggtaacggttaacccgggttgggggggaacccccttaaacgggggtaacccccgttgggtaccccgtaaccccggtttcccgttacccgtacccgacggttacccccccg

SEQ ID NO: 120486 - DNA, 572 bp, Homo sapiens
  misc_feature: GYAE6OF02FOVBM.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggccccctgtgctggtgatatataaagacagtgagaggccctgagggactcccgtgagcgacttctcgtggctccagtctcgaggacaacgagtcacgttgaacctatacgaggtggacgtaccgagggacaaggaagataggagctagacttattactgtacaatcagacagacgagacgtagttacggtttacggttttttgggacggtttccggggtacgggaacgggtaacccgtaaggtcgttaccggacccggttccggttaacggtaccgaacggtaccccgaagggttccccg

SEQ ID NO: 120487 - DNA, 615 bp, Homo sapiens
  misc_feature: GYAE6OF02JZW4Y.2.38.D05.1.454.CMB.1.raw
  modified_base (237)..(237): a, c, t, g, unknown or other
  misc_feature (237)..(237): n is a, c, g, or t
  modified_base (263)..(263): a, c, t, g, unknown or other
  misc_feature (263)..(263): n is a, c, g, or t
  modified_base (335)..(335): a, c, t, g, unknown or other
  misc_feature (335)..(335): n is a, c, g, or t
tcagacgctcgacacacgaccggtgctcgatttagtatctgatagttgggtttgggggaaggaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctccgtgtgcagcctctggattcaccttnagtagctactggatgcacgtgggccncaagctcgagggaacgggctggtgtgggtctcacgttataatgtgatgggatagcacagcacgcgactccgngaacgggccatccacgatcacgagacgacaacgccaaagaaccacgctagtactcgacgacaaagtgaaactagtaccgtaggaacggacgtaccggaacggaccgacggtaccgttgtacgttacttaacgtgtacgaacgaaacggagtaattacggactaacgacgaacgggttccgtacgggtaacccggccgtaaaccggtacggttaccggggacccgtaacggggaaccccgttggtaccctaaccgggttcccacccgttcgaccgtccccg

SEQ ID NO: 120488 - DNA, 607 bp, Homo sapiens
  misc_feature: GYAE6OF02JHRSA.2.38.D05.1.454.CMB.1.raw
  modified_base (289)..(289): a, c, t, g, unknown or other
  misc_feature (289)..(289): n is a, c, g, or t
  modified_base (340)..(340): a, c, t, g, unknown or other
  misc_feature (340)..(340): n is a, c, g, or t
tcagacgctcgacacacgaccggtgctcgatttagtatctgatagttgggtttgggggttggggtccgaggaggcagaactctgggtgtctcaccatggcctggatcctctacttctcccctcttcactctctgcacaggctctgaggcctcctatgagctgacacagccaccctcggtgtcagtgtccccaggacagacggccaggatcacctgctctggagatgcattgccaaagcaatatgcttattgtaccagcagaagccaggccaggcccctgtcgcgtggtnatatataaagacagtgagagccctgagggactccgtgacgcgtaagtttcncgtggctcgagtctacgagggacaacgtgtacctagtcgaccatcgaggtcggacgtccgaagggcaaggaagagttacggaaggtcgtaggtaacttacgttacgtaggtactaaagttcgaacggtacgaacgtaacgacggtacgtaacgttggtttaaccggttttttggggtacggttcggggtaacgggtaacgggaaccgtacggacgttacggtacccggtttacgtacgggttccgaacgtaccccggtaaggtcccg

SEQ ID NO: 120489 - DNA, 523 bp, Homo sapiens
  misc_feature: GYAE6OF02HBC4K.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagaagccaggccacggcccctgtgctggtgatataataaagacagtgagaggccctcgagggactccctgagcgattctctggctccagctcgaggacaacagtcacgttgaccatacaggtggacgtccgaggacagaagagtaggagctagtacttatactagtacaatcagacagacagcgagttgttagttttgggtcgttacgggcgggtacggacctaaggccgttaggaccgtcgtaggccgacgcccgtagtcccg

SEQ ID NO: 120490 - DNA, 582 bp, Homo sapiens
  misc_feature: GYAE6OF02IULA9.2.38.D05.1.454.CMB.1.raw
  modified_base (372)..(372): a, c, t, g, unknown or other
  misc_feature (372)..(372): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattccaccttcgagtacgctacgtggatgcacgtgggtccgccaagctccgaggggaagggctggtgtggtctcacgtattaatagtgagtggggatagcacgaagcgtacgcggtactccggtaggaacgggcctatccgaacctntcctacgagacgaaccaaccgccaaagaacaccgctaggttatctacgacaaatgaaactgtcagacgagccgaaggacgcggtctgtgtattacgtgtcgacaagagatagacagccaggtcgtacggtaccgaccggacgttaccggcggggacccgtaacgggtaccccgttggtaccctccggttcctcccgtaccgacctccccg

SEQ ID NO: 120491 - DNA, 535 bp, Homo sapiens
  misc_feature: GYAE6OF02GOJSE.2.38.D05.1.454.CMB.1.raw
  modified_base (467)..(467): a, c, t, g, unknown or other
  misc_feature (467)..(467): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtgggtccgccaagctccgagggagggctggtgtgggtctcacgtattaatagtgagtgggagtagcacaagctacggcggactccgtagacgggccatcaccatctaccagagacaacgccaaagaccacgctgtatctagacaaatgaaactgtctaggacgagccgaggacacggntgtgttatacgtgtgacgaaagagtactagacgagacgagtccgtagggtaccgaccgtacgtacggg

SEQ ID NO: 120492 - DNA, 602 bp, Homo sapiens
  misc_feature: GYAE6OF02HAGBF.2.38.D05.1.454.CMB.1.raw
  modified_base (266)..(266): a, c, t, g, unknown or other
  misc_feature (266)..(266): n is a, c, g, or t
tcagacgctcgacacacgaccggtgctcgatttagtatctgatagttggggtttgggggaagaggaagactgacggtcctgccacaggtggtcgctgggcacggtgggcactcgacacaacatttgcgctcaactgtcttgtccagtgtagaggtgcagctggtggagtccgggggaggcttagttcagtcctgggggtccctgaggactctcctgtgcagcctcgtggattcaccttcagtagctactgtatgcacgtgggtccncaagctcgaggaagggctggtgtggtctcacgtattatagtgagtgggatacgcacagctacgcgactccggtagacgggtccattcgaccgtatccgtacgagacgtaccaacgccgaagaaccacgtctagtactcagtacaaagtcgaatagtctaggtacgacgtaccgtaaggtaccgtacggtcgtagtacgtaagtttacgaggttacgtacgaaaggttaacgacgttagaccgtagaccgaagtcgtacggtaccgaccgtacgttacggcggggacctacgggaccgtcggtaccgtaccgttcccgtacttacccgagtcccccg

SEQ ID NO: 120493 - DNA, 611 bp, Homo sapiens
  misc_feature: GYAE6OF02JGPU2.2.38.D05.1.454.CMB.1.raw
  modified_base (222)..(222): a, c, t, g, unknown or other
  misc_feature (222)..(222): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggatcacctgctctgganatgcattgaccaaagcaatatgcttatggtaccagcagaagccaggccaggcccctgtcgctggtgatatataaagacagtgagaggccctgaggggatcccgtggacgcgtattcgtactggcctccgagcctcgaacgggacaacgtcgtacgtacgtacgacctatcaggtggacgtcgaggcaagaagagtggaacggtctagaacttattactgtacgtaatcgagtacgagaacgtacggtactaagggtttcggtttaacgttttttcggggttacggttaccgggggtcgggtaaacggggtacccgaacggtcccgtttacgggaaccccggtttaccggttaacgggtccgaaccgggtaccccgtaagggttccccgg

SEQ ID NO: 120494 - DNA, 580 bp, Homo sapiens
  misc_feature: GYAE6OF02HYPXU.2.38.D05.1.454.CMB.1.raw
  modified_base (396)..(396): a, c, t, g, unknown or other
  misc_feature (396)..(396): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagcttagttcagcctggggggtccctgagactctcctgtgcagcctctggattcacttcagtagctactggatgcacgtgggtccgccaagctccgagggaaggggctggtgtgggtctcgacgttattaatagtgatgggatagcacaagctacgcggactccgtaggaacggccgtattccaccatcctacagtagaacaaccgcaaagaacacgctgtanctgacaaatcgaactagtcctagagaacgccggaaggaccgacgggtcctgttgtaacgtttacgtgagtacgaaagagtaatagcgaagcagccgttgggaaccgaccggaacgttacgtcgggggaccctaacggggaaccctcggggtaccaccccgttctcccgtaccacggtacccccg

SEQ ID NO: 120495 - DNA, 579 bp, Homo sapiens
  misc_feature: GYAE6OF02IW29A.2.38.D05.1.454.CMB.1.raw
  modified_base (263)..(263): a, c, t, g, unknown or other
  misc_feature (263)..(263): n is a, c, g, or t
  modified_base (461)..(461): a, c, t, g, unknown or other
  misc_feature (461)..(461): n is a, c, g, or t
  modified_base (523)..(523): a, c, t, g, unknown or other
  misc_feature (523)..(523): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctctggattcacctttcagtagctactggatgcacgtgggtccnccaagcctaccgagggaagggctgggtgtgggtctcgacgtattaagtagtgagtgggatagcagaagctacgcgactcggtagaacgggcctattcacctatcctaccgaagacgaacaacgaccaaagaacacgctgtatcagacaaagtgaactgtcagacgacgaccgaggaccacggcttgtagtacttacgngtacgaacaaaggtagaagtacgacagaccgtagccgttaggacccgccgtaacgtaccggnggggaccctaacgggtaacccttggaccctaccggtccctaccgcaccgtaccccg

SEQ ID NO: 120496 - DNA, 955 bp, Homo sapiens
  misc_feature: GYAE6OF02G9YZZ.2.38.D05.1.454.CMB.1.raw
  modified_base (232)..(232): a, c, t, g, unknown or other
  misc_feature (232)..(232): n is a, c, g, or t
tcagacgctcgacacacgaccggtgctcgatttagtatctgatagttggttttgggggtgggtcctaggaggcagaacttctgggtgtctcaccatggcctggatccctctacttctccccctcgttcactctctgcacaggctctgacggcctcctatgagctgacacagccaccctcggtgtcagtcgtccccaggacagaccggccgaggactcacctgctcgtggagntgcattcgaccaaagcaatatgactttagttcggtaccagacaagaacgcccgaggcccgacgggcccccgtagtcgtcgttgggtagtaactaagtaaagtaaaacggactaaggtgaacggaacggtaccccctacggtaagggggtaaccttccccgtaggaacggtaccgtaacgttttacccgtcgttaccggggtccctaccccgaacggtcccgttaacggaacgggggtaaaccctaaacccggttaacggttacccgttaaaccgggttttaccggaaaccccttaaacgttaccggtaaacgggggttacggggtaacccggttaccccgggaaacggggttaacccgaaaaggggtaaaacggtacgttaacgggggtaaccggggttccgttaaaccggtaaaccgttttaacgtttaaccggttacggggttaacctaaaaccggtttaccgaaaccgggtaccgtaaaccgggaaccgtaaccgggtacgttaaaccggggtttaacgggtttttacccgggtttttttagggggtttacccggggttttacccgggggggtaacccggggttaaaccggggggtaacccgttaaacccggggttcccggtttaaccccgggttaaacccccggggtttaccccgggtttaacccggggtaccccgtaaacccgggggtacccccgtaaaaccgggggttccccccggg

SEQ ID NO: 120497 - DNA, 570 bp, Homo sapiens
  misc_feature: GYAE6OF02IE62H.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagtcagcctgggggtccctgagactctcctgtgcagcctctggattcaccttcagtagctactggatgcactgggtcccgccaagctccgaggggaaggggctggtgtgggtctcacgtattaatagtgagtgggagtagacacgaagctacgcggactccgtagaacgggccgattcgaccatcctacagacgacaaccgacaaagaacacgctagtactctagactaaatgaaacaggtctaggaaggacggacccggaaggaaccgacgggtcttaggtagtttaacttacgtgtagaccgaaagagtaatacgacgaggcaggccgttagggaaccgcccgtaacgtacgggg

SEQ ID NO: 120498 - DNA, 620 bp, Homo sapiens
  misc_feature: GYAE6OF02I5ZXA.2.38.D05.1.454.CMB.1.raw
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
  modified_base (523)..(523): a, c, t, g, unknown or other
  misc_feature (523)..(523): n is a, c, g, or t
  modified_base (528)..(528): a, c, t, g, unknown or other
  misc_feature (528)..(528): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggaggcttagttcagccgtgggggtccctgagactctcctgtgcagcctcgtggacttcaccttcagtagctacgtggatgcacgtcgggtccgccaagcctaccgaggggaagggcgtgggtggtgggtcctcgtaagttaattaataggtgtagtgggagtagcgaacagcgtaacggcggaccgtccggtaggaaccgggccgtattaccacctactctacgagaacgaccaaccgacaaagaaccacgtactagtactcgtagaactaaaagtcgaaacgtgttcaggaacgcggaaccggagaccgcggtctaggtntaacgttgngtacganaaaggnaacgtnacganaccgagtcggtaggacccacggtaacgttagggtccggggaacctaaccgggtacctgggtacccacccggttccacccgtgacccgccccg

SEQ ID NO: 120499 - DNA, 644 bp, Homo sapiens
  misc_feature: GYAE6OF02IT58V.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggatccacctgctcgtaggagatgctattcgaccaaagacaatatagtactttagttacggtaccagacgaagaacgaccgacggacccgacggcccctggtgtcgtggtagaattataagtaaaagactagtagaggaacgccctaggaggtactccgtagacgcgtacttctgtcgctaccagtcctacgacggaacaacgacgttaccgtacgtacgacctagtacgaggtacggacgtcgaaggacaagtaagagtggagtacgagtacttaacttacgacgttacaacgttcaagacgaagacgaacgtacgttaaggttcgggtttaacgttttggggtacggttaccgggtacggggtaacggtaaccgaaaggttccgtacggtaacccgttacggtacggttaccggacccgtaccgggtaaccggcccgg

SEQ ID NO: 120500 - DNA, 666 bp, Homo sapiens
  misc_feature: GYAE6OF02GW10D.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagagccaggccaggcccctgtcgcgtggtgatataagtaagacagtgagacggcctcgaggtactccgagacgcgtacttcgtcgtcggtctccgaagtcctacgaacgggaaccaacgtacgtacgtacggttacgaaccctactacgaggttcgggaacggttaccacgggactaagggaagtaaggttaggacggtccgtagtaactttaacgttacgtacgtactaagttaccgaacgacgtaacgaacgtacggtaccggtaaggttacgggtttaccggttttttggggttacgggttaccggggtaacggggtaaccggggtaaccgtaacgggtccgttacgggtaacccgttcccggttaacgggtcccgtaaccgggtcccggtaaacgggtccccg

SEQ ID NO: 120501 - DNA, 597 bp, Homo sapiens
  misc_feature: GYAE6OF02FU534.2.38.D05.1.454.CMB.1.raw
  modified_base (264)..(264): a, c, t, g, unknown or other
  misc_feature (264)..(264): n is a, c, g, or t
  modified_base (356)..(356): a, c, t, g, unknown or other
  misc_feature (356)..(356): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctctggattcaccttcagtagctactggatgcacgtgggtcccnccaagcctccgagggagggctggtgtgggtctcacgttattaatagtgagtgggagtagcacaagctacgcgactcgtgaggcatcacatcncagacaacacgccaaacgacacgctgtactctgacaaatgaactgtctaggagacgccgaggacgacggcttggtacttaacttacgtggtacgaacgtaaaggtagaagttacgacctaggaccgagtaccgttacgggtacccgacccggtaacgttaccgggtcggggggaccctaacgggggtaaccccgttggtaccccgtacccggtccttacccgtaccgaccgtaccccccgg

SEQ ID NO: 120502 - DNA, 659 bp, Homo sapiens
  misc_feature: GYAE6OF02GDS9B.2.38.D05.1.454.CMB.1.raw
  modified_base (482)..(482): a, c, t, g, unknown or other
  misc_feature (482)..(482): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgacccaaagcaatatgtcttattggtaccagacagaagccaggccacggccccctgtagctggtgatatataaagacaggtgagacggccctcgaggactcctgacgcgtattcacgtcggctcgacgctcgacggacaacgtagtaccacggtttacgaaccgtataccgtaggtagggtacggtaccgagggaccaaggaacgtaggtaggacggtacgtacgttaacttacgtttaccgtgtaactaacncgaacgaccgtaagaccgtagacgtaacggtttacggtttaaccggtttttggggaccggtttaccggggtacggggtaacgggtaacccggtaacggttacccgttaccggggttacccgttaccgggttaacccgggttaccgaacccgggtacccgtaacgggttaccccccgg

SEQ ID NO: 120503 - DNA, 554 bp, Homo sapiens
  misc_feature: GYAE6OF02FQG8C.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggatagcacaagctacgcgactcgtgaacggccgattcaccatctccagagacaacgccaaagaacacgctgtatctgacaaatgaactagtctagagacgccgaaggacacggctagtgttaattacgtggtagacgaaagagatacgacagcaagcctagggaccgccggtaactacggtcggggacccaaggggtaaccccttgggtaccacccggttcctcccgtacgaccgtacccc

SEQ ID NO: 120504 - DNA, 574 bp, Homo sapiens
  misc_feature: GYAE6OF02I60SU.2.38.D05.1.454.CMB.1.raw
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (479)..(479): a, c, t, g, unknown or other
  misc_feature (479)..(479): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtgggggtccctgagactctcctgtgcagcctctggattcaccttcagtagctacgtggatgcacgtgggtcccgccaagcctaccgaggggaagggcgtgggtggtgggtctcgacgttattaagtgtgagtggggagtagcaacgaagctacggcggactccggagaacggccattccacntcnccagacgacaacgaccaagaacacgctagtatctagacaaatcgaaactgtcagacgacgccggaggaccncggacttgtagttacttacgtgtacgacgtaaggacgtaagtacgacgaggtactacggtccgtacgggtacccgtacccggaacgttaccgggg

SEQ ID NO: 120505 - DNA, 851 bp, Homo sapiens
  misc_feature: GYAE6OF02G80S5.2.38.D05.1.454.CMB.1.raw
  modified_base (270)..(270): a, c, t, g, unknown or other
  misc_feature (270)..(270): n is a, c, g, or t
  modified_base (505)..(505): a, c, t, g, unknown or other
  misc_feature (505)..(505): n is a, c, g, or t
tcagacgctcgacacacgaccggtgctcgatttagtatctgatagctgggtttccttgttgtctatttaaaggtgtccagtgtgaggtgcagctggtggaggtccgggggaggcttaggttcagccgtggggggtccctggagacgtctcctgtcgcagcctcgtggacttcaccttcagtacgctactggatgcacgtgggtccacaagctcgaggggagggctgggtgtgggtctcgacgtattaagagtgagtggggagtagctaanagtctacggcggactccggtaggaacgggccgtattccgaaccctagtccctaccgaaggacgaaacctaaaccggaccgaaaaaggaacccaccgggccttaagtaaccgttccgtacggaaaccaaaaaggttcggaaaaacggacgtttacacgggtaaacggaaccggaccccgggaaaagggtacccgaacggggttactttaggttacggtttaaaacttttaaccggngggttaaccggaacaaaagggtagtaaacgtacgggtaacaacggtacgaacggtaccgtaagggtaacccggtaccggaaccgttacgggtaccgggggaccgtaaacccggggaacccgttaccgggtccgtaaacccggttccgtaacccgtcccgaacgtacccccgtacccgaaccggtaacccggggtacccctaccgggttaacccggtccccggttaccccgtccgggacccccggtacccgtccggtaacccggttccggacgggtaacccggtaccccgacccggtaccggaaccgggacgtacccgggacccgtacggggccccggtacccgggg

SEQ ID NO: 120506 - DNA, 670 bp, Homo sapiens
  misc_feature: GYAE6OF02HVTN9.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaaatatgcttattggtaccagcagaagccaggccgacggcccctgtcgctggtgatataataaagacagtgagacggccctgagggactccctaggacgcgtatttctcgtcggcctccgagctacgaggggaaccaaacgtacgtctacgttcgaacccattacgaggtcgggtagtccgaaggcaaggaagataggagctaggaacttactttactgtaactaaacgtcgtaacgccgtaagaaccgtaggtacgttaacgggtttaggttttaacggtttttttgggggttacgggtttcccgggggtaacgggggtaacccggggtaacccggttaaacggtccggttaaccgggttaacccccggttaccgggttaaccgggttacccggtaacccgggtacccccggtaaagggttcccccccggg

SEQ ID NO: 120507 - DNA, 533 bp, Homo sapiens
  misc_feature: GYAE6OF02IZN4K.2.38.D05.1.454.CMB.1.raw
  modified_base (295)..(295): a, c, t, g, unknown or other
  misc_feature (295)..(295): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
  modified_base (470)..(470): a, c, t, g, unknown or other
  misc_feature (470)..(470): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccnccaagcctccgaggggaaggggctgggtgtgggtctcgacgtattaatagtgatgggagtagcacaagctacgcggactccgtaggaacggccgattcgaccatcctaccagacgacaacgccaaagaacacgctgtatctgacaaatgaacngtcngagngccgaggacacggntgtgtattactgtagacgaagagatagacagacaggccgtgggtaaccgccgtacgtaccggg

SEQ ID NO: 120508 - DNA, 513 bp, Homo sapiens
  misc_feature: GYAE6OF02FJIUK.2.38.D05.1.454.CMB.1.raw
  modified_base (399)..(399): a, c, t, g, unknown or other
  misc_feature (399)..(399): n is a, c, g, or t
  modified_base (460)..(460): a, c, t, g, unknown or other
  misc_feature (460)..(460): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaggccgattcacatctccagagacaacgccaaagaacacgctgtatctgcaaatgaacngtctgagagccgaggacacggctgtgtattacgtgtagcaagagatagcagcagctggacncgactacgtggggccagggtaccctggtaccaccgttctcctcgacgtacccg

SEQ ID NO: 120509 - DNA, 526 bp, Homo sapiens
  misc_feature: GYAE6OF02INWTY.2.38.D05.1.454.CMB.1.raw
  modified_base (443)..(443): a, c, t, g, unknown or other
  misc_feature (443)..(443): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctgggggtccctgagactctcctgtgcagcctctggattcaccttcagtagctactggatgcactgggtccgccaagctccgagggaaggggctgggtgtgggtctcacgtattaatagtgagtgggagtagcacaagctacgcggactcgtgaagggccgattcaccatctccaagacacaacgccaaagaacacgactagtatctagacaaagtcgaacngtctggagacgccgagggacacggctgtgtattacgtgtgacaagagatagacagcagtcgtcgggtaccgccgactaccggg

SEQ ID NO: 120510 - DNA, 752 bp, Homo sapiens
  misc_feature: GYAE6OF02JH7OX.2.38.D05.1.454.CMB.1.raw
tcagacgctcgacacacgaccggtgctcgatttagtatctgatagttgggtttgggggtaaggaggaaggacgtgacggtccgtgccgacaggtggtgctgggcgacggtgggcgactcgacacaacatttgcgctcaactgtctgtccagtgtgaggtgcagctggtggagtcggggaggcgttagttcgagccgtgggggtccctggtagactcgtcctgtgcgagcctctcggtacttctaccgttcacggtagctacgttggacttgacacgtcgggtccgaccgtaagccgtaccgagggaacgggggtctgggtggtcggggtctaccgtacgttattaacgtaggttgagttgggaagtagcacaaggtctaacggccggtatccggtgaaacggggtccgatttacccgaacccagttcccgttacgaacggagtaacccgaaaacggaccccgtaaaggaaaacccgaacggtccgtacggttacgtaccgttaaggaacctaaaacgtttacggaaaccgtaggttacccgtagtaaccgggaaacgtcccgggaaaaggacccgttaaacgggccttacgttacggttaaccgtttagtacggtttacggaacgaaaacgtgtaactacggtacgtacggacgacgacgttcgggtaacgcccgtaacgtaaccggtcggggaaccctaaccggggtaaccctcggttaccggaccttaccgacccgttggacctaccccg

SEQ ID NO: 120511 - DNA, 638 bp, Homo sapiens
  misc_feature: GYAE6OF02GUQD8.2.38.D05.1.454.CMB.1.raw
  modified_base (259)..(259): a, c, t, g, unknown or other
  misc_feature (259)..(259): n is a, c, g, or t
  modified_base (369)..(369): a, c, t, g, unknown or other
  misc_feature (369)..(369): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagcttagttcagcctggggggtccctgagactctcctgtgcagcctctggattcaccttcagtagctactggatgcactgggtccnccaagcctccgagggaagggctggtgtgggtctcacgttattaataggtgagtggggagtagcaacgaagcctacgccggactccggtaggaacggccattccaccatcncagacgacaacgccaaagaaccacgctgtaactctagacaaatcgaactagtcgtagacggacggaccgaggaccgacggcttggtagttactttaacgtggttacgacgtaaagggaagtaacgttacggacgtaacggaccgaggtccggttacgggtaaccggaccccggtaaacggttaccggtccggggggaacccaaccgggggtacccccgttacggggtccctaccccggttcccttaccccgtacgacccgtacccccgg

SEQ ID NO: 120512 - DNA, 534 bp, Homo sapiens
  misc_feature: GYAE6OF02GUVLJ.2.38.D05.1.454.CMB.1.raw
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagacgctcgacacacgaccggtgctcgatttagtatctgatagttgggtttggggggaagaggaagactgacggtcctgccacaggtggtgctgggcacggtgggcacttgacacaacatttgcgctcaactgtcttgtccagtgtgaggtgcagctggtggagtccgggggaggcttagttcagcctggggggtccctgagactctcctgtgcagcctctggattcaccttcagtanctactggatgcactgggtccnccaagctccagggaagggctggtgtgggtctcacgtattaatagtgatggggatagcacaagctacgcggactccggngaacgggcatcacntcncaganacaacgcaaagacacgctgtatcnggacaaatgaaacngtactgagagccgagacncgntgtntacttacgtgnacaaganagtgacaggcagcgtcggtacgccgtacgtacgcgggggccaacggggtaacccttgggacctacccgttcgtaccctccggaacgtccccg

SEQ ID NO: 120513 - DNA, 622 bp, Homo sapiens
  misc_feature: GYAE6OF02FWLRF.2.38.D05.1.454.CMB.1.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (359)..(359): a, c, t, g, unknown or other
  misc_feature (359)..(359): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagcttagttcagcctggggggtccctgagactctcctgtgcagcctctggattcaccttcagtagctactggatgcacgttgggtccgccaagctccgagggaagggctggtgtggtctnacgtattaangtgagtggagtagcacagctacgcggaactccggtagacggccgtatccacatccncagacgacaacgacaaagacacgctagtactctagactaaatcgaactagtcgtagaacggacgaccggaaggaccgacggtctaggttattaacgttaccgtaggtacgaacgtaaagaggtaattaacggcaggtacaagggtccgtaggggtaacccggtccggtaaaccgttcggggtaccgggggaacccctaacgggggtaaccccttcgggtacccctacccggttacccttcccggttaccgaccgtacccccgg

SEQ ID NO: 120514 - DNA, 643 bp, Homo sapiens
  misc_feature: GYAE6OF02HN70H.2.38.D05.1.454.CMB.1.raw
  modified_base (199)..(199): a, c, t, g, unknown or other
  misc_feature (199)..(199): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (317)..(317): a, c, t, g, unknown or other
  misc_feature (317)..(317): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccnccaagctccgagggagggctgggtgtgggtctcacgttattaatagtgatgggatagcanaagctacgcggactccgngaacggccattcaccatctccagagacaacgccaagaacncgctgatctagacaaaatgaacagtctagagacgccggtaaggacacgggtctggtgtaatttacgtgtacgactaaaggagtaagtagaccaggacacggtacgttacgggtaccggccgtacgtaacggtcggggaccgaacgggaaccccgttggtacccgaccgtcctccgtccgacgtcccctaccgaacccgaacgggccctaacgttcccggtacccttcccccggtaggcccgtaccccgtggaccccgtaccgacgggtaccgtaccacccggtccggaacggaccgtaccgaaccgtaccgggtccggtaccccgg

SEQ ID NO: 120515 - DNA, 612 bp, Homo sapiens
  misc_feature: GYAE6OF02HJY0K.2.38.D05.1.454.CMB.1.raw
  modified_base (267)..(267): a, c, t, g, unknown or other
  misc_feature (267)..(267): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcttgggttttccttgttgctatttaaaagtgtccagtgtgaggtgcagctggtggagtccggggaggcttagttcagccgtgggggtcctgagactctcctgtgcacgcctcgtggattcaccttnagtagctactgatgcagtcgggtccgaccaagccgtaccgaggggaacgggtcgtgggtggtgggtctacgtacgttaattaacgtagtagagtagggagtagcaagaacgctacgacggtacgtcgtagaacggctacgtcaccgactcctacacgacgaaccaaccgaccaaagaacctacgtctagtatcctacggactaaagtacgaaacctagtcctagggaacgacgacccggaaggaccgacgggtacttacggtagttaacttacgttggtaacgacgtaaaggagtaatacggacaagcgaacgtccggtacggtaccgtaccgtacgtacccggg

SEQ ID NO: 120516 - DNA, 622 bp, Homo sapiens
  misc_feature: GYAE6OF02H02P3.2.38.D05.1.454.CMB.1.raw
  modified_base (316)..(316): a, c, t, g, unknown or other
  misc_feature (316)..(316): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgccaggcctctggattccaccttcagtagctactggatgcactgggtccgccaagctccgagggagggctggtgtgggtctcacgtattaatagtgagtgggagtagcacagctacgcggactccgtgaacggcatcactatctccagacacaacgccaagaacncgctgtatctgcaaagtgaacaggtctagacgacgtcgaaggacaacggctaggtagtactttacgtggtcgacgaaagtagagtagcgaagcgagcgtacggtaccgaccgtacgttacgcgggaccgaggggaacccctggtacccgaaccggtcctacccgtacacgtaccccgtaccaaccggaaccgggtcccgaacgtttcccggtcccgttcccccgtaggcccgtccccggtgccgtacccgaggaccgacccgacccggtcccgaggaccctacgacccgtacgggccccgtaccgg

SEQ ID NO: 120517 - DNA, 630 bp, Homo sapiens
  misc_feature: GYAE6OF02JYMEJ.2.38.D05.1.454.CMB.1.raw
  modified_base (295)..(295): a, c, t, g, unknown or other
  misc_feature (295)..(295): n is a, c, g, or t
  modified_base (499)..(499): a, c, t, g, unknown or other
  misc_feature (499)..(499): n is a, c, g, or t
tcagacgctcgacacacgaccggtgctcgatttagtatctgatagttgggtttgggggttggggttccgaggaggcgagaactctgggtgtctcaccatggcctggatcctctacttctcccctcttcactctctgcacaggctctgaggcctcctatgagctgacacagccaccctcggtgtcagtgtccccaggacagacggccaggatccacctgctctggagatgcattgaccaaagcaatatgacttagtggtaccagcagaagccaggccacggcccctgtgcctggtnagtataataaagacagtgaggacgccctagagggactccgtgacgcgattctctcggctcgagctacgacgggtaacaacgtagtcctacgttacgaaccgtactacgtaagggtggaacggtaccgacgggactaacggaaaggtacgtaggacggctacggtaacttagttaacctggtacaaagtcaacgtacgaaccganaacggtacgtaggtttacggtttacggtttttgggtacggtttaccggggacgggtaaccgggtaccaagggttaccgtacgggtacccggttcggtaccggttaccgaacggttacccggaaggtccccg

SEQ ID NO: 120518 - DNA, 544 bp, Homo sapiens
  misc_feature: GYAE6OF02GEK3A.2.38.D05.1.454.CMB.1.raw
  modified_base (261)..(261): a, c, t, g, unknown or other
  misc_feature (261)..(261): n is a, c, g, or t
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtgggtccnccaagctccgagggagggctggtgtgggtctcgacgttattaatagtgagtgggagtagcacgaagctacgcgactcgtgacggcctatccgacntctcagagacaacgccaagaccncgctgtatctnacaaatgaacagtctagacgacgaccgaggacacggngtgtntattcngtgacaagagatacgcagcgagtcgtaggtaccgccggtaactacggccggggacccgtaagggaccccgttggccctacccgttctaccctcggaacgtcccccg

SEQ ID NO: 120519 - DNA, 636 bp, Homo sapiens
  misc_feature: GYAE6OF02GEQ7R.2.38.D05.1.454.CMB.1.raw
  modified_base (225)..(225): a, c, t, g, unknown or other
  misc_feature (225)..(225): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtccagtcgtccccaggacagacggccaggatcacctgctctgganatgcattgaccaaagcaatatgcttatggtaccagcagaagccaggccacggcccctgtcgcgtggtgatataataaagacagtgagacggcctgagggtactccgtgagcgtattctcgtggcctccgagtctacgaagggaccaacgtacgtaccgtacgttcgaacctatacgaggtcggacgtccgaggtacgaaggaagagtacggaggtaccgttagtaaccgtttaacgttacgttacgttaaccgtaattcgaacgtaccgaagaaccgaggtaccgttaagggtttaccgggttttacggtttttggggtacgggtttcgggaccggggtaacggaaccggtaaggtccgttacggtacccggtccggttacggaccgaccggtaccggtacggtaccccgg

SEQ ID NO: 120520 - DNA, 543 bp, Homo sapiens
  misc_feature: GYAE6OF02F6ETN.2.38.D05.1.454.CMB.1.raw
  modified_base (289)..(289): a, c, t, g, unknown or other
  misc_feature (289)..(289): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattgaccaaagcaatatgcttattggtaccagcagaagccaggccaggcccctgtgctggtnatatataaagacagtgagaggcccctgaggggtactcccgtggacgcgtatttctcgtggcctccgagctacgagggaacaacgtagtcacgttgaacctatcagtggacgtccgaggcaaggaagtagtaggaggtctagacttattacgtagtacaatcagacacgacagctagttggttacgttttgggtgttcgggcgggtagggacctaaggcgtacggtaccgtcgtaggtcgacgcccgaggtcccg

SEQ ID NO: 120521 - DNA, 762 bp, Homo sapiens
  misc_feature: GYAE6OF02HR4KZ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggatccacctgctcgtgggagatgcctagttcggaccaaaaaggcctaaattagttgtctttaagttacggtaaccaagcaaacggaaagccccgaacgggccccctaacggggccccccttgggtccggtccgttaggggttataagttaaagttaaagttaaaaacggacgtaaggttgggaaacggaaccgggtcccccgttaaggaacggggggaacccttccccggtaggaacggtaccggtaactttttccgtccgtaggggtcccttaaccgcggtctaccggaaaacggggtaactaaaacccgtgttacccgttaaggttacgaaacccgtattaacggtagtacgggtacgttacccgaaggacgaaaggaaagtagtaggagggtacttacgacttaagtttacgtagttaacgaataccaagacgaacgaacacgtacggtagtttaggtttacggttttaggggttcggttaaccgggacgggtaacggtaacgaggtaccgtacggtaccgtacggtacgtaccgacggaccgaggtcccgg

SEQ ID NO: 120522 - DNA, 680 bp, Homo sapiens
  misc_feature: GYAE6OF02I80OY.2.38.D05.1.454.CMB.1.raw
  modified_base (180)..(180): a, c, t, g, unknown or other
  misc_feature (180)..(180): n is a, c, g, or t
  modified_base (247)..(247): a, c, t, g, unknown or other
  misc_feature (247)..(247): n is a, c, g, or t
tcagacgctcgacacacgaccggtgctcgatttagtatctgatagttgggtttggggtgggtccaggaggcagaacctctgggtgtctcaccatggcctggatccctctacttctcccctcttcactctctgcacaggctctggaggcctctatggtagctgacacagccacccgtggtntcagtcgtcccaggacagacggcaaggatcgacctgctctgggacagtcgcatcgaccaaagcaatntgcttatggtacagcgtagaacgcgaacggccacggcccctgtcgcgtggtgatactaataaagacaaggtgaagacggccgtacgacggggtaactcccgtagacgtacggtactttccgttcgtacggtcaccgtacggtaccttacggaacgggtacaaaccggtacgtaccgtaaccgggtttacggaaccctaacgtttaccggaaggttaccggtacggtaccctaaggggaccctaaaaggaacggtaagttacggaacgttcccgtaaggtaaccttaattaccgtaagtaaccgaattccgagtaaccgaagaccgacggacgtacggtagtttaccgttttagggtacggttcgggacggtaacggacgtaacgccgttacggaccgttacggtaccggtagaccgttaccgaaggttcccgg

SEQ ID NO: 120523 - DNA, 657 bp, Homo sapiens
  misc_feature: GYAE6OF02HWMZU.2.38.D05.1.454.CMB.1.raw
  modified_base (178)..(178): a, c, t, g, unknown or other
  misc_feature (178)..(178): n is a, c, g, or t
tcagacgctcgacacacgaccggtgctcgatttagtatctgatagttgggtttgggggtgggtccgaggaggcagaactctgggtgtctcaccatggcctggatccctctacttctcccctcttcactctctgcacaggctctgaggcctctatgagctgacacagccaccctcggtntcagtcgtccccaggacagacggccaggatcacctgctctggagatgctattgaccaaagcaatatgcttagtggtaccagcagaagccaggccaggccctgtgctggtgatataataaagcagtgagaggccctgagggactcccgtaggagcgtaatctactggcttacagtctacgacgggacaacgagtcgacgttacgaccatacgtaggtacggacgttacccgagggtaccgaaggtaaacggaacggtacggtaacgggcttaggtaacttaacgtttacgtaacggttaaccgaaacgtttccgaaggtaaccgaagttaaaccgaacgacgttaacgggttaccgggtttacgtttttcgggggttaacgttttcggggaccggggtaaacgggttacgaaacggttccggaacggttacccggttaccggttaacggttccgaaccggtaccggaaacgggttccccg

SEQ ID NO: 120524 - DNA, 860 bp, Homo sapiens
  misc_feature: GYAE6OF02JQVXE.2.38.D05.1.454.CMB.1.raw
tcagacgctcgacacacgaccggtgctcgatttagtatctgatagttgggtttgggggtgggtccgaggaggcagaactctgggtgtctcaccatggcctggatccctctacttctcccctcttcactctctgcacaggctctgacggcctcctatgagctgacacagccaccctggtgtcagtcgtccccaggacagaccggcctaggactcgacctgctcgtggacgatcgcattcgaccaaagcaatagtcgctttaattcgggtaaccacgtacgaagtaacgcccgacggaccaacgggtccccctaggtcgccgttgggtacgaacttaattaaacgttaaaacggacgtaacggttacggaaagggtaccgggtacccctacgggtaacgggggtaacccttccccggttaagggaacgttaccgggtaactttttcccgtcggttaccggggaccctttacccggaacggttccgtaaccgggaaacgggggttaacccaaaacgtaccgggtttacccgtaaaccggggtttaccgaaaccccggttaacgttaccccgggtaaaggggttaccggggttaacccggttaaccccggtaaaggggaccgtaaacgggtaaaacggtacgggttaacggacgggtaacgttacgggtaaccgtttaacgttaaccggttacgtacgtaaaccgttcgtaaagcccgtaagaacgtaacggtaccgtaagggtttacggtttacggttttttcggggtacggttacgggacggggttaacggtaccggtaaccggtcggttaccggtaccggttcggtaaccgttcggaacccggtaccgtaaccgggtcccg

SEQ ID NO: 120525 - DNA, 553 bp, Homo sapiens
  misc_feature: GYAE6OF02IGVEZ.2.38.D05.1.454.CMB.1.raw
  modified_base (343)..(343): a, c, t, g, unknown or other
  misc_feature (343)..(343): n is a, c, g, or t
  modified_base (391)..(391): a, c, t, g, unknown or other
  misc_feature (391)..(391): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagcctccgagggaaggggctgggtgtgggtctcacgtattaatagtgatgggatagcacaagctacgcggactccgtgaagggccattcaccatctccagacgacaacgccaaagaacacgctgtatctgacaaaatgaacngtctgagagccgaggacacggctgtgtaattactgtgcaagagatagnagcagctggacgccgactacgtgggaccacgggaccctggtcaccgtctcctcgacgccctaccaccgaacggccctacgtccggttccttccccgtggcccgtcccgtcgcctaccgacggaccgccaccgtccgacgaccgccacgacggccggtcccgg

SEQ ID NO: 120526 - DNA, 653 bp, Homo sapiens
  misc_feature: GYAE6OF02IYI8S.2.38.D05.1.454.CMB.1.raw
  modified_base (296)..(296): a, c, t, g, unknown or other
  misc_feature (296)..(296): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtgggggtccctgagactctcctgtgcagcctctggattccaccttcagtagctactggatgcacgtgggtccnccgaagcctccgaggggaggggctgggtggtgggtctcgaacgttattaagtgtgagtgggagtagcaagaacgcgtacgcggtacgtccggtagaaacgggcccgtaagtttccaaccgtatacccgtaccgaaggaacgaacccgaaaccggacccaaaagaaccgaccgtccttagtactcgtagacctaaaatacgaaaccgtagttcgagaaggacggaccggaagggacccgtacgggtcgttggttaacgttagtttaccgtaggttacggaacgaaagggtaagtacgtaagaccgtaagaccggacggtccggttacgggtacccggaccccggtacgttaacccggg

SEQ ID NO: 120527 - DNA, 603 bp, Homo sapiens
  misc_feature: GYAE6OF02GR8I8.2.38.D05.1.454.CMB.1.raw
  modified_base (223)..(223): a, c, t, g, unknown or other
  misc_feature (223)..(223): n is a, c, g, or t
tcagacgctcgacacacgaccggtgctcgatttagtatctgatagttagggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctgganatgcattcgaccaaagcaatatgcttattggtaccagcagaagccaggccacggcccctgtcgcgtggtcgataatataaagacagtgagacggccctgagggactccctgagcgtattcgtcgtgctccagtcgtacgacgggacaacgagtacacgttcgaaccatacgaggtggacgtaccgagggacaaggaaacgagtggacggtctagtaacttagttacctagtactaactcgagacgaagacgacgtacgtaggtttacggtttacgtttttggggttacggttcgggtaacgggtaacgggtaaccgtaacggtaccgttacggacccggttaccgtaccggttacgacccgtacccggaacggtccccgg

SEQ ID NO: 120528 - DNA, 726 bp, Homo sapiens
  misc_feature: GYAE6OF02F562J.2.38.D05.1.454.CMB.1.raw
  modified_base (631)..(631): a, c, t, g, unknown or other
  misc_feature (631)..(631): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcttgggttttccttgttgcttatttttaaaaggtgtccagtgtgaggtgcagctggtggaggtccgggggaggcttagttcagccgtggggggtccctgagactctcctgtgcacgcctcgtggacttccaccttcagtagctacgtggatgctacgtcgggtcccaccgaaggccgtaccggagggggtaacggggccgttgggtaggttcggggttccttacgtaaacggtttaagtttaaacgttaggttacggtaggtagggggtagtaacggacaacgaaacgtcgtaaccgggaccggtacgttaccgggtagggaaaccggggtcccgtaacgtttaccgacctacgttccctaacccggaaggaaccaaccgaaacccggacccaaaaaggaaccccgacggtccttagttaacttccgaggtaaacctaaagtacgaacctagtcgtaacggacgacggacccggaaggacgaccgggttnttaggtagttacttacgtgtaacggacaagggtaacagtaacggaccagtaccgaggtcccgttagggaacccggttacccggaccggtacgggg

SEQ ID NO: 120529 - DNA, 525 bp, Homo sapiens
  misc_feature: GYAE6OF02FPAHL.2.38.D05.1.454.CMB.1.raw
  modified_base (465)..(465): a, c, t, g, unknown or other
  misc_feature (465)..(465): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagcaggccaggcccctgtgctggtgatatataaagacagtgagaggccctcgagggactcccgtgagcgattctctggctccagctacgagggacaacacgtcacgtttgaaccatcaggtggacgtccaggcaggaagatggagcgtgactattacgtgtactaatcagcagacagcagtgttacgtttttgggtggttcggngggaacggtaccgaagtcgtacggacccggttactacggtacgaccgtaccgaggtcccg

SEQ ID NO: 120530 - DNA, 701 bp, Homo sapiens
  misc_feature: GYAE6OF02G37P6.2.38.D05.1.454.CMB.1.raw
  modified_base (555)..(555): a, c, t, g, unknown or other
  misc_feature (555)..(555): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacacgccaccctcggtgtcagtcgtccccgaggaccagaccggccaggactccacctgctctggagatgcattcgaccaaagacaattatgtactttagttcggtaccagacaagaacgccgacggccgacggccccgtggtcgcgtggtacgtaattaataaagtaaagaacgtaggtaggaacggacggtaccctacggaacgggtacctcccgtagtacggacgtacgtttccgtcggttcggtacctcccgagtaccgtacggaacggtaaccaaacgtacgtaccgtaccgttacgaacctagtacgaagggtacggacgtcgaagggacgaaacgtaagagtaggacggtctacgtaacgttattacgtagtacgtaacgtacganacgaagacgagtacgttaaggtttcggttttacggttttaggggtcggttacggggaccggtaaacgggtaccgaaggttcccggttaacggtacccggttaccggttaacgggacccgtaacccggtcccggtaacggtccccgg

SEQ ID NO: 120531 - DNA, 503 bp, Homo sapiens
  misc_feature: GYAE6OF02F2UN6.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtgtccccaggacagacggccaggatcacctgctctggagatgcattgaccaaagcaatatgcttattggtaccagcagaagccaggccaggcccctgtgctggtgatatataaagacagtgagaggccctcgagggactccctgagcgattctctggctccagctcgagggacaacgacgtcacgttgaccatcagtcggagtccgaggcagagatgagctagactattactgtacaatcagcagacagcagttgttacgttttgggtgttcggcggaggaccgaagctggaccgtcgtacggtcacgccgaggtcccg

SEQ ID NO: 120532 - DNA, 740 bp, Homo sapiens
  misc_feature: GYAE6OF02H5OXM.2.38.D05.1.454.CMB.1.raw
  modified_base (708)..(708): a, c, t, g, unknown or other
  misc_feature (708)..(708): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcgttgggttttccttgttgtcttaagttttaaaaggtgtccagtgtgaggtgcagctggtggaggtccgggggaggtcttaggttcacgtccggtggggggtccctggaacgtccttctccgtggtcgcgacgtccttcgtggtactttccgaccctttcgaaggttacgccttaacgtggtaactgcctaccggtcggggtcccaccgtaaacggtccgtacccgggaagggggtaacgggtcggttcggttggttacgggtccttacggtaaacgttaagtttaaagtacggtagtacggtaggggaagtacggaacaacgaagtcgaacgccggtaacgttccggaagaacgggccgtatacctaaccgacttccgtaccgaaaggtaacccgaaacgaaaccggaaccaaaagtaaacccgtaccgtagttaacgttaccgtacgtaacgaactaaaacgtcgaaaacgtaacgtcgtaacggtaacggacggaacccgggaaggaacccgtcggtagttcgtaagtttacgtagtcgtagaacgtaagacgtagagacgagngaacgtcggttaccgagacccgtacgtccggg

SEQ ID NO: 120533 - DNA, 718 bp, Homo sapiens
  misc_feature: GYAE6OF02HVEZ8.2.38.D05.1.454.CMB.1.raw
  modified_base (229)..(229): a, c, t, g, unknown or other
  misc_feature (229)..(229): n is a, c, g, or t
  modified_base (579)..(579): a, c, t, g, unknown or other
  misc_feature (579)..(579): n is a, c, g, or t
tcagacgctcgacacacgaccggtgctcgatttagtatctgatagttgggtttgggggtgggtccaggaggcagaactctgggtgtctcaccatggcctggactccctctacttcctcccctcttcactctctgcacaggctctgaggcctctatgagctgacacagcccacccgtcggtgtcagtcgtacccgaggacacgacggcaggactcacctgctacgtggantgctagttcgaccaaagctaagtatgtcttaagttcggtaaccagacgaagaacgccgaggaccgcggtccccgtgtcgaccgtggtactaattaactaaagtaaagactaggtacgaacggtacggccccttaggacgggtaactcccgtaggacgtacgtattccgtacgtcggtccctacgaagtccgaacgaacgggaacaacgtcgtaccgtaacgtttacgaccgtaagtccgtaaggtagggtacaccggaagacgtaaggaaaggtcttaagggacgttacgtcgtaaacttaagtttaccgtagttaacaagttaccgaagacctaacggacgtaacgggnttaaacgggttttcggtttaccggtttttaggggacggtttaccggggaacgggaaccggtaaccggtaacgtcccggttaacggtaccccgttacggttaaccggacccggtaacgtccccgggtaagttcccccggg

SEQ ID NO: 120534 - DNA, 609 bp, Homo sapiens
  misc_feature: GYAE6OF02GILZJ.2.38.D05.1.454.CMB.1.raw
  modified_base (261)..(261): a, c, t, g, unknown or other
  misc_feature (261)..(261): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctctggattcaccttcagtagctactggatgcactgggtccnccaagctccgagggagggctggtgtgggtctcgacgttattaagtagtgagtgggagtagcacaagctacggcggactccgtaggaacggccgtattacacctatcctaccagacgaacaacgaccaaagaacacgactagtactctgactaaatcgaaactgtacgtaggaagacgaccggaaggaccgacggcttagtagttacttacgtaggtagacgaagaagtagtacgacacggactacggcgtagggtacccgccggtaacgtaccgggtacggggacccgtaacggggaacccgttcggggtaccctacccggttcctcccgtacgacccggtacccccg

SEQ ID NO: 120535 - DNA, 536 bp, Homo sapiens
  misc_feature: GYAE6OF02HR39L.2.38.D05.1.454.CMB.1.raw
  modified_base (295)..(295): a, c, t, g, unknown or other
  misc_feature (295)..(295): n is a, c, g, or t
  modified_base (360)..(360): a, c, t, g, unknown or other
  misc_feature (360)..(360): n is a, c, g, or t
  modified_base (419)..(419): a, c, t, g, unknown or other
  misc_feature (419)..(419): n is a, c, g, or t
  modified_base (506)..(506): a, c, t, g, unknown or other
  misc_feature (506)..(506): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtcccnccaagcctccgaggggaaggggctggtgtgggtctcgacgtattaatagtgagtgggagtagcanaagctacgcggactcgtgaaggccgattcaccatctccagacgacaacgccaaagaacncgctgtatcgtgacaaagtcgaacagtcaggagacgaccgaggaccgacgggtctgtagttacttacgtgtgacgaagagagtacgnagcagcgtaggtacccgccgtactaccggg

SEQ ID NO: 120536 - DNA, 813 bp, Homo sapiens
  misc_feature: GYAE6OF02G7TDL.2.38.D05.1.454.CMB.1.raw
  modified_base (230)..(230): a, c, t, g, unknown or other
  misc_feature (230)..(230): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacgaggctctggacggtccttcctatggagctagaacacagcccaccctggtatcagtcgtcccaggacaggacggccaggatcactgctctgganatgctagtcgaccaaagctaattagtgactttagttcggtacagacgagaacgccgacggccacggcccctggtacggcggtggtagaattaagtaagtaaacggtacaaaggtagaaggacggcctaggaggtaactccgagacgctactttcgacgtcggactccagtccgtacggaacggaacaaacgtacgttacgtaacgttacgaacccgtagtacgtaaggtacggtaaccgtacggaacggacgtaaaggaacggtaagttacgggaacggttacctaaacggttaaccgttttaaacgtttacgttaacgttaaaccgtaaacgtaccggtaaactaaacgttaaacggaaccgttaaggttacccggtttaaaggggtttaaccggtttttttaaccggggttttacgggggtttaacggggttaacccgggggttaacggggtaaaacccggggttaaccggttaaccggttacccgggtttaacccgggttaaccccgggtttttaaccgggtaaccgggtttaaacccccggaaacggggtaaccccgtttaacggggttcccccccggg

SEQ ID NO: 120537 - DNA, 721 bp, Homo sapiens
  misc_feature: GYAE6OF02JW4EZ.2.38.D05.1.454.CMB.1.raw
  modified_base (250)..(250): a, c, t, g, unknown or other
  misc_feature (250)..(250): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacacgacggccaggatccacctgctcgtggagatcgcagttcgaccaaagcaatatntacttagttggtaccagtacaaggaacgccacggcccacggtcccccgtaggtcgtccgtgggtagtaacttaataacgtaaaaggtacgtaaggttaggaaggtaccgaccccgttaggaacggggtacctaccgtgaacgtcgtaactttcctcgtcggacctcacggtctaacgaacggaaccaagtacggtctaaccggttacgaaccctatcgtaagggtcgaaccggttccgaagggtacaaggaacgagtaaggacggtctaaggtaacttagtttacgatacgtaactcgacgtacgaacgtacaaccggtagttacgggttttacgggtttaacgggttttgggttaccgggttacggggtaacccgggtaacggtaccgtaaagggttcggtaaccccgggttacgtttaacccggtacgggttaaccccaccggggtttacccgaaaccgggtttcccgg

SEQ ID NO: 120538 - DNA, 587 bp, Homo sapiens
  misc_feature: GYAE6OF02JPIXO.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattgaccaaagcaatatgtcttagttggtaccagcaagaagccaggccacggcccctgtcgcgtggtgattataataaagacagtgagacggcctagaagggactccgtagacgcgtattctcgtcggcctacgacgtcgtacgaacgggaaccaaacgtacgtcgtaacggttacgaccagtacgtaggtaggacgttaccgacgggataacggaaagagttagacggtactagtaacttattacgtgtactaaatcgaagcctaagacagacgtagttgttacgttttggtcggttcgggacggtaggaccgaagtcgtaacggccgttacgagtaccgacggtacccgaaggtcccg

SEQ ID NO: 120539 - DNA, 573 bp, Homo sapiens
  misc_feature: GYAE6OF02G6JWV.2.38.D05.1.454.CMB.1.raw
  modified_base (292)..(292): a, c, t, g, unknown or other
  misc_feature (292)..(292): n is a, c, g, or t
  modified_base (337)..(337): a, c, t, g, unknown or other
  misc_feature (337)..(337): n is a, c, g, or t
  modified_base (372)..(372): a, c, t, g, unknown or other
  misc_feature (372)..(372): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaggggctggtgtgggtctcacgtattaatagtgatgggagtagcacaagctacgcggactccgtgaagggccattcaccntctccagagacaacgccaagacacgctgtatctgacaaatgaacngtctgagacgccgaggacacggctgtgtattacgngtgacaagagatagctagcagctggtaccgccgacgtacgtcggggaccgacgggaacccgtggtccaccgtctccctcgacgcctccgaccgacggcccagttccggtcccttcccccgtggcccgccctcggccctaccggacggacgtacccgtacccgtacccggacggacgaccgaccgacggccccgggtcccgg

SEQ ID NO: 120540 - DNA, 536 bp, Homo sapiens
  misc_feature: GYAE6OF02GS2MQ.2.38.D05.1.454.CMB.1.raw
  modified_base (382)..(382): a, c, t, g, unknown or other
  misc_feature (382)..(382): n is a, c, g, or t
  modified_base (404)..(404): a, c, t, g, unknown or other
  misc_feature (404)..(404): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtgggtccgccaagctccgagggaagggctggtgtgggtctcacgtattaagtagtgagtgggatagcacagctacgcggactccgtgaacgggccattcacatctacagacgacaacgccaagacacgntgtatctgacaatgaacagtcngagacgcgagacacggcttgtattagtacgtgtacgacaaggatatacgcagcagcgttcggacgccggaacgtaccggcggggacccaacggggtaccctgggtcccaccgttcctaccgtcgaccgtccc

SEQ ID NO: 120541 - DNA, 778 bp, Homo sapiens
  misc_feature: GYAE6OF02I9S7W.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctcctatgagctgaccacagcccaccctcggtgtcagtcgtccccaggacagaccggccaggatccacctgctacgtggagatgctattcgaccaaagcaatatgacttattggtaccagcagaagccaggccctaggccccctagtcgcgttcggtagtacttaagttaagtaaaacgacgtaaggtaggaacggtaccgggccctacggaacggggtactccccgtaggaacgtaccgtatttccgtacgtcgggtaccttacccgaggtccttaccgggaacgggaaaccctaaacggtacggttacccgttaaccggtttaccgaaccctaacggtccttaagggtaccgggtaccgttaccgggaaggtaccgaaacgggtaaaggtacgttacgggaacggttccgtacgttaaaccgtttacttaccgttagtaccgaaagttccgaacgtacgaaacgtaccgtaacggtaccgttaagggtttacggtttttacggtttttcggggtagggttttacccgggacggggtaaaccgggaacccgtaaagggtcccgtttaccggtaacccggttaccggttaccgggaccggttaacccgtaacccggtaccggttacccg

SEQ ID NO: 120542 - DNA, 513 bp, Homo sapiens
  misc_feature: GYAE6OF02HBB7I.2.38.D05.1.454.CMB.1.raw
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (393)..(393): a, c, t, g, unknown or other
  misc_feature (393)..(393): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaaagcaatatgcttattggtaccagcagaagccaggccaggcccctgtgctggtgatatataaagacagtgagacggccctcgagggactccctgagcgattcnctggctcagctcgaggacaacngtcacgttgaccatcagtggagtcaggcagaantgagctagactattactgtacaatcagcagacagctagttgttacgtttttgggagttcgggacgggacggtacctaagcgtacgaccgttacgtaggtaccacggacccgaaggtcccg

SEQ ID NO: 120543 - DNA, 696 bp, Homo sapiens
  misc_feature: GYAE6OF02JZ7M4.2.38.D05.1.454.CMB.1.raw
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
tcagacgctcgacacacgaccggtgctcgatttagtatctgatagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtgggtcccgcaagctccgaggggagggtctgggtgtgggtctcacgttattaatgtggagttgggagtagcacgaagctacgcggactcgtgacggccattccacatctccagacacaacgcaaacgacnccgntgtaatctacgacaaagttcgaaactgtctaggaacggtacggccggaaggtaccgcggtacttggttagttaaacttccgtgtagacgtaaagacgtaatacgacagcgaggtcgtacggtaccggaccgtacgtacgggtccggggtaccgaaaccggggtaccgttccgggtaccgtaccgtacccttcccgttacgaccggtacccctacccgaacccggaaccggtaccccttaggttccccggttccccgttacccccgtacgggccccgtcccttacgggtcccttaccggtagggaccccgtacccgacccgttaccggacggacccgcccggtaacccgacccggtcccgggtaccccgg

SEQ ID NO: 120544 - DNA, 566 bp, Homo sapiens
  misc_feature: GYAE6OF02HK3TL.2.38.D05.1.454.CMB.1.raw
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctctggattcaccttcagtagctactggatgcacgtgggtccgccaagctccgaggggaacgggctggtgtgggtctcacgtattaatagtgatgggatagcacaagctacgcggactcgngaggcatcacatcncaganacaacgccaagacacgctgtactctgactaaatcgaaactagtctaggaagacgaccggaaggacacggtctgttagtaacttacgtggtacgacgaaagagtataaggcaagcgagcgtaggtaccgcccgtaacgtaccggacggggacccaaccggggtaaccctgggtacccaacccggttcctacccgtcgaccgtcccccg

SEQ ID NO: 120545 - DNA, 562 bp, Homo sapiens
  misc_feature: GYAE6OF02JD9IN.2.38.D05.1.454.CMB.1.raw
  modified_base (286)..(286): a, c, t, g, unknown or other
  misc_feature (286)..(286): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
tcagacgctcgacacacgaccggtgctcgatttagtatctgatagttgggtttgggggtggggtccgaggaggcagaactctgggtgtctcaccatggcctggatccctctacttctccccctcttcactctctgcacaggctctgaggcctcctatgagctgacacagccaccctcggtgtcagtgtccccaggaccagacggccaggatcacctgctctggagatgcatttgaccaaaagccaatatgcttattggtaccagcagaagcaggccaggcccctgngctggtgatatataaagacagtgagaggcctcgaaggggactcccgtagagcgaagttctctggctccagctcgagggacacagtcacgtacgacntcagngagtcagcagagatgagtcngactatacagtcaatcagcagaacagcgtaagtgggtttaacgtttttgggtagggtttccgggtacggggaacggggtacccgtaaaggtccggttacggtaacccgggttaccggtttaagggtccgtaacggaccccggtaagggtccccgg

SEQ ID NO: 120546 - DNA, 594 bp, Homo sapiens
  misc_feature: GYAE6OF02JAO81.2.38.D05.1.454.CMB.1.raw
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagcctccgagggaacggggcgtggtgtgggtctcgtacgttattaataggtgagtgggagtagcaacgaagctacgcggtactcggtagacgggccgattccacctatccgtaccaggacaaccaaacggccaaagaaccacgctagttacnctagaaccaaaatcgaaacngttcgtagaacgacggaccggaggaaccacgggcttgtagttaagttaccgtgtacgactaaaggagtaacgtaaggcaaggtcacggtaccgttacgggaacccgtcccggtaagttaccgggg

SEQ ID NO: 120547 - DNA, 535 bp, Homo sapiens
  misc_feature: GYAE6OF02GB2DR.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagaagccaggccaggcccctgtcgcgtggtgatatataaagacagtgagagccctcgagggactccgtagagcgattctcgtggctccgagctacgacgggaaccaacgacgtcacgttacgacctaatcaggtacggagtaccgaggtcaaggaagagtagaggctacgaacttattacgtagttacaatcagacagacagctagttgttacgttttgggcgttcgggtcggacggacgaagcgtagaccgtcgtacggtcgacgccgaagtccg

SEQ ID NO: 120548 - DNA, 740 bp, Homo sapiens
  misc_feature: GYAE6OF02F073L.2.38.D05.1.454.CMB.1.raw
  modified_base (265)..(265): a, c, t, g, unknown or other
  misc_feature (265)..(265): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtgggggtccctgagactctcctgtgcagcctctggattcaccttcagtagctacgtggatgccacgtcgggtcccnccagcctccgaggggaagggtcgtgggtggtggtcctcgtacgttattaagtagtgtagtgggagtacgacaacgaagtccgtacggaccggtaccgtccggtaggaacgggtcccgtagttcccgaacccgtactccctacccgaaggtaaccgaaaccaaaccggtacccgaaaacgaaccgaccgtcgttacggtacttaccgtacggaaaccaaagttacggaaactacggttaccgtaagggaaggacccggtaccggaaggtacccgaacgggttcgtaggttacgttttaaggttactaggtacggaacctaagggtacgtaactacgacgaacgacgacggttaccgtacggggtacccgaccgggtaaccgttaccggggtaccggggggaacccggtaaacccggggtaccccgttcgggtacccctaacccggtttcccacccggttaccgaccccgtaccccg

SEQ ID NO: 120549 - DNA, 568 bp, Homo sapiens
  misc_feature: GYAE6OF02G27E0.2.38.D05.1.454.CMB.1.raw
  modified_base (463)..(463): a, c, t, g, unknown or other
  misc_feature (463)..(463): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattgaccaaagcaatatgcttattgtaccagcagaagccaggccaggcccctgtgctggtgatataataagacagtgagacgcctgagggactccgtgacgcgatttcctcgtacgggtctaccgagtcctacgtaacggggaccaaacgtacgtacgtacggtttacgaccctagtcgaggtaggacgtaccacgggacaagaacgagttaggagtctagaacttattactgtanaactacagtacagacagctaggtcgttacgtttgggttgtcgggcgggtacggtacaaggcgttaggaccgttccgtaggttacccgacgtacccgaaggtcccg

SEQ ID NO: 120550 - DNA, 717 bp, Homo sapiens
  misc_feature: GYAE6OF02J1O1P.2.38.D05.1.454.CMB.1.raw
tcagacgctcgacacacgaccggtgctcgatttagtatctgatagttgggtttgggggtgggtccgaggaggcagaactctgggtgtctcaccatggcctggatccctctacttctcccctcttcactctctgcacagctctgaggcctcctatgagctgacacagcccacccgtggtgtcaggtcgtccccaggacacggaccggccaggtactccaccgtgccttcgtcggagatcgctagttcgaccaaagctaaagtatcgtcttagtggtaccagctagaacgccgaggtccaacggccccgtgtcggctggtagactataagtaaagtacgaggttcgaaggacggtccctcggaaggggtacctccgtaggaacggtcgtaactttccgtcggtcggcttacccgagggtactacggaacggggtaacccaaacggtacgttccgtaacggttaccgaaccgtacgtacgtaacgggtacgggtacgtaccggaaggtcgaacggtaaagaggttcggaacgacgttacgtaacgttagtaccgttagtaccgaaagttcgaacgaccgtaagaccgtacgtaccggtaggtttacggttttaaccggtttgggttaccggtttaccggggacgggtaaccggtaccgtaaggtaccgtcgggttacccggtacgtacggttacccgacgggtaccctagggtaccccgg

SEQ ID NO: 120551 - DNA, 592 bp, Homo sapiens
  misc_feature: GYAE6OF02HN3RK.2.38.D05.1.454.CMB.1.raw
  modified_base (307)..(307): a, c, t, g, unknown or other
  misc_feature (307)..(307): n is a, c, g, or t
  modified_base (347)..(347): a, c, t, g, unknown or other
  misc_feature (347)..(347): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtcctccaagcctccgaggggaaggggctgggtgtgggtctcacgttattaatagtgatgggagtagcaacaagctacgcggactccgtgaaggccattcaccatctccaganacaacgccaagaaccacgctgtatcgagacaaatgaaacngtctggacgagccgaggacacggctgtagtatttctggtcgacaagagatagcagcaggtcgtaggaccgccgtacgtacggtcggggacctaacgggacccttggtcccgaccgtcctcctaccgacgtccctacccgaaccgaaccgggtcccctacgtcccggtcccttccccgagggtccccaccgttcgaccgtccgaggccgtcccaccgtccgagaccgccaccggcgcccggtcccg

SEQ ID NO: 120552 - DNA, 661 bp, Homo sapiens
  misc_feature: GYAE6OF02FGGD1.2.38.D05.1.454.CMB.1.raw
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgttattaatagtgatgggagtagcacaagctacgcggactccgtggaagggccgattcaccatctccagagaccaacgccaaagacacgctgtatctgacaaatgaacagtcngagngccgaggacacggctgtgtattacgngtgacaagagatagcagcgagcgtcgggtaccgccgtactacggtcgggggaccaacggggtaacccctgggtaccctacccggtccttcccgtaccgacgtcccctacccgaaaccggaaccgggtcccctaacgttccccgggttcccctttcccccccggtacgggccccgtcccccgtacggtccccgttaccccggaacggggtacccgtacccctaaccccggtacccgggtaacggaccggtacccgaacccggtccggggaccccgggtcccccggg

SEQ ID NO: 120553 - DNA, 772 bp, Homo sapiens
  misc_feature: GYAE6OF02JT2HI.2.38.D05.1.454.CMB.1.raw
  modified_base (170)..(170): a, c, t, g, unknown or other
  misc_feature (170)..(170): n is a, c, g, or t
  modified_base (185)..(185): a, c, t, g, unknown or other
  misc_feature (185)..(185): n is a, c, g, or t
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (548)..(548): a, c, t, g, unknown or other
  misc_feature (548)..(548): n is a, c, g, or t
tcagacgctcgacacacgaccggtgctcgatttagtatctgatagttgggtttgggggttggggtccgaggagggcgagaactctgggtgtctcaccatggcctggatccctctacttctcccctcttcactctctgcacaggctctgaggcctcctatgagctgacacncgccacccgtcggtntcagtcgtccccaggacacgaccggccaggactccaccgtgctcgtggaagntgctagtcgaccaaagtcaaatntcgtattaagttacggtaccacgacgtagaaacgccgacggccgaaccggtcccgtcgttagtccgtggtagtaataataagtaacgaacgtaggtagtacggacgaccccggtacgtacggggtataccccggtagtaaggtcggtaactttcgtcgttaccgggtacctcccgaacgtaccgttacggaacggggtaaaccaaccgtacgttccgtaaccgtttacgaaccctaacgtaccgtaaggtacggtaacggtaccgtaacggtacgaacggtaaacggngttaacggaacggtccgtaaacgttacttaaggtttaacgttacggtacaagttaccgaagtaccgaacggtaacgtacgtaacggtacgttttagggttacggttttacggggtacggtttacccgggggaacgggtaccgggtaaacgtaacgggtttaccgaccgggttaacccgtacccggttaaaggtcccggtaaaccgtcccggtaacggttacccg

SEQ ID NO: 120554 - DNA, 742 bp, Homo sapiens
  misc_feature: GYAE6OF02JCI5N.2.38.D05.1.454.CMB.1.raw
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccggggaggcttagttcagccgtgggggtccctgagactctcctgtgcagcctctggattcaccttcagtanctacgtggatgcacgtggtccnccgaagccgtaccgaggggaacgggcgtgggtgttgggtcctcgacgttattaagtaggtgagtggaagtgcaacgaagcgtacgcggtactccgtaggaacggccgtacgttccgaccagttccgtacgaacggtacgaaaccaaacccgtaccgaaaacgaaaccgtaccgactttacggtaaacttccgtaaggaaacccaaaagttcggaaaaacctacggttacgtaggaacggaaggaccccggaaacgggtaacgacccgggtatttacgggttaagttaaacttttaccggtaggttacgtaaaccggtaaaagtacggttaaacgttaacgggacctaaacgggacctagggtaaccgttcggtaaaacccgggccccgttaaaggtttacccgggcgggggtaaccccgtaagggtaacccccgttggttaccccgaacccgttccggtacccgtacgaaccccgtccccgg

SEQ ID NO: 120555 - DNA, 577 bp, Homo sapiens
  misc_feature: GYAE6OF02IHUJ6.2.38.D05.1.454.CMB.1.raw
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctgggggtccctgagactctcctgtgcagcctctggattcaccttcagtagctactggatgcactgggtccgcaagctccgagggagggctggtgtggtctcacgtattaatagtgatgggatagcacagctacgcggactcgtgaaggcatcaccatctccagacgacaacgccaagaccacgctgtactcgtagacaaatgaaactagtctagacgagccgaggacncggctgtcgtattacgngtcgacaagagatagcagcagcgtaggacgccgacgtacggngggaccacgggaacccgtggtaccgaccgtctcctacgacgtccctaccgaaccgacggtccctacgtccgtcccgttccccgtcggcccgtcccgtgcccgtccggaacggtccgacccgacccgtaccgacggaccggaccaaccgtccggccggtccccgg

SEQ ID NO: 120556 - DNA, 615 bp, Homo sapiens
  misc_feature: GYAE6OF02IRU9U.2.38.D05.1.454.CMB.1.raw
  modified_base (341)..(341): a, c, t, g, unknown or other
  misc_feature (341)..(341): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcctattcgaccaaaagcaaatatgacttattcggtaccagacagaagccagggccaggccccctagtgactgggtagatataataaagacagtgagacgcctacgaggactcccngagcgtattcgtacgtgcctccgagctaccgaagggacaacacgtctacgttagaccctatcgagtaggacgtaccgaggacgaagaaacgagtaggaggtcgtagtaaccttaattaccgtgtactaaataccgaagacaacgtaacgaacgagtaaaggttcgggtttacggttttttagggcgggtttcggggaccgggtaacgggaaccgaacggtcgtacggtacccgttaccggtaaccggtccgaaccggacccgtaacggtccccg

SEQ ID NO: 120557 - DNA, 654 bp, Homo sapiens
  misc_feature: GYAE6OF02HIS6Y.2.38.D05.1.454.CMB.1.raw
  modified_base (223)..(223): a, c, t, g, unknown or other
  misc_feature (223)..(223): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtgtccccaggacagacggccaggatcacctgctctgganatgctattcgaccaaagcaatatgtctttagttcggtaccagcaagaacgccgaggccacggcccctggtgcgtggtgatataataaagactagtaggagacggtccctacggacgggtactcccgtggacgtccgtacgtttctacgtcggacccttccgacgtctccggaaacggggaccaaacgtacgttaccgtacgtttacgaaccctacgtacgtaaggtcggacgttacccgaaggacgtaaggaagtagtacggaggtcgtacgactttaatacgttcgtaactaagtacgagacgaacgacgagacgtaaggtttacggtttacggttttgggtcggtttaccggggcgggtaaccgggaccgtaacggtccgtacggtacccgttaccggtacggtaccgtaccggaccgtacggtccccg

SEQ ID NO: 120558 - DNA, 776 bp, Homo sapiens
  misc_feature: GYAE6OF02IDLG9.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctcccctcttcactctctgcacaggctctgacggcctcctatgagctagacacgacgccctacccgtcggtgtaccagttccgtccccgaggacacggaccggccaaggctaccaccgttgcctcgtggatatgactagttacgaccaaagctaatatggtacttagttcggaaccagacgaaggaacgcccgacggacccgaccggcccgttagtcggtacgttggtaagtaattaaagtaaagtaaacgtaacgaggtagaacggtaacggtccccgtaggaaacggggtctacccggtaggacggtcgttaacgttccgtcgtacggcctccgaacgaccgtaacgacgggaacctaacgacgttccgtacgttacgacccgaagttcgggtagtaacgggtaccgtccggtaaggggacctaaagggaaacgtacggtacggtaacgggcgtttaacggaacctttaacgtaaccggtttagtaaccgttaagtaccgaacgaacgaacgtaaacgccggttaaaggtagggtttaccgtttttagggtttacgggttcgggtttccgggaaacggggtaacggtacgtaacggtaccgttccgggtacccgttacggtaccgggtacccgtaccggacccggtacgggttacccccg

SEQ ID NO: 120559 - DNA, 666 bp, Homo sapiens
  misc_feature: GYAE6OF02IFSW2.2.38.D05.1.454.CMB.1.raw
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (541)..(541): a, c, t, g, unknown or other
  misc_feature (541)..(541): n is a, c, g, or t
tcagacgctcgacacacgaccggtgctcgatttagtatctgatagttgggtttgggggtggtccaggaggcagaactctgggtgtctcaccatggcctggatccctctacttcctccccctcttcactctctgcacaggctctgaggcctctatgagctgaccactacgccctacccgtcggtgtcaaggtcgtaccccgagggacaggaccggcctaaggactccaccgttgccttcgtagggaagntcgctatcggaaccaaagcaatntcgtcttattcggtaccagacacgacgcacggccacggtccctggtcgccgtggtagtattaactaagtaacgactagtcggaggaccgtcctacggaggactcccgtagacgcgtagttctcgtcgtctcgagtcctagagggacctaacgcgtccgtacgtacactagtcaggtacggtcgtaccgaagggacctaagggaactacgggacggtacggtacgttacgtaactttacgtacttacgtacgtaactccgactacggaacncgtaacgtcgttcgggtttaagtttcgggtttggttaacgggttcgggaaaccgggtggtaacccggtagtaccgtgggtaacccgttacggtcggtaccgggtaccctcccgggtaggtccccg

SEQ ID NO: 120560 - DNA, 602 bp, Homo sapiens
  misc_feature: GYAE6OF02JXILK.2.38.D05.1.454.CMB.1.raw
  modified_base (268)..(268): a, c, t, g, unknown or other
  misc_feature (268)..(268): n is a, c, g, or t
  modified_base (363)..(363): a, c, t, g, unknown or other
  misc_feature (363)..(363): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (526)..(526): a, c, t, g, unknown or other
  misc_feature (526)..(526): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtcgcagcctcgtggtacttcaccttcagtacgctacgtggatgcacgtcggtccnccaagctaccgagggaacgggctgggtgtcggggtctacgtaacgttaattaagtaggtagagtgggagtacgcaagagctacggcggtactcgnggtaggaacggccgtaattccaccgatcctacgagaacgacaaacgtaccaaagaaccgcgtactgtanctagactaaagngaaacngtacgagacgacgaccggagacgacgtcgtgtacgttatacgtgtacgagaaagagtacgtagacgagacgtacgngtacggtaccgaacgtaccggtacggtccgggaccgtacgggaccctggaccctaccggtcctaccggtctaaccg

SEQ ID NO: 120561 - DNA, 742 bp, Homo sapiens
  misc_feature: GYAE6OF02HBG97.2.38.D05.1.454.CMB.1.raw
  modified_base (282)..(282): a, c, t, g, unknown or other
  misc_feature (282)..(282): n is a, c, g, or t
tcagacgctcgacacacgaccggtgctcgatttagtatctgatagttgggtttgggggtgggtccgaggaggcgagaactcgtgggtgtctcaccatggcctggatcctctacttcctccccctcttcactctctgcacaggctctgacggccctcctactgacgcctgaacacacgccctaccccgtcggtcgtcagtccgtacccccgaggacaggaccggccaggatccgaacctgcctcgtaggagtacgtgactattcgaaccaaagtcaaattagngtacttagttaggtacaacgacaagaacgaccgacggaccgaccggccctaggtcgcgtggtacgataacgtaaaagtaacaacgtaggtagaaggaccgggacccttaacggaacgggggtaactacccgttagggaacggacgttaaccttaccggtcttccggggtacctacccgtaggtacctaccgggaacgggtaaacccaaacggtacggtaacgtaaccgtttaacgggacctaacaccggtaggtacgggtactacccggaaggtcgaaaggaagaaggtacgaggcttaagacttaacgtacagtacgtaacacgacgtacaacggaacacggtacgacgggttgtttagttttcgggtacgggttcggtaacggggttacggaccggtaaaggtccggaacgttacccgggtacgtagggtacccacgggtacccgtaaggtccccggg

SEQ ID NO: 120562 - DNA, 590 bp, Homo sapiens
  misc_feature: GYAE6OF02FTMH3.2.38.D05.1.454.CMB.1.raw
  modified_base (440)..(440): a, c, t, g, unknown or other
  misc_feature (440)..(440): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagcctggggggtccctgagactctcctgtgcagcctctggattcaccttcagtagctactggatgcacgtgggtccgccaagctccgagggaaggggctgggtgtgggtctcacgtattaatagtgatgggagtagcacaagctacgcggactccgtgaaggccgattccaccatctcagacgacaacgccaaagacacgctagtatctagacaaagtgaaacctagtcctagaagacgaccggaggaccacgggnttagtgttattacgtgtagacaaggagtaatacgcgtagcaacggccttaggggtaccgacccggtaacgttacggtccgggggaacccgaacggggttaacccctgggtaccctaacccggttcccttacccgtcaccggttacccccg

SEQ ID NO: 120563 - DNA, 727 bp, Homo sapiens
  misc_feature: GYAE6OF02IY07S.2.38.D05.1.454.CMB.1.raw
  modified_base (165)..(165): a, c, t, g, unknown or other
  misc_feature (165)..(165): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgagcctcctatgagctgacacngccaccctcggtagtcagtcgtccccgaggaccagaccggccaggactccacctcgcttccgtaggagattgctagttcgacctaaaagcaaatatcgtcttagttggtaccaggcctaagaacgccaggccacggtccccctgtcgtcgtggtgaattataagaaacgacgtagtgaaggacggccctacgaggggtactcccgtaggacgtccgtatttcctcgtcgggtccttaccgacgtccttacggacgggtaaccaacgtacgtaccgtaacggttacgaaccgtagttaccgtaggtacggaaccggtccgaaggggacaaacgggaaacgtacgtacgggtaacggtaccttagtaaaccgtttaagttaccgttaggtacctaaacgttacgaacgaccgaacgaaccgacgtacgttacgggtttagggttttaccggttttcgggttacggtttaccggggtaaccgggtacggtaaccggaacggttcccgtaaccggttcccgggtaccgttaccgggtcccgaacggttccccggtaacggtccccg

SEQ ID NO: 120564 - DNA, 490 bp, Homo sapiens
  misc_feature: GYAE6OF02ICWS0.2.38.D05.1.454.CMB.1.raw
  modified_base (331)..(331): a, c, t, g, unknown or other
  misc_feature (331)..(331): n is a, c, g, or t
  modified_base (418)..(418): a, c, t, g, unknown or other
  misc_feature (418)..(418): n is a, c, g, or t
tcagacgctcgacacacgaccggtgctcgatttagtatctgatagttgggtttgggggtggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagcagtgagaggccctcagggatccctgagcgattcnctggctcagctcagggacaacgagtcacgttgacatcagtgagtccaggacagaagatgagctgactatactgtacaatcagcaganagcagtgtattttgggtagttcgggacggaggactaaggctagtaccgtcgtaggtcagtcccgaggtcccg

SEQ ID NO: 120565 - DNA, 684 bp, Homo sapiens
  misc_feature: GYAE6OF02IV026.2.38.D05.1.454.CMB.1.raw
  modified_base (581)..(581): a, c, t, g, unknown or other
  misc_feature (581)..(581): n is a, c, g, or t
  modified_base (605)..(605): a, c, t, g, unknown or other
  misc_feature (605)..(605): n is a, c, g, or t
  modified_base (640)..(640): a, c, t, g, unknown or other
  misc_feature (640)..(640): n is a, c, g, or t
tcagacgctcgacacacgaccggtgctcgatttagtatctgatagttgggtttgggggaggccccgacgccctgggattcccagctgtttctgcttgctgatcaggactgcacacagagaactcaccatggagtttgggctgagctgggttttccttgttgctattttaaaggtgtccagtgtgagtgcagctggtggagtccggggagcttagtcagccgtgggggtccctgaggactctccgtgtgtcagcctctggtattcgaccttcagtagctacgtggtatgctacgtcgggtccaccgaacgcctccggaagggtaacgggctggtggtacgggtctaccgacgttattaacgtaggttcgaagttgggaagttacgacgtaacgaagccgttaacggacggaccttaccgggtagaacgggcccgtattaccgaacctagtaccctaccgaggaaacgtacccgaaacggtcccaaaaacgggtaaccaaccggtacgtttacgtaacgttacccgtaggaccctaaaagtcgtaaaccgtagttccgaggaacgacgtacccggaaggaccncgggtactggtacgttaattacgngtacggtaacacggtaaggccttaaaggaccgtanaaccgtaggcccgttaggtaaccggttaccggcttaacccgggg

SEQ ID NO: 120566 - DNA, 566 bp, Homo sapiens
  misc_feature: GYAE6OF02GWMXD.2.38.D05.1.454.CMB.1.raw
  modified_base (381)..(381): a, c, t, g, unknown or other
  misc_feature (381)..(381): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgcaagctccagggaaggggctggtgtgggtctcacgtattaatagtgatgggagtagcacaagctacgcggactccgtgaagggccgattcaccatctccagagacaacgccaagaaccacgctagtatctgcaaatgaacagtctgagagccgaaggacacggctgtgtattactgtgcaagngatagcagcagctggtacgccgactacgtcggggccagggaaccctggtccaccgtctcctcacgccctacccgaccgaacggcccacgttccggttcccttccccgtcggcccgtcccgtacggccgtaccgaacgggacgaccgtacccgtccggacgaccggccaccgacggccggtcccgg

SEQ ID NO: 120567 - DNA, 578 bp, Homo sapiens
  misc_feature: GYAE6OF02IWBO3.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccccctcttcactctctgcacaggctctgaggcctcctatgagctgacacagccaccctcggtgtcagtgtccccaggacagacggccaggatcacctgctctggagatgcattgaccaaagcaatatgcttattggtaccagacagaagccacggccacggcccctgtgctggtacgatataagtaaagactaggtgaagacggccctcgagggactcccgtagacgcgtatttcctcgtcggctaccgacgctacgagggaccaacgacgtcgtacgttacgaacctatcgaggtcgacgtcgaggacagaagagtgacggtctagtactattacgtgtactaatacgagtacgagacgagcctaaggttcgttacgtttttgggtggtttaccggggagggtaccggtacgaagtccgtacgtaccggtcgttacggtacgacgtacccgtaggtcccg

SEQ ID NO: 120568 - DNA, 750 bp, Homo sapiens
  misc_feature: GYAE6OF02GIEW5.2.38.D05.1.454.CMB.1.raw
  modified_base (251)..(251): a, c, t, g, unknown or other
  misc_feature (251)..(251): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggtcttagttcagccgtgggggtccctgagactctctgtgcngcctctggattcaccttcagtagctacgtggatgcacgttcgggtccgaccaaggccgtaccgaggggtaacggggtcttggggtggttgggttcctacgtaacgttagtttaaagtaggtaggtagtaggggagtagccgaacgaaggtaccgtaaccggacgggtaaccttacccgggtagggaaaccggggtcccgtaaatttcccaacccgtagttcccgtacccgaaggaacgaacccaaaccggaccgaaaacggtaaccacggtcctaggttaacttcctaggacctaaaagtccgaaacgtacgttacgtaaggaacggtacgacccggggtaaggaaccggtaaccggtacgttacgggttagttaaccgtttacggttcgggtaacgaaccggtaaaagggtaacggtaaactaaccgggctaaaccgggcgtaacggttccggtttaaccgggttaacccggacccgggtaaacgttaaccccggggg

SEQ ID NO: 120569 - DNA, 621 bp, Homo sapiens
  misc_feature: GYAE6OF02JWZYO.2.38.D05.1.454.CMB.1.raw
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (481)..(481): a, c, t, g, unknown or other
  misc_feature (481)..(481): n is a, c, g, or t
  modified_base (569)..(569): a, c, t, g, unknown or other
  misc_feature (569)..(569): n is a, c, g, or t
tcagacgctcgacacacgaccggtgctcgatttagtatctgatagttgggtttgggggagccccagccctgggattcccagctgtttctgcttgctgatcaggactacacacagagaactcaccatggagtttgggctgagctgggttttccttgttgctattttaaaaggtgtccagtgtgaggtgcagctggtggaggtccggggagcttagttcagccgtgggggtccctgagactctcctgtgcagcctntggattccaccttnagtgctacgtggatgcacgtcgggtccgacaacgcctacggagggtaacggggtctgggttcggtggtctacgtacgttaagttaagtagtggagtgggtagtagcgaacagccgtacggcggtactccggtaggacgggaccgtacttccaccgnttaccnccgaagacgaaccaaccggaccgaaagaaccgacgttactaggtactcganacaaagtgaactgtacgtaggaacggtacgacggaacgaccgacgtacgtaggtacttaagtcgttaggcgataaaggctaatacggngtaacgcgacggtccgtacggggtaacccgtcggtaccgtacgggtccgggg

SEQ ID NO: 120570 - DNA, 683 bp, Homo sapiens
  misc_feature: GYAE6OF02HVKXO.2.38.D05.1.454.CMB.1.raw
  modified_base (134)..(134): a, c, t, g, unknown or other
  misc_feature (134)..(134): n is a, c, g, or t
  modified_base (137)..(137): a, c, t, g, unknown or other
  misc_feature (137)..(137): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (407)..(407): a, c, t, g, unknown or other
  misc_feature (407)..(407): n is a, c, g, or t
  modified_base (442)..(442): a, c, t, g, unknown or other
  misc_feature (442)..(442): n is a, c, g, or t
  modified_base (513)..(513): a, c, t, g, unknown or other
  misc_feature (513)..(513): n is a, c, g, or t
  modified_base (532)..(532): a, c, t, g, unknown or other
  misc_feature (532)..(532): n is a, c, g, or t
tcagacgctcgacacacgaccggtgctcgatttagtatctgatagttgggtttgggggtgggtccaggaggcagaactctgggtgtctcaccatggcctggactccctctacttcctcccctcttcactctctncanaggctctgacgcctcctatgagctgacacacgcccacccgtggtgtcaggtccgcccgaggacacggaccggccaggactcacctgctcgtggagtatgctacttacgaccaaaagtnaaattntcgtacttaagttcggtaaccagacgaagaacgccgaagggcccacgggtcccctggtcgcgttaggtataaagaattaagaaaacgtacaaggtggaagaccggtcctacggaagggacctccgtgaacgtacgtacttcgtcgnggtccctaccgaagtctaacggaacggaacgtaanacgttaccgtagtttccgaacacgtaccgaggtacgtaccgtcgaaggaccgaaaggtaacggagtaaggngacgtagaaccttatttangttaacgaactgaccgagaaccgaagcgagtaaggttacgtttccgtttggggtttaacgttccggggagggtaacccgggtacggtaacgtaccgttaggtacccgttaccggtcgggttaaccacggaacccggtaggttaacccccgg

SEQ ID NO: 120571 - DNA, 877 bp, Homo sapiens
  misc_feature: GYAE6OF02JRXDJ.2.38.D05.1.454.CMB.1.raw
  modified_base (196)..(196): a, c, t, g, unknown or other
  misc_feature (196)..(196): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacacgccaccctcggtgtcagtctccccaggacngacggcctaggctcacctgcctcgtgggacatcgacctattcgacccgaaagctaacttagtcgtctttagttacggtaccgaagactaagacggtaccagggaccgaacgggccccctggttacgccgtggtccgattaagtataaacgaactagtaggaacggacggtaccgtaccgaggggtaccgttacccgtaggaacggtacccggttaaggtttacccttccggttccgggtaccgttaccccggtacggtacccgttaacggaacccggggtaaaccgtaaacccgtagggtttcccggtaaaccgtttacccgggaacctaacgttaccggtaaacgggtcgggttaaccgtacccggaacgggtaacggtaaacggaacggtaaggttagggaaccgggtacccggttaaccgggtaagtttaactttaacccggttacgggtaacttaaccgttccggaacggaacccgtaaggaaccccggttaaggtacccgtaaggggttttaccggggttttaacgggtttttttccgggggaacggtttttaccggggggaacccggggttaacgggtaccggttaaaaccggttcgggttaaaccgggtccccggttttaaccgggtaaccgggtaccggttaacccgggtacccggtaccgggggtacccccg

SEQ ID NO: 120572 - DNA, 756 bp, Homo sapiens
  misc_feature: GYAE6OF02FIO1Z.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcacctgctctggagatgcattcgaccaaagcaatatgtacttattcggtaccagcagaacgccgaggccacggcccctgtcgcgtggtgacttaataataaacgactaggtggaagacggtccctaggaacggggacttccccgtaggacgtcggtactttccgtacgttcgggaccttcccgaagtccttaccggaacggggtaaccaaaccgtacgtaccgtaacggtttacgaaccgtacttaccgagggttacgggaaccggtaccgaacgggtacgaaaggaaacggtaagtacgggaacggtacgttacggtaactttaacgtttaacgttacgttaaccgtaaacgttacgaacgtacgaacgaacgaacggtaacggttacgggttttacgggttttaaccggtttttttgggggtacgggtttaccgggggtaccggggtaaccgggtaaacccgtaacgggtccggttaccgggtaacccggtttaccggttaaccgggtaccggtaacccggtacccggtaacgggttacccccgg

SEQ ID NO: 120573 - DNA, 682 bp, Homo sapiens
  misc_feature: GYAE6OF02JLZCR.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtgggggtccctgagactctcctgtgcagcctctggattcaccttcagtagctactggatgcacgtgggtccgcaagctccgagggacggggctggtgtgggtctcgtacgttaattaacgtagtgagtagggagttagcgaacaagccgtaacggcggtacgtccggtaggaacggggccgtattaccgacctactccgtaccgaaggacgaaccaaccgtaccaaagaaccacgtctagtactctcgaactaaagtcgaaactcggtactagaacggacgaccggaacggacccgacggtctaggtttagtaacgtttacgtggtcgaacgtaaaggacgtaacgtacgacgaacggtccagggtaccggttacgggttaacccggacccgtaaccgggttaccgggtccgggggtaacccgaaccggggttaaccccgttcgggtacccgtaccccggtttccgtaccccgtaccgtacccgtacccccg

SEQ ID NO: 120574 - DNA, 764 bp, Homo sapiens
  misc_feature: GYAE6OF02GSLT7.2.38.D05.1.454.CMB.1.raw
  modified_base (224)..(224): a, c, t, g, unknown or other
  misc_feature (224)..(224): n is a, c, g, or t
  modified_base (371)..(371): a, c, t, g, unknown or other
  misc_feature (371)..(371): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtccagtcgtccccaggacagacggccaggatcacctgctctgganatgctattcgaccaaagctaaatatgtacttagttacgaccagcaagaacgccgacgccgacggcccctggtcgcgtggtgaatataacgaaacgctaaggtagaggacggtccctacgacgggctacccgtgacgacgtatttccncgtcggtaccctcgagacctagaacgggaacctacgagtccgtacgttacgaaccctagtaccgtaaggtaccggtagtaccgaggtaaccgaaggtaaacgtacgtacgggaccggtaacgttacgttaacccgttaagtttaacccggtaacgtttaaccgtaaacgtaaccgtaaccggtaacgaaccgtaaggtaacgttaacggttaaccgggttttaaggggtttttaaccgtttttttcggggtaccgggggtttaaccggggaacccgggggtaaaagggtaaccccgttaacgggtaccggtttacccggggtaaccccggtttaacccgggttaggttaaccccggaacccggggttaaccggttaaccccgggttcccccgg

SEQ ID NO: 120575 - DNA, 577 bp, Homo sapiens
  misc_feature: GYAE6OF02FZYPV.2.38.D05.1.454.CMB.1.raw
  modified_base (257)..(257): a, c, t, g, unknown or other
  misc_feature (257)..(257): n is a, c, g, or t
  modified_base (300)..(300): a, c, t, g, unknown or other
  misc_feature (300)..(300): n is a, c, g, or t
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctgggtggagtccgggggagcttagttcagccgtcggggggtccctgagactctcctgtgcagcctntggattctaccttcagtagctacgtggatgcacgtcgggtccnccaagctacgagggagggctggtggtggtctcacgtattaagtagtgagtgggtagtagcaacagcgtacggcgacgtcgaggacgggcagttccacntcacagacgaacacgacaaagacacgctntactctacgaactaaatcgaatacgtcgtagaacggacgaccggtaggacgacggctaggttacgttacgtacgttggtacgaacgtaaggacgtaagtacgacgtagacgacgtaccggtacggtacccgaccgtaacggtacccgggg

SEQ ID NO: 120576 - DNA, 566 bp, Homo sapiens
  misc_feature: GYAE6OF02GSAN1.2.38.D05.1.454.CMB.1.raw
  modified_base (362)..(362): a, c, t, g, unknown or other
  misc_feature (362)..(362): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctctggattcaccttcagtagctactggatgcactgggtccgccaagctccgaaggggaacggggctggtgtgggtctcgaacgtattaatagtgagtgggagtagcaacaagctacgcggactcggagacggcatcacatcncagagacaacgccaagacacgctgtatctagacaaatgaacagtcaggagacgccgaaggacacggtctgtattattactgtacgacaagagtagtacgcagaccagcgtacgggtaccgaccggtaaccgtacggtccggggaaccaccggggtaacccttcgggttacccacccggttcctacccgtaccgacgtacccccg

SEQ ID NO: 120577 - DNA, 693 bp, Homo sapiens
  misc_feature: GYAE6OF02IJWRN.2.38.D05.1.454.CMB.1.raw
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (346)..(346): a, c, t, g, unknown or other
  misc_feature (346)..(346): n is a, c, g, or t
tcagacgctcgacacacgaccggtgctcgatttagtatctgatagcttgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtgggtccaccaagcctcgagggaagggctgggtgtgggtctcgacgttattaactagtgagtgggactagcacaagctacgcgactcgtggaacgggccattcgacatcnccagacgacaacgcaagacacnctgtactcngacaagtgaacngttcaggagacgccggaaggacacgggtctcggttgtaactttacgtggtagaacgtaaggtaacgatacggacgaacgacgaacggtcgttacggaaccggtccgaacgttacggacgggggtaccaacgggtaaccccgtggtacccgtaccggtaccctcgttacgaccggtccctacccgtaaccggtaaccgggccctaaccggttcccggttccccttaccccgtgggcccccggttccgtacccggtaccttaaccccgggagggtaccccggtaccttaaccccggtacccgggaagaccccggtaccggaaaccgccgggttacccccgggtcccggg

SEQ ID NO: 120578 - DNA, 671 bp, Homo sapiens
  misc_feature: GYAE6OF02GFQ1A.2.38.D05.1.454.CMB.1.raw
  modified_base (228)..(228): a, c, t, g, unknown or other
  misc_feature (228)..(228): n is a, c, g, or t
tcagacgctcgacacacgaccggtgctcgatttagtatctgatagttgggtttggggggtgggtccaggaggcagaacctctgggtgtctcaccatggcctggatccctctacttctccccctcttcactctctgcacaggctctgaggcctcctatgagctgacacagcccaccctcggtgtcagtcgtccccagggacagacggccaggatccacctgctctgganatgctagttcgaccaaagccaatatgtccttagttcggtaaccaagtcgaaggaacgccaacgggcccacggccccctggtcgcgttggtcgatataataaagcaggtgagacggtccctcgagggtactcccggtagacggcgtactttcgtcgtggtcctcgtagtcgtacgacggggtaccaacgtacgtccgtacgttcgaacctagtacgaggtcgggacgttccgaagggtacaacggaagtacggtacggaaggttacctacgtacgttaacgttacgtacgtactaagtacgtacgacgaacgtacgaacggtcgtaaggttcggtttacggttttggggtacggttccggggaacgggtacggtaaccggtaacggtccgttacggtacccggttacgttaacggtacccgtacggtcccggtaaggtccccgg

SEQ ID NO: 120579 - DNA, 597 bp, Homo sapiens
  misc_feature: GYAE6OF02FWCHI.2.38.D05.1.454.CMB.1.raw
  modified_base (347)..(347): a, c, t, g, unknown or other
  misc_feature (347)..(347): n is a, c, g, or t
  modified_base (529)..(529): a, c, t, g, unknown or other
  misc_feature (529)..(529): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggagtagcaacagctacgcggactccgtgaagggccattcaccatcctccagacgacaacgaccaagaaccacgctagtactcgtgacaaatgaaacngtctagagcgcgaggacacggctggtagtactttacgtgtgactaaggagtacgtagcgaagacagtaccgttgggtaccgaccgaacgtacggtcggggaccaacgggacccgtggtccaccgtcttaccgcacgtccctaccgaccgtaacgggccctacgtccggttcccgttccccgnggtacccgtcccgtcggtcctaccggacggcgacccaccgacgcgacgccacgacggtccggtcccgg

SEQ ID NO: 120580 - DNA, 627 bp, Homo sapiens
  misc_feature: GYAE6OF02I1139.2.38.D05.1.454.CMB.1.raw
  modified_base (224)..(224): a, c, t, g, unknown or other
  misc_feature (224)..(224): n is a, c, g, or t
  modified_base (333)..(333): a, c, t, g, unknown or other
  misc_feature (333)..(333): n is a, c, g, or t
  modified_base (436)..(436): a, c, t, g, unknown or other
  misc_feature (436)..(436): n is a, c, g, or t
  modified_base (456)..(456): a, c, t, g, unknown or other
  misc_feature (456)..(456): n is a, c, g, or t
tcagacgctcgacacacgaccggtgctcgatttagtatctgatagttggggtttgggggaagaggaagactgacggtcctgccacaggtggtgctgggcacggtgggcactcgacacaacatttgcgctcaactgtcttgtccagtgtgaggtgcagctggtggaggtccgggggaggcttagttcagcctggggggtccctgagactctcctgtgcagccctntggattcaccttcagtagctactggatgcacgtgggtccgccaagctaccgaggggaaggggctgggtgtgggtctcgacgttaattagtagtgagtgggagtagcaanaagcgtacgcggactccgtggaacggccgattccgaacctactcctaccgaagacgaaccaacgccaaagaaccgacgctgtactctagaacaaatcgaaacngtcagagacgccggaggacncggtcgtagttcgttaattccgtgtacgacggaaagaggaagttaacgcgaacgtcgacggcttacgggacccgtcccggtaaacgtacccgggttcgggggaacccctaacgggggaaccccttgggtccccgttaaccccgtccgtttcccctaccgacccggtccccg

SEQ ID NO: 120581 - DNA, 755 bp, Homo sapiens
  misc_feature: GYAE6OF02HMNW8.2.38.D05.1.454.CMB.1.raw
  modified_base (276)..(276): a, c, t, g, unknown or other
  misc_feature (276)..(276): n is a, c, g, or t
tcagacgctcgacacacgaccggtgctcgatttagtatctgatagttgggtttgggggagccccagcccctgggattcccagctgtttctgcttgctgatcaggactgcacacagagaactcaccatggagtttgggctgagctgggttttccttgttgctattttaaaggtgtccagtgtgaggtgcagcgtggtggaggtccggggaggcttagttcaggccgtgggggtccctggacgactctcctgtcgcacgcctgtaggcttccaccttnagtacgtctacgtggatcgactacgtcgggtccgaccaacgccgtaccggagggggaacgggtcgttgggtggttcgggtacctcgaacgttaagttaagtaggtagtagtaggggagtacgacaacgacgtacgtaccgcggtaacccgtcggtaggaaccgggtccgtaacttaccgacccgtattcccgtacccgaggaaccggtaaaccccaacggaacccgaaagaaccctacggcgtttagaccttggtacaacgtaaaagtcgaaacctaggtccgtaacggaagggaccgggaaccgaaacgggtaccgaccggggttacttaccggtttaaggtttaacctttacggaggttacccgggaaaagtaaacgggtaaaggcgttaaaccggaccggtaaacgtacccgaaccggggttaccgttaacccgggggtaaacccgtaccccggttaaccgggttaacccgggggg

SEQ ID NO: 120582 - DNA, 794 bp, Homo sapiens
  misc_feature: GYAE6OF02HTMYR.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctaattttaaaaggtgtccagtgtgaggtgcagctgggtggaggtccgggggaggtcttagttcaggccgtggggggtccctgagactctcctgtcgcagcctcgtggacttcaccttcagtacgctacgtggatcgccgtacgtcgggcccgaccgaagcccgtaccggaggggggaacggggtccgtgggtggtcggggttctccgtaacgttaagtttaatacgggtaggaggtggggtaagtaggaccgtaacgaacgcgtaaccggcggtaaccgtccggtaaggaaaccggggccgttaacgttcccaacccgtattaccccgtaccgaacggtaaaccgaaaccgaaacccgtacccggaaaaaggaaccctaacggtccttaaggtttaacgtaccgttaggaaaccgttaaaacgttacgaaaccgtttacggtcgtaacgggaaacggaccggtaaaccccggggaaaggtaaccggaacccgggtcgtttacgggttaaacgtttaacgtttaaccggttggtaaccggtaacgtaaaaggggacgttaacggtaacggaccggtaagaaccgtagggtaccccggttaggggtaaccccgaccggtaacccggttaaccggggg

SEQ ID NO: 120583 - DNA, 584 bp, Homo sapiens
  misc_feature: GYAE6OF02FN10M.2.38.D05.1.454.CMB.1.raw
  modified_base (241)..(241): a, c, t, g, unknown or other
  misc_feature (241)..(241): n is a, c, g, or t
  modified_base (324)..(324): a, c, t, g, unknown or other
  misc_feature (324)..(324): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatntgcttattggtaccagcagaagccaggccaggcccctgtcgctggtgatatataaagacagtgagaggccctgagggatcccngacgcgtattctctggctccgagctcgagggacaacgacgtcacgttcgaccatacgagtggacgtaccgaggacaagaagacgtaggacgcgttagaacttatttacgtacgtactaacgtacgaagcaagaccgaggactaaggttcggtttacgttttttggggtcggtttacgggacggggtaacgggtaacccgtaaggtccgttaacggtacccgttaccggttacgggtccacggtacccgtaacggtcccgg

SEQ ID NO: 120584 - DNA, 670 bp, Homo sapiens
  misc_feature: GYAE6OF02HJFAD.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgccagctccgagggagggctggtgtggtctcacgtattaatagtgatgggagtagcacagctacgcgactcgagaacggccgattcaccatctcagacgacaacgcaagaccacgctgtatctagactaaagtgaactagtctaggagacgcgaggacacggctggtagttattacgtggtacgacgtaaaggagtagtagcaaggacaggtccgtacgggtaacccggtacccgaaaccggttacgggtccgggggaacccgtaaccgggggtaacccgttccgggtaccctacccgtccgttaccctccgaccgtcccgtacccgaacccggaaccgggaccccttacgttcccggttaccccgttccccggcgtaccccgtccccttacggtcccgtacccgtagggaccctacccgacccgtaccggacgtaccggaccctaaccggaccggtccccggtaccccggg

SEQ ID NO: 120585 - DNA, 632 bp, Homo sapiens
  misc_feature: GYAE6OF02GLRPP.2.38.D05.1.454.CMB.1.raw
  modified_base (263)..(263): a, c, t, g, unknown or other
  misc_feature (263)..(263): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctctggattcaccttcagtagctactggatgcacgtgggtccnccaagctccgaggggaagggctggtgtgggtctcacgtattaatgtgagtgggatagcacaagctacgcggtactccgtagaacgggccattcaccatctccagacgacaacgccaaagaacacgctgtactcgtacgacaaagtcgaacagttacgtaggaagacgaccggaaacgggaccgacgggtacttggttagttaacgtttactaggtgaaccgaaaggtaagtaattaacgcaaggccgtaacggtaccggttacgggtaaccggacccggtaacgtaaccggttcggggggaacccgtaacggggtaacccccgtggttacccgaccccgttaccctccccgttaccgaccgtacccccg

SEQ ID NO: 120586 - DNA, 588 bp, Homo sapiens
  misc_feature: GYAE6OF02H2H6H.2.38.D05.1.454.CMB.1.raw
  modified_base (425)..(425): a, c, t, g, unknown or other
  misc_feature (425)..(425): n is a, c, g, or t
  modified_base (471)..(471): a, c, t, g, unknown or other
  misc_feature (471)..(471): n is a, c, g, or t
  modified_base (549)..(549): a, c, t, g, unknown or other
  misc_feature (549)..(549): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccggggaggcttagttcagccgtggggggtccctgagactctcctgtgcagcctctggattcacttcagttgctacgtggatgctacgtgggtcccgacctaacgcctccgtaagggggaacggggtccgttgggtagttgggggtctacggacgttaattaacgtagtgagtgggagtacgcacaagctacgacggactcgtgaagggccgattccaccagtcncctaagacgacaacgccaaaggaccagctagtactctagacaaatnaacagtctagagagccggaaggcctaacgggtctaggtacgttacgttactggtcgtacgaaggaagtagtacgacgnggacagaccgttcggtaacccgcccgtaacgttaccggg

SEQ ID NO: 120587 - DNA, 603 bp, Homo sapiens
  misc_feature: GYAE6OF02GWFZ1.2.38.D05.1.454.CMB.1.raw
  modified_base (219)..(219): a, c, t, g, unknown or other
  misc_feature (219)..(219): n is a, c, g, or t
  modified_base (414)..(414): a, c, t, g, unknown or other
  misc_feature (414)..(414): n is a, c, g, or t
  modified_base (494)..(494): a, c, t, g, unknown or other
  misc_feature (494)..(494): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctctatgagctgacacagccaccctcggtgtcagtcgtccccaggacagacggccaggatcacctgctcgnggagatgcattcgaccaaagcaatatgcttagtcggtaccagcagaacgccacggccaggcccctggtgcgtggtgactagtaagtaaagacgtaggtagaggacggtccctaggacgggtacctccgtaggacgtacgtactttcgtcgtcggtcctacgacgtcgtacgagggaacaacgagtacgtacgtanaaccgtatacgacggtaggtacgtacgacgggtacaaggtaacgagtggagtctagaacttcgtactgacgtaactcgancgaagacgtagcgtaaggtagtttggttttagggtggttaccgggacgggaacggtacgaacggtcgtacggtaccggttcgtacggtcgaaccgtccggaaggtcccg

SEQ ID NO: 120588 - DNA, 638 bp, Homo sapiens
  misc_feature: GYAE6OF02I8V9A.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttcttgttgctattttaaaaggtgtccagtgtgaggtgcagctggtggagtccgggggaggcttagtcagcctgggggtccctgagactctcctgtgcagcctctggattccacctttcagtagctacgtggatgctacgtcgggtccgccaagccgtcccgagggggaaggggtccgtggggtacggtggggttctcgtaacggttaatttaaagttacgttaggagttgggggacttaggactaacgaaggccgtaaccggcggaccttaccgggtaggtaaacgggcccgtattccgaacctatcctaccgagaacggaaccgaaacgaccaaacgaacacgacctgtactctcgactaaagtacgaacagttcagagacgccggaaggaccgacggtcgtggttagttacttacgttcgtagacgaagtaagaacgttagaccgaaggctagggccgttaacgggccgtaaccggaccgtacgggg

SEQ ID NO: 120589 - DNA, 739 bp, Homo sapiens
  misc_feature: GYAE6OF02GN4S8.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgacggcctcctatgagctgacacagcccacccgtcggtgtcagtcgtccccgaggacagaccggccaggactccaccgtgcctcgtggagatcgactattcgaccaaagcaaattatcgtacttagttcggtaaccagacaagacgccgacggccacggtcccctaggtcgtcgtggtagaattaagtaaagtaaacgacaggtacgacggaccggtcccctagggacggtaacctcccgtaggacgtaccgtactttcgtaccgtcgcccttaccgagtccgtacggaacggtaactaaccgtacggttacccgtaacggttaccgaacctacgtacggtacgggtacgggtaccgtaccggaacggtaacgaaacggaaaggtacggtacgggtaccggtacgttacgttaaaccgtttacgttacgtacgttaacaacgttacgacgaaccgaacgtacgtacgtacggttacgggtttagggttttacggtttttgggtccgggttaccgggtaacgggaccggtaaccgtacggttccggttacgtaccggttccggtacggacccgtaccggtacccgtacggtaccccg

SEQ ID NO: 120590 - DNA, 607 bp, Homo sapiens
  misc_feature: GYAE6OF02FRYIM.2.38.D05.1.454.CMB.1.raw
  modified_base (400)..(400): a, c, t, g, unknown or other
  misc_feature (400)..(400): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggatcacctgctctggagatgcattgaccaaagcaatatgacttagttggtaccagcaagaacgccaggccacggcccctgtgcgtggtgatatataaagacagtgagacggccctcgacgggtactcccgtaggacgcgtactttctacgtcggctccagctcgaggtacaacgtcgtactcggttcaaccgntcgagtggacgtccgaggacgaggaagtaggtggacggtactacggtaacttattacgtagtaacaagttcgactacgaacgtacgacgagtacggtttacggtttcggtttttgggtcggttcggggtaacggtaccggggtactaacggtacgttaccgggtaccgttccggtaaggttaccgaaccggtaccgaacggtccccg

SEQ ID NO: 120591 - DNA, 671 bp, Homo sapiens
  misc_feature: GYAE6OF02G2YFR.2.38.D05.1.454.CMB.1.raw
  modified_base (290)..(290): a, c, t, g, unknown or other
  misc_feature (290)..(290): n is a, c, g, or t
tcagacgctcgacacacgaccggtgctcgatttagtatctgatagttgggtttgggggtgggtccaggaggcagaactctgggtgtctcaccatggcctggatccctctacttctcccccctcttcactctctgcacaggctctgaggcctcctatgagctgacacagcccaccctcggtgtcagtgtccccaggacagacggccaggatcacctgctctggagatgcattgaccaaagcaatatgcttattggtaccagcagaagccaggccaggcccctgtgctggtnatatataagacagtgagcggccctcgagggctcccgtgacgacgtattcgtcgtcggcttcagtcctacgacgggaaccaaccgtagtaccgtacgttcgaacctagtcgtaacgggtcggtaacggtcccgaagggaccaaagggaaacgaggttacgggaaggtccgttacggaaactttaactttaaccgtcgttaaccaaacgttcgaagaccgtaacggaacgtacggtaacgtagggttttacgggtttaacggtttttttgggggtacggttttaccgggggacgggttaacggggaacctaaccggtccggttacggttaaccccggttcgttaaccgggtcccgaaccggtacccggtaacggttcccccgg

SEQ ID NO: 120592 - DNA, 684 bp, Homo sapiens
  misc_feature: GYAE6OF02HVNLG.2.38.D05.1.454.CMB.1.raw
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
  modified_base (519)..(519): a, c, t, g, unknown or other
  misc_feature (519)..(519): n is a, c, g, or t
  modified_base (526)..(526): a, c, t, g, unknown or other
  misc_feature (526)..(526): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccggggggaggctttagtcagccgtggggggtccctggagactctcctgtgcacgtcctcgtgggtacttccaccctttcgaaggttacgcctaacgtgggtatgctacgtggggtccccgccaaagtcctccgagggggaacggggcgttggggtgtcggggttctcgacgtattaataggtgagtgggagtacgcaacgaagcgtacggcggacctccggtaggaaacggggcccgatttaccacccgtatcctacccaggaacgaccaaacgaccaaagaaccgagcctaggtactcngtaacaaacttagaaactgtacnggacgacggaccgaaggaccgacggtntgggttntaacttagtggtacgacgaaagtacgtaagtacgacgacgtcgaacgggtcccgttaagggtcccgtaccggtaacgttaccggggcgggaacccggtaacgggttaccccgtcgggtaccctacccggttccttacccgtaccgtaccggtcccccg

SEQ ID NO: 120593 - DNA, 729 bp, Homo sapiens
  misc_feature: GYAE6OF02J2IV1.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgagcctctatgagctgacacagccaccctcggtgtcagtcgtccccagacagacggcaggactccacctgctcgtggagtatcgctattcgaccaaagcaatatgtacttagttacggaccagtacgaagacgccgacggccacgggtcccctggcgtcggtgtacgaacttattaaagaaacgacgtaggtacgaggaccgtaccctacggtacgggtacctacccgtggaacgtacgttcgttccgtcgtcggtcccgtacgaacggtccgtacggaacgggtaacctaaacgtacggtacgtaccggttacaccgtacgtacggacggtacggtacgtaccggacggtacaaacgacggtacggtacgtaccggtctaacgtaaccttacggttagttcgtaaaccgtacgtcgtaacggtaacaacggttacaaaccgttacggtacggtttacgggttttacggttttcggggttacgggtttacccggggcgggttaaacggtaccgtaacgggttacccgaccgggttaacccggttcgtaaaccggtcccgaaacccgggtacccaccgggttccccgg

SEQ ID NO: 120594 - DNA, 579 bp, Homo sapiens
  misc_feature: GYAE6OF02GE1SE.2.38.D05.1.454.CMB.1.raw
  modified_base (373)..(373): a, c, t, g, unknown or other
  misc_feature (373)..(373): n is a, c, g, or t
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctgggtgtgggtctcgacgtattaatagtgatgggagtagcacaagctacgcggactccgtgaacgggccattccaccatctccagagacaacgccaaagaaccacgctgtatctagacaaatgaacagtctaggagagccgaggaccaggctgtntacttactgtgacaaggagatagcagcgacgcgtagggtaccgaccgacgtacggcggggtaccgacgggtaccctggtccgtaccgtcctacctcgacgccctacccgaccgacgggcccagtcccggtccttccccgnggcccncccgtcgcctcccgaggaccgccgaccgtccgacgacgaccaccgacggcccggtcccgg

SEQ ID NO: 120595 - DNA, 620 bp, Homo sapiens
  misc_feature: GYAE6OF02FI2SD.2.38.D05.1.454.CMB.1.raw
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (409)..(409): a, c, t, g, unknown or other
  misc_feature (409)..(409): n is a, c, g, or t
tcagacgctcgacacacgaccggtgctcgatttagtatctgataggttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctctggattccaccttcagtagctactggatgcacgtcgggtccgccaagcctcgaggggaagggctgggtgtgggtctcacgttaattaatagtgagtgggagtagcanaagctacgcgactcgngacggccgattcacntcacagacgacaacgcaaagacacgctagtatcagacaaatcgaaacngtcagagacgaccggaggaccagggtctgtagttacttacgtgtacgacaaaggactagtacgactaggacctaacggtccgttacggggacccgtacccgggtaaacgttaccggggtaccgggggggaaccccgtaaacgggggtaaccccccgtttgggtacccccgtaacccggtttcccgtaccccgtaccgacccggtacccccc

SEQ ID NO: 120596 - DNA, 627 bp, Homo sapiens
  misc_feature: GYAE6OF02IQ05D.2.38.D05.1.454.CMB.1.raw
  modified_base (275)..(275): a, c, t, g, unknown or other
  misc_feature (275)..(275): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (477)..(477): a, c, t, g, unknown or other
  misc_feature (477)..(477): n is a, c, g, or t
  modified_base (518)..(518): a, c, t, g, unknown or other
  misc_feature (518)..(518): n is a, c, g, or t
  modified_base (541)..(541): a, c, t, g, unknown or other
  misc_feature (541)..(541): n is a, c, g, or t
  modified_base (561)..(561): a, c, t, g, unknown or other
  misc_feature (561)..(561): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcttgggttttccttgttgcttattttaaaaggtgtccagtgtgaggtgcagctggtggaggtccgggggaggcttaggttcagccgtggggggtccctgagactctcctgtgcagcctcgtggattccaccttnagtagtctactggatgcacgtcgggcccaccgaagcctacggaggggagggctgggtggtggtctcgacgttattaagtgtgagtgggagtagcaacagctacggcgacgtcgaggaacggcctactacacctagtcctacgaagacgaaccaacgaccaaagaaccncgtnttagtactcgtagactaaaagtcgaaacgngttacgaggacgacgacccggggaaaggaccctacggggtnttaaggttcttaagttttaccgnggtaacgaacggtaaaggtntaaacggtacgacgtacgacggaacggtccggtttaaccgggaaccggccccgtaacgtacggggg

SEQ ID NO: 120597 - DNA, 627 bp, Homo sapiens
  misc_feature: GYAE6OF02IICD0.2.38.D05.1.454.CMB.1.raw
tcagacgctcgacacacgaccggtgctcgatttagtatctgatagttgggtttgggggtggtccaggaggcagaactctgggtgtctcaccatggcctggatccctctacttctccccctcttcactctctgcacaggctctgaggcctcctatgagctgacacagcccaccctcggtgtcagtcgtccccaggacagacggccaggatccacctgctcgtggagtatgctattcgaccaaaagctaaatactgtctttagttaggtaccagacaagaacgccgaggccacggccccctgtcgcgtggtagtattaataataaagactaggtagacggacgggtccctacgaacggggtactcccgtaggacgacgtactttccgttcgtcgggtccctaccgtaacgtctaccggaacggtaaccaaacgtacgtaccgtacgtttacgaactacgtacgtaggtacggtacgtaccgaggtaacgaagaaggagttaggacggtacgtagttacttatacgttcgtaactagtcagacagtacagcgtagttgtttacgtttgggtcgttgggcggtacggactagtcgtcggtaccgtcgtcgtaccgacgtcccgaggtcccg

SEQ ID NO: 120598 - DNA, 643 bp, Homo sapiens
  misc_feature: GYAE6OF02JWFC6.2.38.D05.1.454.CMB.1.raw
  modified_base (171)..(171): a, c, t, g, unknown or other
  misc_feature (171)..(171): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (344)..(344): a, c, t, g, unknown or other
  misc_feature (344)..(344): n is a, c, g, or t
  modified_base (537)..(537): a, c, t, g, unknown or other
  misc_feature (537)..(537): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggtttccttgttgctattttaaaggtntccagtgtgaggtgcagctggtggaggtccgggggaggtcttagttcagccgtggggggtccctgagctctctgtgcagcctntggattcacctcagtanctactggatgctacgtgggtcccacgaacgcctaccgagggaagggctggtggtgggtctcgacttagttaangtgagtggacgtagctaacagcgtacggccggactccgggaggaacgggacccgtattaccaccgtactacgtccctaaggaacgaacccgaaacggaccaaacggaaacctacggtcttacgtacttcgtacggaacctaaaaggtccgaaactacgggtactagggaacgtacgggacccgaagggaaccncgggtacttgggtacttaggttaccaggttgaccgtaaaggagtaacgtcgaacgtcggacctaaggggcccttacgggtaaccctacccgggtaacttccggggg

SEQ ID NO: 120599 - DNA, 619 bp, Homo sapiens
  misc_feature: GYAE6OF02FGR3Y.2.38.D05.1.454.CMB.1.raw
  modified_base (262)..(262): a, c, t, g, unknown or other
  misc_feature (262)..(262): n is a, c, g, or t
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
tcagacgctcgacacacgaccggtgctcgatttagtatctgatagttgggtttgggggaagaggaagactgacggtcctgccacaggtggtgctgggcacggtgggcactcgacacaacattttgcgctcaactgtcttgtccagtgtgaggtgcagctggtggagtccgggggaggcttagttcagcctggggggtccctgagactctcctgtgcagcctctggattcacctttcagtagctactggatgcacgtggtccnccaagctccgagggaacgggctggtgtgggtctcacgttaattaagtagtgagttgggatagcacgaagcgacgcggactcgnggacggccattccacatcncaganacaacgccaanacacgctagtatcagacaaatgaaactggttctaggaacgacggaccgacgggaactcgggaccgttgtacgttaacttacgtaggtacgacgaaagtagtaacgtaacgccaggtacacggttcgttaccgggaaccgccgggttaaaccgtacggtaaccgggggacccgtaaaccgggacccccgttagggttcccctaacccgggtccctttaccgtacccggaccttacccccg

SEQ ID NO: 120600 - DNA, 749 bp, Homo sapiens
  misc_feature: GYAE6OF02IDCX2.2.38.D05.1.454.CMB.1.raw
  modified_base (166)..(166): a, c, t, g, unknown or other
  misc_feature (166)..(166): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacngcccacccgtcggtgtcagtcgtccccaggacaggaccggccaggactcacctgctcgtgggagtatgctattcgaccaaagctaatatgtactttagttcggtaccagacgagaacgccgacgccgacggcccctgtgcgtggtagtaataataataaagacgaggtcgaacggacggcccgtacggaacggtcctcccgtggaacggtcgttatttccgtcgtccggccttaccgacggtacgtacgaacgggaaccaaacgtacggttaccgtaacgtttacgaaccttacgtaccggtaagggtacggtaaccgtccgaacggggactaaagggaacgtagttacgggaacggtcttaacggtaacttacgttaaccgtcgttaaactaacgtaccgaagaccgaacgaacgtacgtacggtacgggttttacggttttaacggttttcgggggttaacgggtttccggggaacggggtaaccgggtaaccgtaacgggtttaccggtacccggttaacccggttacggttaacccgggtacccgtaacccgggtaccccggtaacgggttccccccgg

SEQ ID NO: 120601 - DNA, 809 bp, Homo sapiens
  misc_feature: GYAE6OF02I0YE2.2.38.D05.1.454.CMB.1.raw
  modified_base (728)..(728): a, c, t, g, unknown or other
  misc_feature (728)..(728): n is a, c, g, or t
tcagacgctcgacacacgaccggtgctcgatttagtatctgatagttgggtttgggggagccccagccctgggattcccagctgtttctgcttgctgatcaggactgcacacagagaactcaccatgggagtttgggctgagcgttgggttttccttgttgctattttaaaaggtgtccagtgtgaggtgcagctggtggaggtccgggggaggtcttagttcaggccgtggggggtccctggagactctcctgtgcacgcctctggacttccaccttcagtagcttacgtggatcgcaccggtcggggtcccgacccgaaacgtccgtaccggaagggggtaacggggtccggttggggttgggttcggggttcctaccgtaaacgtttaatttaaacgtaggttaggtaaggttagggggtaagttaacgaccgaaacgtaacggtaccggttaaccggaccggtaccgttacccggggtagggaaaccggggtaccccgtaacgttacccgaaccctaacgtttcccctaacccggaaggaaacccggaaacccctaaacccgggaacccgtaaaaacggaaacccgacccggtaccgtttaggttaaccttacgtagaaacctaaaagttacgaaaccgtaggttacctagggaaccgtaccgggacccgggtaaagggtacccgaaccgggtccttagggttaacgtttaacgtttaacccgnggttacgaacggtaaaggtacggtaatacggacaaggtcgacggtccggtaaccggtacccggacccgtacggtaacgggg

SEQ ID NO: 120602 - DNA, 632 bp, Homo sapiens
  misc_feature: GYAE6OF02GOK33.2.38.D05.1.454.CMB.1.raw
  modified_base (293)..(293): a, c, t, g, unknown or other
  misc_feature (293)..(293): n is a, c, g, or t
  modified_base (335)..(335): a, c, t, g, unknown or other
  misc_feature (335)..(335): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
tcagacgctcgacacacgaccggtgctcgatttagtatctgatagctaggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccgccaagcctccgaggggaagggctggtgtgggtctcacgttattaatagtgagtgggagtagcacagctacgcgactcgagaaggcatcacatcncagagacacgccaagaccacgctagtactctgacaatgaacngtcagagacgccgaggaccgacggtntagtagtacttacnggtacgacgaaaggtacgaagtagacgaggctacggaccgttacggtaccgacccggtaaccgtacggtaccggggaccgaacgggtaaccccgtcggtacccgtccgtccttcccgtaccggtacgccctacccgaacccgaacggtccccgtacgttcccggtcccttccccgcggtcccgtcccgtccgtccgtaccgacggccgtacccgaccgtaccggacgtaccgaccgtacgaccggtcccggtcccgg

SEQ ID NO: 120603 - DNA, 716 bp, Homo sapiens
  misc_feature: GYAE6OF02ITZ4W.2.38.D05.1.454.CMB.1.raw
  modified_base (267)..(267): a, c, t, g, unknown or other
  misc_feature (267)..(267): n is a, c, g, or t
  modified_base (629)..(629): a, c, t, g, unknown or other
  misc_feature (629)..(629): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgcttattttaaaggtgtccagtgtgaggtgcagctggtggaggtccgggggaggtcttagttcaggccgtcgggggtccctgacgactctccgtgtcgcagcctcgtggntttccaccttcgagtacgtctacgtggatgctacgtcgggtccgccacgtccgtccgaggggaagggtctggtggtcggtctacgacgttattaagtagtggagtggtaagtacgacaacgacgacgtacggacggtacgtccggtaggaacgggacccgtagttaccgaccctacgtcccgtaccgaaaggacgaacccgaacgacccgtaaacggaaaccaccgtacgttacgttaacgttccgtaaggtaacccaaagttacggtaaaccgtaacggttccgaaaggtaaccggaccgggaacccggtaagggacccgttaacgggccgtttaggttaacggttaacgttttacccggnggttaacgaaccggtaaggtaacgggtataacggacgacgtacggcggtaccggttacgggacccggtacggtaccggttaacgggg

SEQ ID NO: 120604 - DNA, 768 bp, Homo sapiens
  misc_feature: GYAE6OF02IDLLQ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacacgcccacccgtcggtgtcagtcgtccccaggacagacggccaggactcacctgctcgtgggagtatcggactacgttcgaccgaaagactaattatcgttactttagttacggtaaccagacgaaggaacgccgaacgggccgaaccgggtccccttggtcgtccgttagggttacgtaaacgtttaaagtaaaacgttaaaacggaaccgtaaggttaacgggaacgggtaccggtccccgttaacgggaacggggtaccttccccggtaggaacggtaccgttagtttccgtcgtcggtaccctaccgtacgtaccgtacgaaacgggaacctaacgcggttacctaacgtttacgaaccttagtcgtaacgggtcggaacgtcccgaagggacgaaaggaagtacggtaggacgtacgtaacgttaacttaagtttacgacggttaaccaagttccgaagacgaacgtaacgcggtacgttacgggttttagggttttacgttttggggtacggttaccgggaagggtaaccggacgtaacggtttccgaacggttcccgttacggtaacggaccgttacccggaccgtacggtccccgg

SEQ ID NO: 120605 - DNA, 599 bp, Homo sapiens
  misc_feature: GYAE6OF02G3WFZ.2.38.D05.1.454.CMB.1.raw
  modified_base (261)..(261): a, c, t, g, unknown or other
  misc_feature (261)..(261): n is a, c, g, or t
  modified_base (460)..(460): a, c, t, g, unknown or other
  misc_feature (460)..(460): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagcctggggggtccctgagactctcctgtgcagcctctggattccaccttcagtagctactggatgcactgggtccncaagctccgagggaggggctggtgtgggtctcacggttattaagtagtgagtgggagtagcacaagctacgcggtactccgtaggaacggccattccacctatctacagacaacaacgccaaagaccacgctgtatctagactaaatcgaactagtctgaagacgccggaagaccacgggcttaggttagtatttacgnggtacgacgtaaagacgtaatacgcaagctaggccgtacgggttaccgacccggtaagttccgggtacggggaacccctaacgggggtaaccccttgggtacccgtaccgttccccgtacctaccgacccgtacccccg

SEQ ID NO: 120606 - DNA, 684 bp, Homo sapiens
  misc_feature: GYAE6OF02JEM8R.2.38.D05.1.454.CMB.1.raw
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
tcagacgctcgacacacgaccggtgctcgatttagtatctgatagttgggtttgggggtaggccccagccctgggattcccagctgtttctgcttgctgatcaggactgcacacagagaactcaccatggagtttgggctgagctgggttttccttgttgctattttaaaggtgtccagtgtgaggtgnagcgtggtggnggtccgggggaggtcttagttcgagccgtggggggtccctggacgctctcctgtgcgacgcgtctggacttcgaccttcagtagctactggatcgcgtacgtcggggtcccgccaacgcctaccggaaggggacggggctggggtgtcgggtctacgtacgttattaagtgtaggacgttagggagttagacgaacgaaggtaccgtacggaccgggtaccgttaccgggtaagggaaaccgggggtcccttaacggtttccaaacccgtagttaccctaccgaaggtaacgaaaccgaaccgtaaccgaaaacgtaacgacctccgtagttaacctcgtagaacctaaaggtacaaacgtcgttaagtcgaacgtacggacccgaggaccgtacggtgttacggtattacgttaacgtgtagacgtaagacgtaggtaacgagtaccggagcgttaacggccggtacgaccggattaccgggg

SEQ ID NO: 120607 - DNA, 632 bp, Homo sapiens
  misc_feature: GYAE6OF02HEIY8.2.38.D05.1.454.CMB.1.raw
  modified_base (262)..(262): a, c, t, g, unknown or other
  misc_feature (262)..(262): n is a, c, g, or t
  modified_base (371)..(371): a, c, t, g, unknown or other
  misc_feature (371)..(371): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtacgctactggatgcacgtgggtccnccaagctaccgagggaaggggctggtgtgggtctcgacgttataatagtgagtgggagtagcacaagctacggcggacctcgtggaacggccgattcacatctccaganacaacgcaaagaacgacgctgtactctagacaaatacgaacagtctagagacgaccggaggaacacggcttgtagttaacgttactggttacgacgtaaaggagtaagttacggaccgtaaggaacgacgtaggttacccggtaaccggtacccgggtaaccgttaaccggggtacgggggtacccggaaaccgggggtaacccgttacccgggtaccgtaaaccccgggtttcccctacccgtacggcccttacccccgg

SEQ ID NO: 120608 - DNA, 598 bp, Homo sapiens
  misc_feature: GYAE6OF02HIZCQ.2.38.D05.1.454.CMB.1.raw
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
  modified_base (379)..(379): a, c, t, g, unknown or other
  misc_feature (379)..(379): n is a, c, g, or t
  modified_base (469)..(469): a, c, t, g, unknown or other
  misc_feature (469)..(469): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccgaggggaagggctggtgtgggtctcacgttattaatagtgagtgggagtagcacaagctacgcgactccgtgaaggccgattcaccatctccagacgacaacgccaaagaacncgctgtactctgacaatcgaacngtcagagacgccgaggacacggctgtagtaattcgngtgacgaagagagtagcacgcgacgcgtaggtaccgccgtacgtcgtcggggaccgacgggtaacccgtcggtacgtacccgtccgtccncgaccgccctaccgaaccgtaccggccctacgtcccgtcccgtaccccgtggccccgtccgtccgcctacccgagggccacccgtacccgtaccggacgtaccgaccgaccgaccggtcccggtcccgg

SEQ ID NO: 120609 - DNA, 609 bp, Homo sapiens
  misc_feature: GYAE6OF02G1M3H.2.38.D05.1.454.CMB.1.raw
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctcgtggattcaccttcagtagctactggatgcactgggtccgccaagcctccgaggggacgggtctgggtgtgggtctcgacgttattaagtagtgagtgggatagcanagcacgcgactcgngacggcatcacatcncagacacaacgccaagacncgactgtactcgtagactaaatcgaacnggtacnggaacgacgccggtaaggacctaacgggcttggtactttacgttacgtggtacgaccgaaaggtacgtagtaacgccgaagaccgtagtaccgttacgggacccgtaccggtaacgttaccgggcgggggaacccgtaacggggtacccccgtcggttacccgaccccggttcctacccgttacgaccgtacccccg

SEQ ID NO: 120610 - DNA, 695 bp, Homo sapiens
  misc_feature: GYAE6OF02IO4O5.2.38.D05.1.454.CMB.1.raw
  modified_base (544)..(544): a, c, t, g, unknown or other
  misc_feature (544)..(544): n is a, c, g, or t
  modified_base (569)..(569): a, c, t, g, unknown or other
  misc_feature (569)..(569): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcttgggttttccttgttgcttaatttttaaaaggtgtccagtgtgaggtgcagcgtggtggaggtccgggggaggcttagttcaggccgtgggggtccctgagactctcctgtcgcacgtcctcgtggactttcctacctttcgaagttacgtactaacgtggatcgctacgttcgggtacccgcccgaaacggcccgtaccggaaggggggaacggggccgttggggtcgggttcggggttccttacgtaacggttaatttaaagttaggtggtaagtggggaggttacgaccgaacgaacgtccgtaacggccggtaaccgttaccggtaggaacgggaccgtattaccacgtacttcaccgaaagacgaaccaacggaccaaagaccacgtctagttacncgtagaactaaagtcgaactggttnagggagaccgccgaaggtaccgacgtcgttagttacgttaagtttcgtaggtacaacggtaagacgtagttaacgcgtaagaccgtagtcggttaaccgggaccgtacccggtaagtacccggggg

SEQ ID NO: 120611 - DNA, 666 bp, Homo sapiens
  misc_feature: GYAE6OF02GS213.2.38.D05.1.454.CMB.1.raw
  modified_base (288)..(288): a, c, t, g, unknown or other
  misc_feature (288)..(288): n is a, c, g, or t
  modified_base (382)..(382): a, c, t, g, unknown or other
  misc_feature (382)..(382): n is a, c, g, or t
  modified_base (488)..(488): a, c, t, g, unknown or other
  misc_feature (488)..(488): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagtcagccgtgggggtccctgagactctcctgtgcagcctctggtattccaccttcagtagctacgtggatgcncgtcggtccgaccaacgccgtccgaggggacggggcgtgggtggtgggtctacgacgttaattaacgtagtgtaggtagggagtacgaccgaanaacgcgtacggaccggtacgtccggtaggaacgggccgtaacgttaccaaccgtacgtccgtacccaaagggaaacctacgaaaacccgtacccgaaaagaaaccncggtaccttaggttacttcgtacgaactaaatcggaaactgttcaggaacggccggaaccgggaaggacccgtacgggtcttaagggttcgttaacttcgtaggtacggaactaaggtagagtaacgagtacggacagggttccgaacgggttcccgaccgtaacggttaccccgggg

SEQ ID NO: 120612 - DNA, 924 bp, Homo sapiens
  misc_feature: GYAE6OF02HZHB7.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagcttgggttttccttgttgcttaattttaaaaggtgtccagtgtgaggtgcagctggtggaggtccgggggaggctttagttcaggccgtcggggggtccctgagactctcctgtgcacgcctctggtacttcctaccttcgaagtagccttaacgtggtatcgccgtaacggtcgggtaccccgaccgaaacggtccgttacccggaaggggggtaacggggtcgttaggggttcggttcggggttaccgttaccgttaaaccggtttaaagttttaaacggtaaggtttacggtaaggttagggggtaaggttaacggaccgtaaaccgtaacgtaccggttaaaccgggaccgggtaaccggttaccgggtaacggggtaaaccggggtcccgttaacgtttacccgaaccctaacgtttcccttaacccgaaacggtaaccgaaaccccgtaaaccggaaacccgtaaaacggaaaccccgtaaccgggtcttaacggttaacttaccggtaaggtaaacccaaaagtttaccggaaaacctacggtttccggaaagggtaacggtaccggggaacccggtaaagggggaaccctaccgggggttctttaaacgggtttaacgtttaaccgttttaaccgggtaggttaaccggtaacgtaaaagggtaaacggttaacggaaaaccgggtccgtaaaacgggtaccggtaacgggttacccgggttaaccggggttaaaccccgggtaccccgggtaaaccggtttaaccccggggggg

SEQ ID NO: 120613 - DNA, 886 bp, Homo sapiens
  misc_feature: GYAE6OF02F3RMI.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattccaccttcgagtagctacgtggatgctacgtcgggtcccgaccaacgtccgtacggaaggggaacggggtcgttgggttggtcggggttactacgtacgttaattaagttgtgaggtagggtagtacgacaacgagtccgtacggaccggtacgttccggtaagggacgggcctatacccaacctagttcccgtaccggaaggaaccgaaccgaaccggacccgaaaaggaaccctacggtactttaggtaaccttcgtaacgaaccctaaagttaccgaaacgttccggtacgaggaaacggtccggaccgggaaggtaccgtacgggttactggtttaacgttaacctttacggtacggtacggaacctaaagggtacgtaacgtaacgtaccgtacgggtacggtaccggtaccggttaccgggaacccggtaacccggttaacccggtaacggtacccgggggtacccggtaaccccgggttaaaccggttccggtaaccccgttacccggtttccgttaaccgacccgtaccggtaccccgttacccgaaacccgggtaaccccggtcccgttaccggttaccccggtttaccccgttccccgggtaccggtccccgttaaccccggtcgttccccgggtaacggaccggtacccgaccccgttacccggtaccggtacggacccgtacggacccggtcgaccccgggttaccggg

SEQ ID NO: 120614 - DNA, 750 bp, Homo sapiens
  misc_feature: GYAE6OF02IXBPC.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagcctggggggtcccctgagactctcctgtgcagcctctggattcacttcagtagctactggatcgcacgtcgggtccgaccaagctccgaggggaagggctggtgtgggtctctacgtattatagtgagtgggagtagcacgaacgacgtacggccggacgtcccggtaggaaccggggcccgtaattccgaccgtactctaccgaaggtacgaaccgaacgtacccgaaagaaccaccgtaccttggttaactcgttacgaacctaaaagttaggaaacctggtacgttaggaacgaccggaccggaacggtaccgaggtaccgtttgttaacggtaagtttaccctagggtacgaacaaaggagtaacgtaagtacgcggacctaggcgtacgggtacccgaccgtaccgtaaccggtacggggtacccgaaccgggtacccgttagggtccgtacccgtacctcccgtagacccgtccgtaacccgtacccggtaacggacccttggttaccccgtcccgtttcccgacccggtccgtaccctccgggtcccttaccggacggtacccgaccgttcccggacccggacggaccgtacccggacctaccgggaccccgtcccggg

SEQ ID NO: 120615 - DNA, 659 bp, Homo sapiens
  misc_feature: GYAE6OF02HK3KL.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctatttaaaggtgtccagtgtgaggtgcagctggtggaggtccgggggaggcttagttcagccgtgggggtccctgagactctcctgtgcagcctctggattcaccttcagtagctacgtggatgctacgtcgggtcccgaccaacgcctaccgaggggaacggggcgtggggtggtcgggtactacgtaacgttaagtttaacgtaggtaggagtaggggaagtagacgacgaaacggcgtacggacggaccgttaccggtaggaacgggaccgtactttaccaacctagtccctaccgaaggacgaaccgaacgaccaaacgaaccacggcctaggtacttacgtacgaactaaagtgaaacgtgttacgtaggaagacgggaccgaacggacgaccggtagttggttagttaattaccggtgttacgacgtaaaggacgtagtaaggcccgaagccgtacggccggtttacgggacccgtaccggtacgtaaccgggg

SEQ ID NO: 120616 - DNA, 601 bp, Homo sapiens
  misc_feature: GYAE6OF02GS6DR.2.38.D05.1.454.CMB.1.raw
  modified_base (263)..(263): a, c, t, g, unknown or other
  misc_feature (263)..(263): n is a, c, g, or t
  modified_base (532)..(532): a, c, t, g, unknown or other
  misc_feature (532)..(532): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctcgtggattcaccttcagtagctactggatgcacgtgggtccnccaagcctccgaagggaagggctgggtgtcgggtctcgacgttaattaataggtgagtgggatagcacgaagctacggcggactccggtagacggccgtatccaccatcctaccgaagacgaaccaacgaccaaagaacacgctagtatccgtagactaaaatcggaaacctgtctaggaacgacgaccggaggtacgacgggtctagttcggttaattcgtggtacgactaaggaacgtaatagacacggcacggtctagggtacccnccggtaacgtccgggtcgggacccgtaagggtacccgtggtacctccgtctaccctacgaccgtccccg

SEQ ID NO: 120617 - DNA, 601 bp, Homo sapiens
  misc_feature: GYAE6OF02G0SHC.2.38.D05.1.454.CMB.1.raw
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagacctctcctgtgcagcctcgtggtacttccaccttcagtagctactggatgcacgtcgggtccgccaagctccgaagggaagggctgggtgtggtctcgaacgtattaatagtgagtgggatagcaacaagctacgcggactccgtagaacggccgatccacatcacagacacaacgacaaagaacncgntagtatctanacaaaagtcgaaacagtcgaggaacgcgaccgaggacctcggattagtatttaacgttacgtgtaaggaactaaagagtaaactagggacaaggacaacggtacgtacgacccggaccggtaacgtaccggacgggggaaccctaacgggaaccccgtcgtacccgacccggtttccacccgtacgccgtaaccccg

SEQ ID NO: 120618 - DNA, 554 bp, Homo sapiens
  misc_feature: GYAE6OF02G8CQT.2.38.D05.1.454.CMB.1.raw
  modified_base (463)..(463): a, c, t, g, unknown or other
  misc_feature (463)..(463): n is a, c, g, or t
  modified_base (492)..(492): a, c, t, g, unknown or other
  misc_feature (492)..(492): n is a, c, g, or t
  modified_base (508)..(508): a, c, t, g, unknown or other
  misc_feature (508)..(508): n is a, c, g, or t
  modified_base (521)..(521): a, c, t, g, unknown or other
  misc_feature (521)..(521): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtgggtccgccaagcctccgaggggagggcgtgggtggtgggtctcgacgttattaacgtagtgagtgggagtagacaacaagctacgcggacctccggtaggaacgggccgtattccacctagtcctcccagacgaccaacgaccaaagaaccacgctagtatctagacaaagngaactgtcaggacgagccgaggccacgtntacgtagtattactgngacgaaggagtangcagacagtcgtacggacccgacgacgtacggg

SEQ ID NO: 120619 - DNA, 706 bp, Homo sapiens
  misc_feature: GYAE6OF02JEN3C.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctggacggcctcctatgagctgacacagcccaccctcggtgtcagtcgtccccgaggaccaggaccggccgaggactccaccgttcgcttcgtgggacgtatcgactagttcgaccgaaaggcaaattatgtactttagttacggtaaccagacgaagaacggccgacggcccgaaccgggcccctgtggcgtagggtacaattaataaagtaaacggaacgaggttaggaacggacgggccccgtacggaacggggtacctcccggtagacggtacgtactttccgtcgtggtccctcgacgcctacgacgggaccaaacgtgtccgtacgttacgacctacgtagtacggtaggtcgtaccgaggtacgaaggaagacgtaggacgtacgtacgtaacttaacttacgtacgtactactacgagagaacgacgacgtacgtaggtttcggttttacggtttgggttacggtacggggtacgggtaaccggtaacgtacggttacggtaccggtaccggttcggttaccggtaccggaacccgtacccggtacggtaccccgg

SEQ ID NO: 120620 - DNA, 531 bp, Homo sapiens
  misc_feature: GYAE6OF02H1UZ1.2.38.D05.1.454.CMB.1.raw
  modified_base (464)..(464): a, c, t, g, unknown or other
  misc_feature (464)..(464): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagagccaggccaggcccctgtgctggtgatatataaagacagtgagacggccctgagggactcccgtgagcgatttctctggctccagctcgaggacaacagtctacgttgaccatcgagtggagtcgagcagaagatgaggctgaacttatacttgtacaatcagacagacagcagttgtttacgttttgggtggttaccgggngggtaacgggtaccaaggtccgtacggtacccgttccggttaggtaccgacgtacccggaggtcccg

SEQ ID NO: 120621 - DNA, 955 bp, Homo sapiens
  misc_feature: GYAE6OF02HV8MD.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctcctatgagctgacacagcccacccgtcggtgtcagtcgtccccaggacagacggccaggactccacctgctcgtagggagatgactagttacgaccaaaagctaaattagtgtactttaacgttacggtaaccaggacgaaggaaacggcccgaacggacccgtaaccgggtccccccgttaggtacgtccgttagggtacggtaacttaagttaaaacgtaaaacgaacgtaggttaggaaccggtacggtaccccgttacggaacgggggtaaccttccccggtaaggtaaccggtccgttaaacgtttttcccgtacggttaccgggtaccctaacccggtaacggtacccgttaaccgggaaacgggggttaaaaccctaaaacggttaaccgggtttacccgttaaacccgggttttaccgaaacccgttaacgttaacccggtaaagggtttaccgggtaaaccggttacccggaaagggaaccgtaaacgggaaaaggtacggttaacgggaacgggttaaccgttaaccgttaaaacgttttaccgtttaaaccggttagttaaacccgtaaagtttaccgaaacgtaccgtaaaccggtaacgtaaccggtaacgttaacggggtttttacgggtttttaaccgggtttttttcgggggtaaccggggtttacccggggaacgggggtaaacccgggtaaacccggtaacgggttacccggtaaccggttaaccccgggttacgttaacccgggtaccgtaacccgggtaccccggtaaacgggttccccccggg

SEQ ID NO: 120622 - DNA, 618 bp, Homo sapiens
  misc_feature: GYAE6OF02JHWXD.2.38.D05.1.454.CMB.1.raw
  modified_base (302)..(302): a, c, t, g, unknown or other
  misc_feature (302)..(302): n is a, c, g, or t
tcagacgctcgacacacgaccggtgctcgatttagtatctgatagttgggtttggggtgggtccaggaggcagaactctgggtgtctcaccatggcctggatccctctacttctccccctcttcactctctgcacaggctctgaggcctcctatgagctgacacagccaccctggtgtcagtcgtccccaggacagacggccaggatccacctgctctggagatgctatcgaccaaagcaatagtgtcttagttcggtaaccagcaagaacgccgacggccacggtcccctgtcgcgtggtnataataataaagactagtgagacgtcctagaggactccgtagacgcgtattctcgtcgacctaccgagtcgtacgaaggacaacgtagtacacgttcgacattcgagtagacgtccgagacaagaagacgtaggacgtacttagaacttaagttaccgtagttaacaagtcgtaagaccgtaagaacgtagtaccgttaagggtttacgtttaacggttttgggtacggtacgggtacgggtaacggaccgtaaggtccgttaaccggtacccgtacggttaccggacctacccgggtaccgtacggttaccccgg

SEQ ID NO: 120623 - DNA, 681 bp, Homo sapiens
  misc_feature: GYAE6OF02HKF1F.2.38.D05.1.454.CMB.1.raw
  modified_base (179)..(179): a, c, t, g, unknown or other
  misc_feature (179)..(179): n is a, c, g, or t
  modified_base (224)..(224): a, c, t, g, unknown or other
  misc_feature (224)..(224): n is a, c, g, or t
  modified_base (318)..(318): a, c, t, g, unknown or other
  misc_feature (318)..(318): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtntcagtcgtccccaggacagacggccaggatcacctgctcgtgganatgctattgaccaaagcaatactgtacttagttcggtaccagcaagaacgccaggccacggcccctgtcgcgtggtgtatataataaacgtacnggtagacgacggccctagacgggactccccgtaggacgtccggaactttcgtcgtacggtccaccgaggtcgtacgaagggtaacaacgtagtccgtacgtacgtacctagtaccgtaggtggtaacgtcgaggacaacggagaattacggacgtacgtagtaaacgttacgtaccgttaggtaacctaacttacgaagaacgtaaccgacgcggtacgttaacggtttcggtttacggtttttacggggttacgggtttaccggggtacgggtaaccggtaacggtaaacggttccggttacggttaacccggttaccgggaacggtttcccggaaccggttacccggacggttcccccggg

SEQ ID NO: 120624 - DNA, 796 bp, Homo sapiens
  misc_feature: GYAE6OF02H50UL.2.38.D05.1.454.CMB.1.raw
  modified_base (171)..(171): a, c, t, g, unknown or other
  misc_feature (171)..(171): n is a, c, g, or t
  modified_base (177)..(177): a, c, t, g, unknown or other
  misc_feature (177)..(177): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagatctctgtgcagcctctggacttcaccttnagtacnctacgtggatgcacgtcgggtccgaccaagcctccgagggtaaggggctggtggtgggtctacgtacgtattaagtgtgagtgggagtacgcaacgaagcctacggcggtactccggtggaacgggcctattccgacctacttccaccgagaacggacaaccgacaaacggaaccacggtccgttagtactcctaggaacctaaagtcgaaacgtcggttaccgtggtaagaccgtaccgggaacggacccggtaacggcggtttacggtaggtttaactttacgtgggttacggaaccgtaagggaacggtagtacgaccggtacggacctacggtaccgggttaccgggtacggtaccccggttaacggttacccgggtaccggggtacccgaaacccggggttaacccgtcgggttaccccgtaaccggttcccttacccggtccgtacccggtcccgtaaccccgaccggtaacccggtcccgtaaccggttccccggttcccttacccggggttacccggtccgccccgttacggtccctaaccgggcggaccgtaccggtaaccccgtggaacccggtacgtccggaaccggtccgggtaccggtacccgggg

SEQ ID NO: 120625 - DNA, 573 bp, Homo sapiens
  misc_feature: GYAE6OF02FWAYQ.2.38.D05.1.454.CMB.1.raw
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
  modified_base (452)..(452): a, c, t, g, unknown or other
  misc_feature (452)..(452): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagcttacgtggatgcacgtgggtccgccaagcctaccgaaggggaagggctgggtggtgggtctcgacgttattaagtagtgagtgggagtagcagaagctacgcgactcgtagaacggccgatcaccntctcaganacaacgacaagacacgctagtactctgacaaatgaaactgtacngacgagccgaggaccacggntggtatattacgngtacgacaaaggatagtagcaagcgagtccgtacgggtaccgccgtaacgtaccggtcggggacccgtaacgggtaaccccgtcggtaccctacccggttcctcctaccgacgtacccccg

SEQ ID NO: 120626 - DNA, 643 bp, Homo sapiens
  misc_feature: GYAE6OF02F4PQP.2.38.D05.1.454.CMB.1.raw
  modified_base (243)..(243): a, c, t, g, unknown or other
  misc_feature (243)..(243): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtccagtgtccccaggacagacggccaggatcacctgctctggagatgcattgccaaagcaatntgcttattggtaccagcagaagccaggccaggccccctgtgacgtggtgatatataaagacagtgagagccctacgagggactccctgagcgtatctcgtgctccagctacgagggacaacgagtcacgtttacgaccgtactacgagtagggtagtccgaagggtactaaggaaaggtactaggacggcttaggacttacgtttacctcggttaccaaagttaccgagtaccgaagtaaccgtaaggtacctaagggtttcgggttttaaccgttttttgggggttacggttttaccgggggtaacggggtaaccggggaaccctaaagggttccgtaaccggtaccccggttaccgtttaacgggtaccgtaaccggtaccccggtaaggtcccccgg

SEQ ID NO: 120627 - DNA, 856 bp, Homo sapiens
  misc_feature: GYAE6OF02J1S38.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctgggtggacggtccgggggaggtcttagttcaggccggtcgggggtccctagacgacctctccgtgtgcacgtcctcgtggtattcctaccttcagtacgcttacgtggatcgcctacggtcgggtaccccgaccaacgcccgtacggaacgggggtaacgggtcgttgggtggtcgggtctacgtaacgttaattaagtaggtagtaagtcggggtaatacggacgaacgtaacggccgtaaccggaccggtacccgtaccgggtaagggtaaccggggtcccgtaacgttacccgaacccgttaacgttcccgtaaccgaaaacggtaaaccgaaacccgtaaacccggtaaacccgaaaaggaaaccccgacgtacccgtttaggtaacttccggtaacgtaaacgtaaaaacgttacggaaacccgttaggttaaccgtacgggaaacggtaacccggggccggtaaacgggacccggtaaccgggtacttacggggttaactacggtttaacgtcgtaacgaaacggtaaagtaacggtaacgtacgggaccgaacgggtccgtaacggtcggtaacccgggtaccgtaccgggttaacccggtcggggtaacccggggaaccggttaacccggggtcccgttacggtacccgtaccccggttacctcccgtaccggtaccctaacccccggg

SEQ ID NO: 120628 - DNA, 677 bp, Homo sapiens
  misc_feature: GYAE6OF02IWBHJ.2.38.D05.1.454.CMB.1.raw
  modified_base (180)..(180): a, c, t, g, unknown or other
  misc_feature (180)..(180): n is a, c, g, or t
  modified_base (225)..(225): a, c, t, g, unknown or other
  misc_feature (225)..(225): n is a, c, g, or t
  modified_base (505)..(505): a, c, t, g, unknown or other
  misc_feature (505)..(505): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtntcagtcgtccccaggacacgacggccaggatcacctgctctgganagtgactagttcgaccaaaggtctaaatactgtactttacgttacggtaaccagtaccgaagaacgccgtaacgggccctaacgggtccccttggtcggtcgttaggggtctaagttaataacgtaaaagacgtaggtacggaacggacggtcccttagaggggactcccgtaggcgtcgtatttctcgtcggtctaccgaggtctacggaggtaacccaactgttccgacgttacgacctgtacgaggtacggtacgtcgacggagaaacggtaagcgngtaacgtcgtacgtaaacttagtacgttgaacggtaacttaccggaatacgaacgaccgtaggacgttagggtttcgttttacggttttggggtacggtacggggacgggttacggaacgtacggtacgtcggtaacccgtgtaccggacgacggtacccggattccccggg

SEQ ID NO: 120629 - DNA, 703 bp, Homo sapiens
  misc_feature: GYAE6OF02G6GPG.2.38.D05.1.454.CMB.1.raw
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
tcagacgctcgacacacgaccggtgctcgatttagtatctgatagctgggttttccttgttgctattttaaaaggtgtccagtgtgaggtgcagctggtggagtccggggaggcttagttcagcctggggggtccctgagactctcctgtgcagcctctggattcaccttcagtagctacgtggatgcacgtgggtccncaagctccgaggggagggctgggtgtggtctcacgtattaanagtgagtgggactagcacagctacggcgactcgtagaggccatccacntcacaganacacgcaagacncgntgtactcngactaaagtgaactgtcgtagacggcgacccggaggaacctacggtcttaggttacgtaactttaccgtggtacgaacgtaaagtagtaacgtaacgacgacggacgtaggtaccggttacgggtaacccggacccggttaccgtacgggtaccggggtaaccgtaaccggggttaaccccgttacgggttacccgtacccggtttcccgtacccgttaacgacccggtacccgtacccgaaccggtaaccgggtccccgttaacggttcccggttccccgttaccccgttcgggacccttacccggtccggtaccgtaccggacggtaccacccgtaaccgtaccggacgtaccgacgtaccggtccggtaccggtcccggg

SEQ ID NO: 120630 - DNA, 846 bp, Homo sapiens
  misc_feature: GYAE6OF02IA2F2.2.38.D05.1.454.CMB.1.raw
  modified_base (163)..(163): a, c, t, g, unknown or other
  misc_feature (163)..(163): n is a, c, g, or t
  modified_base (214)..(214): a, c, t, g, unknown or other
  misc_feature (214)..(214): n is a, c, g, or t
tcagacgctcgacacacgaccggtgctcgatttagtatctgatagttgggtttggggggttgggtccaggaggcagaactctgggtgtctcaccatggcctggatcctctacttcttccccctcttcactctctgcacaggctctgacggcctcctatgagcngacacagcccacccgtcggtgtcagtcgtcccgaggacagacggcaggacncactgctcgtggaatatgactattcggacaaagactaatagttgtacttaagtttacggtaaccgtagacaggtaaacgaccgaggaccgacgggtacccctggttagccggttttaggacgtaattaaataagtaaaagaccgtaagggttagaggaccggtaccccgtaggaacggggtacctacccgttaggaaacggtccgttaacttttccgtcgttacggtaccgttccgaacggtccgttaacgaaacgggaaacccgtaaactaacggttccgttaacgggtttaacgtaaccgtaacgtacgtaagggtacggtaccgtaacgaacggtaccgaaggaaacgtagtaacgggacggtacgttaagttaacgtaactttaacgtacggttaaccaaacgttacgaacggtaaccgtaacggaaccgtaggtaaccggttaacgggttttaccgggtttttaacgggtttttttcgggggtaaccggggttttacccgggggtaacggggtaaaaccggggtaaccgggtaaacccgggttaccgttacccgggttaaccccgggttaaccgggtaaccggttaacccggtaacccggtaaccccgggtaacggtaccccccggg

SEQ ID NO: 120631 - DNA, 652 bp, Homo sapiens
  misc_feature: GYAE6OF02GQBJT.2.38.D05.1.454.CMB.1.raw
  modified_base (120)..(120): a, c, t, g, unknown or other
  misc_feature (120)..(120): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (571)..(571): a, c, t, g, unknown or other
  misc_feature (571)..(571): n is a, c, g, or t
  modified_base (615)..(615): a, c, t, g, unknown or other
  misc_feature (615)..(615): n is a, c, g, or t
  modified_base (631)..(631): a, c, t, g, unknown or other
  misc_feature (631)..(631): n is a, c, g, or t
  modified_base (634)..(634): a, c, t, g, unknown or other
  misc_feature (634)..(634): n is a, c, g, or t
tcagacgctcgacacacgaccggtgctcgatttagtatctgatagttgggtttgggggagccccagccctgggattcccagctgtttctgcttgctgatcaggactgcacacagagaacncaccatgggagtttgggctgagtcgttgggtttttcctttgttgtacttaagttttaaaaggtgtcctaggtgtggaggtncagcgtggtggnggtccgggggaggtcgttaggttcgacggccgggttcggggggtccctgacgtccttccgtccgtagtcgcgtacgtccctggtaggtactttaccgaccttcgagttacgctaaccgtggacttcggaccgtacggtcgggtacccgacaaggtccccgtacggaaggggacggggtcgttggtcggttcgggtctacgtacgttaattaacgtaggtagacggtggagtacgactaacggaagtcgtaacgccgtacgtacgtacggaaggtccgtactacaccgtctccgtacgagaacgtaaccaaccggataaaaccggacacgtcgtatactcgagtacgaaactgaaaccngtacaggaccgagaccgacgacggtcagttcgtagtctagcgtnaacgtagatggacagncgngtacgcgacgcacgtcgg

SEQ ID NO: 120632 - DNA, 556 bp, Homo sapiens
  misc_feature: GYAE6OF02HKXHU.2.38.D05.1.454.CMB.1.raw
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
  modified_base (480)..(480): a, c, t, g, unknown or other
  misc_feature (480)..(480): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagccgtggggggtccctgagactctcctgtgcagcctctggtattccaccttcagtagctacgtggatgcacgtcggggtcccgccaagcctaccgaggggaacggggctggtggtgggtctacacgttattaatagtgagtgggagtagcacaagcctacgcggactccggtagaagggccatcaccatcncgaganacaacgaccaagacacgntagtatctgaacaaatcgaacagtctggaacgacgccggagaccacggctgtatacttactgtagacaagagtatacgnagcagcgtacggtacgaccgtaacgtacggtcgggaccaccgggacctggtcccaccgttcaccctcgacctcccg

SEQ ID NO: 120633 - DNA, 698 bp, Homo sapiens
  misc_feature: GYAE6OF02G9YZV.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccgaggacagacggccaggatcacctgctcgtggagatgctattcgaccaaagctaatatgtcttagttcggtaccagccgaagaacgaccacgggacccacgggtcccccgtggtcggcgttgggtacgaagttaataaagttaaaaggacgtaggtagaacggacgggcccctggaaggggtaccttcccgaggacggacgttactttcgttcgtccgggtcctaccgagccgtacgacggggtaaccaacgtaggtacctacggttacgacctagtcgaggtagggtacgtcccgaaggaccaaggaagagtggaacggtcgtacgtacgttattaaccgtgttaactaacgtacgacgacgaacgacgtacgtacgtaggtttgggttttaacggtttttggggtacgggtttccgggggaacgggtaccgggtaacccgtaacggttccgttacccggtaccggttccgtacggtaccgtaccgggacccggtacggtcccgg

SEQ ID NO: 120634 - DNA, 691 bp, Homo sapiens
  misc_feature: GYAE6OF02FPRER.2.38.D05.1.454.CMB.1.raw
tcagacgctcgacacacgaccggtgctcgatttagtatctgatagctgggttttccttgttgctattttaaaaaggtgtccagtgtgaggtgcagctggtggagtccgggggaggcttagttcagcctggggggtccctgagactctcctgtgcagcctctggattcaccttcagtagctactggatgcacgtgggtccgccaagctccgagggaaggggctgggtgtgggtctcacgtattaatagtgagtgggagtagcaacgaagctacggcggactccggtggaacggccgattcacatcctcagagacacgaccaagaacacgctgtactctgactaaatgaaaccagtcgtaggagacggaccgacgggaccgacggtgtcgtagttaacttaaccgtggtagacaaaggagtaagtagacaggcaacggtctacgggacctacccggataccgggtcggggaccgaaccggggtacccgtcggtccctaacccggttcctacccgtacgtacccgtccccgtaacccgtaaccgaaccggggtccccttaaccggttcccggtttccccgtttccccccgggtggtcccccgttccccggtcgcccgttaccggaaccggcccgacccgttacccggtaccggaacggacccggaccgaacccgcgggtccccgggtaccccgg

SEQ ID NO: 120635 - DNA, 736 bp, Homo sapiens
  misc_feature: GYAE6OF02H5IM8.2.38.D05.1.454.CMB.1.raw
  modified_base (268)..(268): a, c, t, g, unknown or other
  misc_feature (268)..(268): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctgggtggaggtccgggggaggcttagttcagccgtggggggtccctgagactctcctgtgcagcctctggattcaccttcagtagctacgtggatgcactcggggtcccnccgaaagtcctaccgaagggggaacggggtcgtggtggttcggggtctacgtaacgttaatttaaacgtagtagagtgggaatagacaacgtaagctaaccggcggtacctaccggtaggaaacggtcccgtatttccgaacctattcctcccgaaaggaaccgacaaaccgccgaaagaaaccacggtaccttaggtaactccgtaggaaactaaaagtcgaaacctgggtaccttaggaaggaccggaacccggaaaggacctaacgggctttacgagtttaaattccgttagggacgaacgtaaaagaggtaagttaacgccgtaaagccgtaaagggcccgttagggtaacccggtacccgtaaggttaccgggggtcccgggggaaccccttaaacgggggtaccccctgggggttaccccaccccgggtttccctaaccttaccgggaaccccgtacccccg

SEQ ID NO: 120636 - DNA, 716 bp, Homo sapiens
  misc_feature: GYAE6OF02HN9G3.2.38.D05.1.454.CMB.1.raw
  modified_base (180)..(180): a, c, t, g, unknown or other
  misc_feature (180)..(180): n is a, c, g, or t
  modified_base (297)..(297): a, c, t, g, unknown or other
  misc_feature (297)..(297): n is a, c, g, or t
  modified_base (351)..(351): a, c, t, g, unknown or other
  misc_feature (351)..(351): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtntcagtgtccccaggacagacggccaaggatcacctgctctggagatgcattgaccaaaagcaatatgctttaattggtaaccagcaagaagccaggccacggcccctgtcgctggtnatatataaagcaggtgagacggccctagaaggggactccctggacgcgtattcncgtggcctccagcctacgaagggaacaaacgtagtacctacggtttacgaaccctaattccgaaggttacgggaacggttaccgaacgggaccgaaaggtaaagaacgttaggaacggcgttaacgaacgttaatttaaccgttaggttaacctaaacgttacgaacgtaaccgaacggtaaacgaacggtaacgtaaacgggttttacggggttttacggtttttttagggggttaccgggtttttacccgggggaacggggttaaccgggggaacccgtaaacgggtacccggttacgggtaaccccggtttaccggtaaccgggttacccgaacccggtaccccggaacgggttacccccgg

SEQ ID NO: 120637 - DNA, 834 bp, Homo sapiens
  misc_feature: GYAE6OF02H7FA7.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctgggtggaggtccgggggaggtcttagttcaggccgtgggggtccctgagacctctcctgtgcagcctctggattccaccttacagtacgctactggtatgcacgtcgggtacccgaccaagccgtccggaaggggaacgggtcgtgggtggtcggtctcgtaacgttatttaagtgtagaggtacggggagtaacgacgtaacgaacgtccgtaccgggaccgaccgttaccgggagggtaaccggggaccgtaacgttaccgaacctacttaccgaccgtaacggaaacgtaacccgaaaaccgacccaaaaggaaacctaacggtccgttaggtaaaccttccgtaacgaaaccttaaaagtcgtaaaaccgttaggtaccgttaacgggaggtaaccgggacccggggtaaggaacccgtaccggggtattcggtttaaccggtttaacgtttaacgttacgggttacgtaaaccgtaaaaggggtaataacggttaaccgaccggaacgtacggtaaccggtcggttacccggggttaaccccgacccggtaaaccggttaaccccgggggtcgggggtaaacccccggtaaaccggggttaccccggttaccgggttaaccccctaacccgggtttccctaccccggaacccgtccccggtaaccccccgg

SEQ ID NO: 120638 - DNA, 668 bp, Homo sapiens
  misc_feature: GYAE6OF02G1D4V.2.38.D05.1.454.CMB.1.raw
  modified_base (332)..(332): a, c, t, g, unknown or other
  misc_feature (332)..(332): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctcctatgagctgacacacgcccacccgtggtgtcagtcgtccccaggacagaccggccaggatccacctgctcgtggagatgactattcgaccaaaagcaaatgtgtctttaagttcggtaaccagacaaggaacgacccgaggcccgacgggtcccctggtcgcgttggtataataataanaaaggactaaggtacggaggaccggcccacggacgggtacctccgtaggacgtcgtatttctcgtcgtcctcgacgctacgaggtaaaccacgtacgtacgtacgttacgaaccctagtacgaaggtcggacgtccgaggacaaggaaagtacgaggacgtcgtaacgtattacttacgtgtaacaacttacgaacgacgtaacgaacgtacggtaacgttacggtttacgggttttacggtttggggtacggttaccgggaacggggtaacgtacggtaacggtctacggtacccggttacgtaccggtacgacggtaccggaaccggttcccgg

SEQ ID NO: 120639 - DNA, 741 bp, Homo sapiens
  misc_feature: GYAE6OF02J0WVG.2.38.D05.1.454.CMB.1.raw
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
tcagacgctcgacacacgaccggtgctcgatttagtatctgatagttgggtttgggggtgggtcaggaggcagaactctgggtgtctcaccatggcctggatcctctacttctcccctcttcactctctgcacaggctctgaggcctcctatgacgctgacacacgccaccctcggtgtcacgtcgtccccgaggacacggaccggccagggactaccgaccgtcgcctccgtggagtagtcgctagttggaccaaacggtacctaattaattcggtactttaacgttcggtaaccaggacgaaaggaacgtccgaacgggcccacggtcccccgtgtacgcgtaggtnaataataanaaacggtaacgtaggtacggacggaacggaccctaggaacggggatcccgtagacgtcgtaacttcgtccgtaggtccccacacggtaccgtacgaacggggtacctaacgggacttaccgtacggttcgaactacgtacgacggtacggacgtaccgaggacgtagaacggaattcggacgtactaggtaactacgtacgttactaccgtaactcggaaacgacgaaccggtaacaggtaaccggtagtttaacgggtttccgttttaggggttacgggttccgggtaacgggttacgggacctaacggggttacgtaccgggtaaccggttcccggtaaacggggttccgtaaaccgggtaccccgtaagggttcccccgg

SEQ ID NO: 120640 - DNA, 652 bp, Homo sapiens
  misc_feature: GYAE6OF02JDGN7.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggaggcttagttcagccgtggggggtccctgagactctcctgtgcagcctcgtggattccaccttacagtacgctactggatgcacgtcgggtcccgaccaagcctaccgaggggaagggtcgtgggtgtgggtcctcgtacgttaattaagtagtggagtagggagtagcaacgaacgtactacggcggtactccggtaggaacgggccgtacttaccacctactccgtaccaggaacgaccaaacgcccaaaagaccacgtactgtacttcgagacaaagtcgaaactcggtactaagggacgtaacgcccggtaaagggaccgaccgggttcgttaaggtttaggttactttacctgggttacgaaccgtaaagggagtaacgtacggacgtaggacccaaggtccggtaaccggtaccggtaccccgttaatacccggggg

SEQ ID NO: 120641 - DNA, 759 bp, Homo sapiens
  misc_feature: GYAE6OF02J0RIZ.2.38.D05.1.454.CMB.1.raw
  modified_base (323)..(323): a, c, t, g, unknown or other
  misc_feature (323)..(323): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctcctatgagctgacacacgccaccctcggtgtcagtctcccagcagcggccaggatcactgctcgtggagatgctagttcgaccaaagactaatatacgtctttaagttcggtaaccagacgaacgaacggccgacggccaacggcccctgtagcgtggtagaattagtaaanaaacgactaggtagaacgtacgtccgacgtaacgggtacctaccgtacggaacgtaccgtactttccgtcgttacgtcccgtacgtacggtcctaacgaacgggtaacaaaccgtacgtaccgtacgttaccgacctagtctaggtacggtacggtaccgacggtaacgaagtaaacggtagttacggtaacggtaccgttaacgttaacgttaacgtttaacgtaacgttaacgtaaagttacccgtaaggtaaccgtaacggtaacgaacggttaccggtaaggtttaccgggttttaacggtttttacggggttacgggttacgggtaaccggggtaacggttaaacccgtaaccgggtaaccggttaccggttaaccggttaacccggttaagggtacccgtaaccggtaaccccggtaaccggttccccgg

SEQ ID NO: 120642 - DNA, 717 bp, Homo sapiens
  misc_feature: GYAE6OF02GOZFR.2.38.D05.1.454.CMB.1.raw
  modified_base (357)..(357): a, c, t, g, unknown or other
  misc_feature (357)..(357): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacacgcccacccgtcggtgtcagtcgtccccgaggacagacggccgaggactcacctgctcgtggagagtgctattcgaccaaagcaatgtgtcttagttcggtaaccagacaagaacgccgaggcccacggcccctgtcgcgtggtgataacgtaataaagacgagtggagacggccctgagggactacccgnggacgtcgtactttctccggtaggtcccctacgacggtccgtcggtaacgggaaccaacggtacgtaccgtacggttacgacctactacgtacggtaggaccgtacgacggtacgagtaaagcgttagacggtcgtagtaacgttacttaccgttgtaacgtaagccgtacgaaccgtacggaaccgaagaccggttaacgggtttacggggtttttttaccgggttttcgggggttacgggtttaccggggggaaccgggttaaccggggtaaccgtaaagggttcccggttaaccgggttacccgggttaccggtttaacccggacggtaaccccggacccggtaggtaccccccggg

SEQ ID NO: 120643 - DNA, 676 bp, Homo sapiens
  misc_feature: GYAE6OF02GXV31.2.38.D05.1.454.CMB.1.raw
  modified_base (338)..(338): a, c, t, g, unknown or other
  misc_feature (338)..(338): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgaggcctcctatgagctgacacagcccaccctcggtgtcagtcgtccccaggacagaccggccaggatcacctgctcgtggagatgctattcgaaccaaagcaaatatgtctttaattcggtaccagacacgaacgccgacggccacggcccctggtcgcgtggtcgaatataataaagacaggtgagacgccncgagggactccgtgacgcgtattcgtcgtcggcctcgagcgtacgaacggaacaacgtacgtacgtaccggttacgaaccctagtaccgtaggtacggtaaccggtccgaagggacaaacggaagtagtaaggaccggtactacgtaactttaagttacctacgttaactacgtacagtaccgaacgtaacgacggtacgttaaggtttacgggtttttacggttttggggtaccggtttacgggggaacggttaaccggggaaccgtaccggttaccggtaccgttaccgggttaccgtaacggtcccggtaccggtacccggtaccggtaccccgg

SEQ ID NO: 120644 - DNA, 748 bp, Homo sapiens
  misc_feature: GYAE6OF02HRVC0.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtcgtccccaggacaggaccggccaggatccacctgctcgtggagatgctattcgaccaaagcaaatatgtctttagttcggtaccagcaagaacgccgacggccacggcccctgtcggccgttggtgaattaataagtaaaacgacgtagtggaaggaccggcccctacggacggggactccccgtaggacggcgtagtttcctacgtcgggtaccctccgagtccgttaccggaaggggaaccaaacgtacggtaccgtaacggtttacgaaacccgtagtaccgaacgggttacgggtaccgttaccggaagggacgaaacgggaaagtaacgtacgggaacggtccgtttaacggtaaacctttaagtttaaccgttagttaacctaaacgtccgaacgtacgaacgaaccgtaggtacgtaagggttttacgggttttacggttttttggggtacggtttccggggaacggggtaaccgggtaaccgtaacggttccgtaaccggtacccggttaccggttaacgggttaccgaacccggtacccggaagggttaccccg

SEQ ID NO: 120645 - DNA, 711 bp, Homo sapiens
  misc_feature: GYAE6OF02HZVP9.2.38.D05.1.454.CMB.1.raw
  modified_base (547)..(547): a, c, t, g, unknown or other
  misc_feature (547)..(547): n is a, c, g, or t
  modified_base (647)..(647): a, c, t, g, unknown or other
  misc_feature (647)..(647): n is a, c, g, or t
  modified_base (665)..(665): a, c, t, g, unknown or other
  misc_feature (665)..(665): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagtcgttgggtttttccttgtttgacttaagtttttaaaaggtgtccgagttgtggaggtgcaggtcgtgggtgggtacggtccggggggaggtcgtttagttcgacggtccggttcggggggtccctggtacgtaccttccgttccgttggtcgcgacgtccgttcgtaggtacgttacctaccttacgtagtacgtccgtacgtcggactcggacctaccgtcgggtcccgaccgaacgccgtaccggaaggggtacgggtcgtggttggtcggtactcgtaacgttaattaagtaggtagtaggtggagtagactaacgagtactaccggacgtacgtcggtaggacgggaccgtactacctacacttccgcgaagtacgaaaccgaagaccgaaaagaaccgtntacttgtaacttcgtaacgaactaaggtaacacgtagtcgacggaacgcggaacccgtaggaacccgttacgtgttacgttagttcgtacgtggttaacncgtaaaggacgtaagtanccgtaagcgtaacggttcgacggtacccgtaccgtaggtaaccggg

SEQ ID NO: 120646 - DNA, 718 bp, Homo sapiens
  misc_feature: GYAE6OF02F7X7D.2.38.D05.1.454.CMB.1.raw
tcagacgctcgacacacgaccggtgctcgatttagtatctgatagttgggtttgggggtgggtccaggaggcagaactctgggtgtctcaccgtggcctggatccctctacttctccccctcttcactctctgcacaggctctgaggcctcctatgagctgacacagcccaccctcggtgtcagtcgtccccaggacagacggccaggatcacctgctcgtggagatgcattcgaccaaagcaatatgctttattggtaaccagtacagaacgccgaaggcccacggtcccctgtcgcgtggtagatataataaagacagtgagacggccctagacggactcccgtaggacgtcgtattccgtcgtcggcctaccgagtccgtacgaagggacccaaacgtacgttacctacgtttcgaaccctagtccgaaaggttcgggaacttaccggagggtaccaagggtaaacggtagttacgggaaggtcgttacggtaaaccttaacgtttaccgttagttaacgtaaacgttaccgaaggaccgtaacggtaacctaacggtaccgtaaggtttacggttttaccgggttttttacggggtcggtttacccggggacggggtaaaccgggtaacccgtaaggtcccggttaaccggtacccggtttaccgggtaacggtacccggacgtaccccgggtaacggtccccgttacccccgg

SEQ ID NO: 120647 - DNA, 745 bp, Homo sapiens
  misc_feature: GYAE6OF02F3I6H.2.38.D05.1.454.CMB.1.raw
  modified_base (611)..(611): a, c, t, g, unknown or other
  misc_feature (611)..(611): n is a, c, g, or t
  modified_base (666)..(666): a, c, t, g, unknown or other
  misc_feature (666)..(666): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcgagccgtgggggggtccctggacgtactctccgtgtgcagcctctggtacttcaccttcagtagctacgtggatgcctacgttcgggtacccgaccgaacggccgtaccggaaggggggtaacggggggtccgtgggggttcgggttcggggttccgtaccgtaaacggtttaagtttaaagttaagggttaggtaaggttagggggaagttaacggacaaccggtaaacggtccgttaaccgggccggtaaccgtcccggtaacgggaaaccggggtcccgtaacgttcccaaccgtacttccgtaaccgaaggtaacgaacccaaaccggacccaaaagaacccgtacggtacctaggttaaccttcgacgaactaaacgtagaaaccgngtaccgtaggaacgcggaccggaaggccgacgggtctaggttacgtaatttccgngtacggacgtaaaggacgtaagacggacaacggtcgaacggtcgttaacgggtaaccccgccggttaaccgtaccgggg

SEQ ID NO: 120648 - DNA, 907 bp, Homo sapiens
  misc_feature: GYAE6OF02GF9EZ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtgtccccaggacagacggccaggactcacctgcctctggacgattgctattcgaccaaagcaatatgtactttagttcggtaccagtacaaggtaacgccgaacgggcccgaacgggtccccccgttaggtcggtccgttgggttacgaacttaaagttaaagttaaaacggaaccgtaaggttacggaacggtaaccgggtacccccttacgggtaaacgggggtaaccttaccccggttagggaaacggtaccgggttaaacttttccgttaccggttccgggtacccgttacccgaacgggttacccgttaaccgggaaaacgggggtaacctaaaccggtaacggttacccgtaaacgggttttaccgaaaccccgttaacgttaaccggtaacggggttacgggtaaaccggttacccgggaaacgggtaaccgtaaagggaaacggtaacggttaacgggaaccgggtacgttaacggttaaaccgtttaacgttttaacgttacggttaaccgtaaacttacggaaacgtaccgtaaccggaactaccggtaccgtaagggtttaccgggttttacgggttttttacgggggtacggtttaccgggggtaaccggggtacgggtaaacccggtacggttacccggttacccgggttaaccgttacccgggttaaccgggtacccggtaaccggtaccccggtaacgggtcccccgg

SEQ ID NO: 120649 - DNA, 760 bp, Homo sapiens
  misc_feature: GYAE6OF02ITU6Q.2.38.D05.1.454.CMB.1.raw
  modified_base (223)..(223): a, c, t, g, unknown or other
  misc_feature (223)..(223): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtcccaggacagacggccaggatcacctgctcgtggantgcattgaccaaagcaatatgtacttattcggtaccagcaagaacgccaggccacggcccctgtcgcgtggtcgataataagtaaagacgtagtgacggacggcccgtacgagggtacctacccgtgacgtcgtactttctcgttcggtcctaccgacgtcgtacgaacgggaactaaacgtacgttaccgtacggtttacgaacctacgtaccgtaacggtacgggtacgttaccgaacgggtaccgaaagggtaaacgtaacgttacgggaacgggttccgtttacggttaaaccgtttaacgtttaaccgttaacggttaacctaaacggttaccgaacgtaccgtaacgaccgttaacgggtaccggtttaagggtttaccgggtttttaacgggtttttttacggggtcggggttttaccgggggtaacgggtaacccggggtaacggttaacggtaccggttaaccggtaaccccggtttacggtaaccggttaccggtaaacccggtaccccggtaagggttacccccgg

SEQ ID NO: 120650 - DNA, 787 bp, Homo sapiens
  misc_feature: GYAE6OF02JT966.2.38.D05.1.454.CMB.1.raw
tcagacgctcgacacacgaccggtgctcgatttagtatctgatagctgggttttccttgttgtctatttaaaggtagtccagtgtgaggtgcagctggtggagtccgggggaggcgttagttcagccgtggggggtccctggagactctcctgtgcagcctcgtggtattcaccttcagtagctacgtggatggcacgtgggtcccgccgaagcctccgagggggaacggggctgggtggtgggtacctcacggttataataggtgatgggacgtagcaacgagcgtacgacggcctaccggtacgaggggaccccgtaagttccgaaccctatcccgtacgaaacggtacggaaccaaccgaacccgaaacggaaaccacccgggaatacggtacttacggacacgtaaaacttaggaaccgtaagtaccgtaggaacggacggacccgggtaagggaaccaacgggccgttagttaacggtaacgttaccgtagggtagaccggtaaagaagtacgtaacggtacgaacgtacgacgtacggtacggtaccgaccggtacgtacggtacgggaccgtacgggacccggtcgggtaccgtaccggtaccgttccgaccgtaccgtaccgtaccgtaacccggaccggtacccgtaccgttcccggtacccgttacccccgtcggttccccgacccgtccccggtcccgtaccgtaccgggtaccgacccgtaacccgccggtaacccggaccgaccgtaacccggcgggtacccccggtacccggg

SEQ ID NO: 120651 - DNA, 610 bp, Homo sapiens
  misc_feature: GYAE6OF02HNTW1.2.38.D05.1.454.CMB.1.raw
  modified_base (237)..(237): a, c, t, g, unknown or other
  misc_feature (237)..(237): n is a, c, g, or t
  modified_base (600)..(600): a, c, t, g, unknown or other
  misc_feature (600)..(600): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggacgtccgggggaggcttagtcagccgtggggggtccctgagactctcctgtgcagcctctggtattcaccttnagtagcttactggatgcacgtcggggtccaccaagctccggagggagggctggtgtgggtctacacgttattaagtagtgagtggggtatacgacaacgacgactacggcggtacctccggtaggaacgggtcctaacttcaaccattccgactagacgaacaaccgcaaacgacacggcttgtactcagaacaaatagaactagtacgtaggaagacggacggagtccgaacggtcttgtacgtttattactggtacgacgaagagactagcgaacgcgacgcgtacggtaccgaccgtaaggtaccggtggggacccgtaacgggtaacccgtcggtacccgtaccgttaccgtcccgtanacccgtcccg

SEQ ID NO: 120652 - DNA, 669 bp, Homo sapiens
  misc_feature: GYAE6OF02HV66R.2.38.D05.1.454.CMB.1.raw
  modified_base (162)..(162): a, c, t, g, unknown or other
  misc_feature (162)..(162): n is a, c, g, or t
  modified_base (489)..(489): a, c, t, g, unknown or other
  misc_feature (489)..(489): n is a, c, g, or t
  modified_base (518)..(518): a, c, t, g, unknown or other
  misc_feature (518)..(518): n is a, c, g, or t
  modified_base (572)..(572): a, c, t, g, unknown or other
  misc_feature (572)..(572): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttccactctctgcacaggctctgacgccctcctatgacnctgacacacgcccacccgtcggtgccagttccgaccccaggacacggaccggccaggactccaccgtcgctcgtagggagtatcgactagttacgaccaaaaacgacaaattagtcgtactttaagttacggaaccaggacaagaacgccgaggccgaaccggtcccgtggtcgcggtagtagtaataactaaagaaacgacgaggtagaacggtacggaccgttacgaaggaacccttccgtaggaacgtcgtattccgcgtcggacctcgaacgtcgaacgtacggaaacacgacgttacaccgttacgacctagttacgaaggnggtaaccgtacgaacggtacaaggtaaancgtaggcagttacgtaaacttgtaccgacgtaagaactcgaagaccagtaacgngtacgtagggtttcgtttacggtttgggtcggtacggcgggaacgacacggttacgcgtacccgttaacggctaaccggcgtaccgtaacggtcccg

SEQ ID NO: 120653 - DNA, 690 bp, Homo sapiens
  misc_feature: GYAE6OF02HIJGT.2.38.D05.1.454.CMB.1.raw
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
tcagacgctcgacacacgaccggtgctcgatttagtatctgatagcgtggggtttccttgttggcctattttaaaaggtgtccagtgtgaggtgcagctggtggagtccggggaggcttagttcagcctgggggtccctgagactctcctgtgcagcctctggattcgaccttcagtagctactggatcgcacgtgggtccnccaagtctccgagggaaggggctggtgtagggtctcgacgtattaactagtgagtgggatagcaacgaagctacgcggactccgtgaacgggccatcacagtccncaganacaacgccaaagacacnctagctctgacaaatnaacncgtcngagacgaccgaggacctacggcttaggtattaacgttactcggtagtaacgtaaggagacgttaacgcgtaaggcaacggtcgtacgggtaacgtcccgtacgtaccggtcggggaccctaaccggggtaacccgttgggttacccgtaccggtttcccgtccgtacccggtaccgtaccccgttaccgaaccccgggtaaaccgggcccgtaacgggttccccggttcccgttacccccgttggaccccgtcccgtaccgtccggtacccgacgggtaccgacccgtacccgtaccggaccgcgtacccgaaccggtccggtccccgtacccggg

SEQ ID NO: 120654 - DNA, 624 bp, Homo sapiens
  misc_feature: GYAE6OF02F5S3X.2.38.D05.1.454.CMB.1.raw
  modified_base (224)..(224): a, c, t, g, unknown or other
  misc_feature (224)..(224): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggatcaccgtgctctgganatgcattgaccaaagcaatatgtcttattggtacagcagaagccaggccaggcccctggtcgcgtggtgataataataaagacaagtgagacggcctacgacggggactcccgtggacgtcgtattctcgtggcttaccgaggtcctcgaacggggaaccaaacgtacgttaccgaacgtttcggaaccctagtacgaaggttagggacgtaccgaaggaccgaaggaacgagttaggacgtacgtagaacttaattacgtcgttacaagtcaacgactaacgagacgacgtaggttacggtttacggtttttagggtcgggttacgggcggggtaaggtaaccgaagtccgtacggtacccgttaccgtacggtaccgtacacccggtaggtaccccgg

SEQ ID NO: 120655 - DNA, 539 bp, Homo sapiens
  misc_feature: GYAE6OF02FSAOR.2.38.D05.1.454.CMB.1.raw
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtgggtccgccaagcctccgagggaagggctggtgtgggtctcacgtattaatagtgagtggagtagcacaagctacgcggactccgtgaagggccgattccactatctccagacgacaacgccaagaacacgctgtactctagacaaatcgaacagtctgagagccggaagacncggntggtntattactgngtacgaagtagatacgcagcagcttggacgccgactacggtcgggaccacgggtaccctaggtcctaacccggtctacccgtcacgtaccccg

SEQ ID NO: 120656 - DNA, 786 bp, Homo sapiens
  misc_feature: GYAE6OF02HCKH4.2.38.D05.1.454.CMB.1.raw
  modified_base (198)..(198): a, c, t, g, unknown or other
  misc_feature (198)..(198): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccnccaagctccgagggaagggctggtgtgggtctcgacgttattaatagtgagtgggagtagcaacaagctacggacggactccggtaggaacggccgattcaaccatcctacgaagacggaaccaaacgccgaaaagaaccacgtctagtaactcgtagaactaaaagtcgaaaacgtcgttccgtaaggaaggaacgtacccgggaaaggaaccgaacgggtcgttaggttaggttaacttacgtaggtacgacgtaaaaggacgaagtacgacgaacgtacgaggtcgtacggtaccgacccgtaacggtaccggtacggggacccggtaaccggggtaacccgttcggtaccgtacccggttcgtacccgttaccgacccgttacccgtaacccgaacccggtaacccggggtaccctaaccggtttaccccggttcccccgttacccccgggttaccgggccccgttaccccgttacccgggtcccttaacccggaacggtaacccggtaccccgtaacccggttaacccgggaacggaacccggtacccggtaacccggtaacccgggccccgggtaccccggg

SEQ ID NO: 120657 - DNA, 848 bp, Homo sapiens
  misc_feature: GYAE6OF02JRF6E.2.38.D05.1.454.CMB.1.raw
  modified_base (810)..(810): a, c, t, g, unknown or other
  misc_feature (810)..(810): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctggacggcctcctatgagctagacacacgcccacccgtcggtgtcaggtccgtccccaagggaccacggaccggccgaaggactaccaccttgcttcgtgggagtatgctagttcgaaccaaagctaaatatcgttactttacgttacggtaccagacgaacgaacgccgacggccaccgggtccccttggtcgcggttagggtagtaattaacgtaaagttaaaacgaacgtacgggtacggaaacggtcccgggtacccgtacgggaacggggtaaccttaccggtacggtaacggccggttaccttttccggttccggtcgggtacccttaccggaacgtccgtaacggaacgggtaaccaacggtcgtaccgtaacggttacgacgtacgtacgtagggtacgtaccggtacgaacgggtacgaacggtaagtacggacggtaacggttacctaagtttaaccttaaggttaacctacggtaaactaccggagtaccgaaccgtaacgaaccgtaacgttacggtacgggttttacggtttttaccgggtttaggggtttccggggaaaccgggttacggggttaaacccgggaaacgttaacccgggtccggtttaaaccccggggttacccggtttaacccgggtaccgggtttaaccccnccccgggggttaaaaccggttaccccggggttccccgg

SEQ ID NO: 120658 - DNA, 710 bp, Homo sapiens
  misc_feature: GYAE6OF02HWJYJ.2.38.D05.1.454.CMB.1.raw
  modified_base (483)..(483): a, c, t, g, unknown or other
  misc_feature (483)..(483): n is a, c, g, or t
  modified_base (669)..(669): a, c, t, g, unknown or other
  misc_feature (669)..(669): n is a, c, g, or t
tcagacgctcgacacacgaccggtgctcgatttagtatctgatagctgggttttccttgttgtctattttaaaggtgtcctagtgtgaggtgcagctggtggagtccggggaggcgttagttcagccgtggggggtccctggagactctccgtgtgcagtcctcgtggattcgaccttcagtagcttacgtggattcggacacgtgggtcccgaccaaggcctaccgaaggggaacgggggctggtcggtgggtactccgaacggttattaagtaggtgaagtggggtaatagccaacgaagcctaacggcggaactcggacggtaagggccgtagtcgtaccgatctaccgagacgaacgacaccgaaagacacgactagtactactacgactaaacgtagaaccaggttctaacggagacgaaccggaacggaccgaggactttacggtagttaaccgttaagcggttacgacgtaaacgngtaaacgtacgagaacggtacaccggtagtaacggtacgggaaccgaacgttaacggacggggaccgtaacgggaccgtacggtccgaccgtccggtacctaccgaccgtccctaccgaaccgaccggtaccaccggtcgtaccccgttcccgcgacccgtccgtcgaccctacgccgggtaaccncccgtcacccggagccgaaccgtcgaccgacggtccccggg

SEQ ID NO: 120659 - DNA, 738 bp, Homo sapiens
  misc_feature: GYAE6OF02IBF91.2.38.D05.1.454.CMB.1.raw
  modified_base (122)..(122): a, c, t, g, unknown or other
  misc_feature (122)..(122): n is a, c, g, or t
  modified_base (166)..(166): a, c, t, g, unknown or other
  misc_feature (166)..(166): n is a, c, g, or t
  modified_base (184)..(184): a, c, t, g, unknown or other
  misc_feature (184)..(184): n is a, c, g, or t
  modified_base (663)..(663): a, c, t, g, unknown or other
  misc_feature (663)..(663): n is a, c, g, or t
tcagacgctcgacacacgaccggtgctcgatttagtatctgatagttgggtttgggggtgggtccaggaggcagaactctgggtgtctcaccatggcctggatccctctacttctccccctnttcactctctgcacaggctctgaggcctcctatgagctgaaccncacgcccaccccgttggngtcaggtccgtccccgaggacacggaccggtcgaggactcacctgacttagtggacgtatcgactacgttcgaaccaaagactaattagtcgttatttaacgttacggtaaccgaggacctaaggaacgacccgaacgggtaccccaccgggtcccccttaggtcggtaccggttaggtactaagtaacgttaaacgaaaaggtacgaggttaggaaccggtaaccggccctacggaaggtccgtaccgtaggacgtcgttactttccgcgttaccggctacccggagtcctaggacggtaccaacgtacgtaccggttacgttacgaacccttagtacgtaacggggtcggtaacgttacccggaggtacaagggaacgtagtacggagactagtacttacgttacggataactacacggaacgacagacgtaacgagttacgggtttacggtttacgttttggggtacgtaccgggngggaccggtaacgtacgggtacctaccgggtaccgttaaccggtaccgtacggaccgtaccggtacggtccccgg

SEQ ID NO: 120660 - DNA, 969 bp, Homo sapiens
  misc_feature: GYAE6OF02I064T.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggaggtccggggagcttagttcagccgtgggggtccctgagactctccgtgtgcagcctcgtggtattcacctttcagtacgctacgtggatgcacgtcgggtaccgacaagtcctacgagggggaacgggtctggttggtacgggtctcgtaacgttaattaagtaggtacgtaagtaggggtaattaaccggactaaaccgtaaacggccgtttaaccgggaccgggttaaccccgtttacccggggttaacggggaaaaaccggggtaccccggttaacttttaaccccgggtaaaacccgttaaccgtttaccccggtttaaacccccggtaaaaggggaaacccggttaaaaaccccggtaaacccggtaaaaccccggaaaaacggttaaaaccccgaaccgggtaaccgttttacgttaaacgttacccggtaaacgggtaaaacctaaaaaacggtaaccgtaaaacccggttacggtttaaccggtaacgggtaaacgggaaccccgggaaccggggttaaaaccgggaaacccgttacccgggttaaccgtttaagggtttaggtttaaaaacccgtttggtacgggttaacccgaaagtaaaaacccggttagggtaaacgttaaccgggacgtaaaccggccgttaaaggggttcccgtaccgggtaacccggtcccggtaaacccgttttaccggggccgggggttaaaccctaaacccggggtttacccggtaaccgggttacccctaccccgggttaccttacccggttaccccggaccgtttaaccccccgg

SEQ ID NO: 120661 - DNA, 703 bp, Homo sapiens
  misc_feature: GYAE6OF02GY6AY.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctgggagatgcattgaccaaaagaccaatatgtcttattcggtaccagacagaacgccgacggccacggccccctgtcgcgtggtagtatataagtaaagacaggtcgaggacggccctagagggactcccgtgacgtactagtttcctcgtcggtcctccgagcctacggaacgggaaccaacgtacggtaccgtaacggttcgaaccctagtacgtaacgggttacggacggttaccgacgggaacgaaaggaaaggtagtacgggaggtacttacggaactttaacttaccgttagttacgtaacgtacgaacgtacgacgtaaccgacgtacgttaaggttacggttttaccggttttttcggggttacgggttccgggggtacggggtaaccgggtaaccgtaaccgggttccgttaccggtaaccccgggttcggttaaccgggtacccggtaacggaccccggtaaccgggttcccccgg

SEQ ID NO: 120662 - DNA, 692 bp, Homo sapiens
  misc_feature: GYAE6OF02H0HJA.2.38.D05.1.454.CMB.1.raw
  modified_base (355)..(355): a, c, t, g, unknown or other
  misc_feature (355)..(355): n is a, c, g, or t
  modified_base (429)..(429): a, c, t, g, unknown or other
  misc_feature (429)..(429): n is a, c, g, or t
  modified_base (458)..(458): a, c, t, g, unknown or other
  misc_feature (458)..(458): n is a, c, g, or t
  modified_base (492)..(492): a, c, t, g, unknown or other
  misc_feature (492)..(492): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggaggtccgggggagcttagtcagccgtggggggtccctggacgactctcctgtgcagcctgtggacttcctaccttcaggtacgctactggatcgactacgtcgggtcccgccaaggcctaccggaagggggaacggggtcgttgggtcggtgggttctacgtaggtaattaagtagtgagtgggatagcaanaagcgtaacggcgtactcggtaggacggcacgttccacgactcctcgaaggacacgaaccgacaaacgaccacncgttagactcgagaactaaagtcgaaacngttcgaagacggacggccgaacggacaccgggtnttaggtaactttagttacgtggtaacggacgaaagtagtaagaccgtaggaacgccgtacgggattacccggggtaacccggtaccgtaaccgggttaacccggggccgggggaaccccgttaaaaccggggtcccccggttacgggttaccccgaaccccggttttccctaacccggtacccgtacccgtaacccccgg

SEQ ID NO: 120663 - DNA, 630 bp, Homo sapiens
  misc_feature: GYAE6OF02HEY9C.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgccaaagcaatatgcttattggtacagcagaagccaggccacggcccctgtgctggtgatataataaagacagtgagacgccctagagggatacccgtgacgcgtaagtttctcgtggcctccagtctcgagggacaacgagtcacgttcgacctatcaggtggacgtccgaggacagaagataggaggtacaggtactagtttaccgttagtactaattacgacgacctaaggaccaacggtaccgttaagggttcgggtttttaacggtttttcggggtttacggtttccgggggtaaccgggtaaccggggtaaacctaaccgggtccggttaaccggtaccccggttacccggttaacgggtacccgaaccgggtaccccggtaagggtccccccgg

SEQ ID NO: 120664 - DNA, 730 bp, Homo sapiens
  misc_feature: GYAE6OF02IZPAH.2.38.D05.1.454.CMB.1.raw
  modified_base (140)..(140): a, c, t, g, unknown or other
  misc_feature (140)..(140): n is a, c, g, or t
tcagacgctcgacacacgaccggtgctcgatttagtatctgatagttggggtttgggggtgggtccaggaggcagaactctgggtgtctcaccagtggcctggactccctctacttcctccccctcttcactctctgcanaggctctgacggcctcctatgagctgacacgacgccctacccgtggtgtcagtccgtaccccgagggacacggaccggccgaaggactaccacctggcctcgtagggagtatgcctagttacgaccaaaagcaattactggttacttagttacggaaccgagacgaaacgaacgccgaaggccgtaaccggtccccgttaggtcggcgttggtagtaacttaagtaaacgtaaacgaacgtaggtacggacggtaccggaccctacggaacggtactccgtagacgtgtacttcgcgtcggtacctcgaacgtccgtaaccggaacggtaaccaaacgtacgaccgtacgttacgaaccgtcacggtaaggtcgggacgtaccggagaccgaacggaagagacggacggacttacgtagtatttaaccgttgtaactaacagaccgacgtagtacacggtaagttacgggttcggtttttaacgggtttggggttaccgggttaccgggacggggtaacgtaaccgtaacggttcccgaaccgggttaacccgttggtaccggttaccgaccccggacgtaacggtcccg

SEQ ID NO: 120665 - DNA, 792 bp, Homo sapiens
  misc_feature: GYAE6OF02JGOBC.2.38.D05.1.454.CMB.1.raw
  modified_base (584)..(584): a, c, t, g, unknown or other
  misc_feature (584)..(584): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctcggtgtcagtctccccaggacagaccggccaggactccacctgctcgtggagatgctattcggaaccaaaggactaaattatcgtactttagttcggtaacccagaccgaaggaaacgccgaacgggcccgaacgggtccccccttaggtcggtccgttagggtagtaattaattaaacgtaaaggaccgtaaggtaggaacggacggcccgtacggaagggtacctcccgtaggacggaccgtatttaccgccgtggtcccgtaccgtacgtaccgtacgaacggggtaaaccaaccgtaggttacccgtaccgttacggaacctacgttaccgaggttacgggaccgttaccggagggaacgaaacggtaagacgtagggacgtacgtaggttaacttagtttaccncggtttaacaacgttacgaacgacgaacggacctaaggttacccgtaaagggttttcgttttttaacgggggtttttcgggttccgggttacccgggggtacggggaacccgggttaacgaaccggggttttcgtaacccgggttaccccggtttaccggtaaaccgggttaccgtaacccggtacccggtaacggtttccccccggg

SEQ ID NO: 120666 - DNA, 830 bp, Homo sapiens
  misc_feature: GYAE6OF02IGKW4.2.38.D05.1.454.CMB.1.raw
tcagacgctcgacacacgaccggtgctcgatttagtatctgatagctgggttttccttgttgctattttaaaaggtgtccagtgtgaggtgcagctggtggaggtccgggggaggcttagttcagcctggggggtccctgagactctcctgtgcagcctctggattcaccttcagtagctactggatgcactgggtccgcagctcgagggagggctggtgtgggtctcacgttattaagtagtgagtgggagtagcaacaagccgtacggcggtacctccggaggaacgggccgtaattccaccgattcctacccgaggacgaaccgaaaccgaccgaaaaggaaacctaccggtacgttacggttaacgttacccgttagaaaccgtaaaacgttacggaaaaccgtaggtttaccgaggtaaacgggaccggaaccggaacgggtaccgtacccgggtacggtttgttaagtaacgtttttaaccgggttacgaaccggtaaagtacgtaagtacggacgacggtacctacgggtacgttaccgggtaccggacccgttaacggtaccgggttacgggggacccgtaaccggggtaaccctttcgggtacccgttacccgtccgttacccgtaccggtaccgtccccgtaaccccggaacccggtaacccgggtacccgttaccgtttccccggggttccccctttacccccggtaccgggcccccgttcccgtacggtaccccgtacccggaacggtaccgtacccgtaccccggttaccggaacgggaaccgtacccgaaccggtcgggtaccccggtacccgggg

SEQ ID NO: 120667 - DNA, 597 bp, Homo sapiens
  misc_feature: GYAE6OF02HEG3C.2.38.D05.1.454.CMB.1.raw
  modified_base (222)..(222): a, c, t, g, unknown or other
  misc_feature (222)..(222): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggaggtccgggggaggcttagttcagccgtggggggtccctgagctctcctgtgcagcctntgattccaccttcagtagctactggatcgctacgtcggtcccgcaacgcctacggaggggaagggcgtgggtggtgggtctcgtacgttattaataggtgagtgggagtagcaacgaagctacggcggtactcggaggaacgggcctacttacacatcctacagacgaacgaaccgaccaaagaccacgtctagtactctagaactaaagtacgtaacacgtgtacggaaggacggcggaacggaccgacggtgttcgtagttacgttacgtggtagacgtaagagacgtagcgagcgagtcgtacgaccgaccgcgtaccggcgggaacccgacggtaccgtaccggccgtacccgttctccgtcaccgtaccc

SEQ ID NO: 120668 - DNA, 735 bp, Homo sapiens
  misc_feature: GYAE6OF02IBR9K.2.38.D05.1.454.CMB.1.raw
  modified_base (650)..(650): a, c, t, g, unknown or other
  misc_feature (650)..(650): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttggctgagtcttgggttttccttgttgtcttaattttaaaaggtgtccagtgtgaggtgcagcgtggtgggaggtcccgggggaggtctttaggttcacggtccgtggggggtcccctgaacggtacctccttcctgtcgctacggccttcgtggtactttcctaccctttcgagttcgacgttacgttggattcggacgtacgtcgggttccgacacgcgtccggaaggggacgggcgttgggtgtcggtctacgtacgttaattaagtagtacgaggttacgggtaagtacggtacaacgaacggtccgtaacgggaccggtaaccgttccggtaacggaaacggggtcccgtacgttaccgtaaaccctacgttcccgtaaccgaaggaaaccggtaaccaaacccggtaaccgaaaacgaaacgtacccgcgtttagtaactccgtttagaaccttaaaggtcaaacgtcgttaacgcgtaaggcgaccggtacgaaccgacgtacgtaggttnttaacgttcgttgagtacgaaagtaggtaactacggaccagtcgaacgtcggttaacccggaccgtacccggtagtaacccgggg

SEQ ID NO: 120669 - DNA, 651 bp, Homo sapiens
  misc_feature: GYAE6OF02H3RPM.2.38.D05.1.454.CMB.1.raw
  modified_base (261)..(261): a, c, t, g, unknown or other
  misc_feature (261)..(261): n is a, c, g, or t
  modified_base (344)..(344): a, c, t, g, unknown or other
  misc_feature (344)..(344): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtgggggggtccctgagactctcctgtgcagcctctggattcaccttcagtagctactggatgcacgtgggtccgcaagctccgaggggagggctggtgtggtctcacgttattaatggtgagtgggatagcaanaagcgtacgcggacctcgtggaaggccattcaccatcaccagacaacacgacaaagacacgctgtactctagacaaatgaacngtactgagacgaccgaggacgtacggctaatgtaactttacgacgttgaacgaaggtacgaagtagacgagacgacgtcgtacggtaccggtaccgtacgtacggtacggggacccggtaacgggtaaccgtaccggtaccgtacccggtcccgtccgtaccgtaccgtacccgaacccgaacccggaccgggtacccgtaccgtccgttaccccgttccccgtccggcccgtccccgtcggcccgtaccggaccggtacgacccgacccgtccggacgacgtaccaccggtaccggcccgtcccgg

SEQ ID NO: 120670 - DNA, 811 bp, Homo sapiens
  misc_feature: GYAE6OF02FSIUN.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagtcgttgggttttccttgttgcttaagttttaaaaggtgtccagtgtgaggtgcagcgtgggtggaggtccgggggaggtcttagttcacggccggtcggggggtccctgagacctctcctgtgcagcctcgtcggtacttcaccttcagtacgtctacgtaggatgaccgtacgttcgggtccccgaccgaacggtccgtaccgggaagggggtaacggggtcggttggggtgggttacgggttccgttaccgtaacggtttaagttaaaggtaggttagggtaggttagggggaacgttaacggaccgtaacgaaacgtaccggtaaccggtaccgggtaaccgtacccgggttaggggaaaccggggtacccgtaacgttacccgaacgtaccgttacccgtaaccgaaggaacccgtaaacccgaacccggaacccgaaaacgtaaacccgaccggttactaggttaacctccgtagtaaacctaaagtaacgtaaacgtacgtcgtaaggacggaaccggtacccggaacgggtacccgacgggttcgttaggttaacgttaacgtttaccggcggtaacgaaccgtaaagggagtaaatacccgggtacaaggtcctaaacgggtccggtaaaccgggtacccgtaccggtaccgtaaccggggg

SEQ ID NO: 120671 - DNA, 766 bp, Homo sapiens
  misc_feature: GYAE6OF02IJ4Z4.2.38.D05.1.454.CMB.1.raw
  modified_base (279)..(279): a, c, t, g, unknown or other
  misc_feature (279)..(279): n is a, c, g, or t
  modified_base (286)..(286): a, c, t, g, unknown or other
  misc_feature (286)..(286): n is a, c, g, or t
tcagacgctcgacacacgaccggtgctcgatttagtatctgatagttgggtttggggagccccagccctgggattcccagctgtttctgcttgctgatcaggactgcacacagagaactcaccatggagtttgggctgagcgttgggtttttcctttgttgcttaattttaaaaggtgtccagtgtgaggtgcagctggtggaggtccggggagcttagtcagccgtgggggtcctgagctctcctgtgcacgcctcgtgtacttcaccttcgagtacncttacgnggatgctacgtcgggtcccgaccaacgccgttaccggaagggggaacgggtcgttggggtcggttgggtctaccgttaacgttaagtttaaacgtaggttaggtaggtaggggaagtacggactaacgaacggtcctaacggaccggtaccgttccgggtaggaacggggtcctaacgtttacccgaacccacgtttacccgaacccgaagggtaaccgaaacccgtaaacccggaccaaaaacggacccgtaacggtccgtttagtaacttccgtaaggaaacctaaaagttacggaaacgtacgttctagggaacggtacggacccggtaagggaccctaacgggccgttttaaggttactttaacgtttacggtaggtaacgaacggtaagacgggtaacttagggaccgttaacggcccggtaaggttaccccggttaacggggtaccccgtacccgggtaacgggttaccggggg

SEQ ID NO: 120672 - DNA, 707 bp, Homo sapiens
  misc_feature: GYAE6OF02GLFXP.2.38.D05.1.454.CMB.1.raw
  modified_base (264)..(264): a, c, t, g, unknown or other
  misc_feature (264)..(264): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcgtgggttttccttgttgcttaattttaaaaggtgtccagtgtgaggtgcagcgtggtgggaggtccgggggaggtcgttagttcagccgtgggggtccctgagacctctcctgtgcagcctntggacttcaccttcagtagactacgtggatcgcgacgtcgggtcccaccgaacgccgtaccggaaggggacggggtcgtgggtggtcgggtctcgtaacgttaattaagtagtgagtggggtagtagacaagaagcgtacggcggtacgtacggtaggaacgggccgtattaccacctactccgtaccgaagacaacgaaccgaccaaacgtaccgacgtctagtacttactagaaacgaactacgaaacctagggttaccaagggtaacggaaccggtccgggaaacgggtaacccggtacgggttacttaggtttaacgttaacgttttacgtaggtaacggtaacgaaaacgggtattaaacgggtacgtaacgacggttaacggacggttaccggttaccgggtaacccgggtaccccggtaacggtttaacccggggg

SEQ ID NO: 120673 - DNA, 824 bp, Homo sapiens
  misc_feature: GYAE6OF02F1SXF.2.38.D05.1.454.CMB.1.raw
  modified_base (199)..(199): a, c, t, g, unknown or other
  misc_feature (199)..(199): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcacgtgggtccnccaagctccgaggggagggctgggtgtcgggtctcacgttattaagtagtgagtgggagtagcaacgagctacggcggactccggtaggaacgggccgtattccgacctattcctaccgaggaacgtaccaacggaccaaaacgaacctaccggcttagtactcgtacgaactaaagtgaaaccgtgttcgaggtagacggtcccggaacgggaccgtacgggtcgtttaggtaacgtttacgttacgtgtacggaactaaaggtacggtaacgtacggtacgaacggtacgtaacggtcggttaccgggtacccgtacccggtaacggttacccgggtacgggggaacccgtaaccggggttacccgttaccgggtacccgtacccggttcccgtaccgtacccgtaccggtacccctaacccggaacccgggtacccgggtaccccgttaaccggttccccggtttaccccgttcccccgggtaccggtccccgggtaccccggttaccggtcccggttaacccggaacccgggtacccgtaccccggtaacccggttcccgggaaacgggtacccggacccgtaacccggggtaccccgggtaccccgggttacccccgggg

SEQ ID NO: 120674 - DNA, 639 bp, Homo sapiens
  misc_feature: GYAE6OF02GTXAC.2.38.D05.1.454.CMB.1.raw
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (476)..(476): a, c, t, g, unknown or other
  misc_feature (476)..(476): n is a, c, g, or t
  modified_base (582)..(582): a, c, t, g, unknown or other
  misc_feature (582)..(582): n is a, c, g, or t
tcagacgctcgacacacgaccggtgctcgatttagtatctgatagttgggtttgggggagccccagccctgggattcccagctgttctgcttgctgatcaggactgcacacagagaactcaccatggagtttgggctgagctgggttttccttgttgctattttaaaggtgtccagtgtgaggtgctagctggtggagtccgggggagcttagttcagccgtgggggtccctgagactctcctgtcgcagcctgtggattccaccgttnaggtacnctacgtggatgactacgtcgggtaccgccaaggtcctaccgaaggggtacgggcctgggtagtgggtactcgtaacgttagttataggtcgagtggggactagcaacaggctacggcggactcggtagaacgggtccagttccaacgtacgtccgtaccagtaacgacgaaccgaccgaaacgtaaccacgtctagtacncttagaactaaagtcggaaacctgttaccgtagggaaccgacgggtaaccgaacgggtacaccggggtaccttagtacgtacttacggtcgacgtaacgaaggtanaggtaacaccggtagaccgtacggaccgttagggtaccgacccgtagtaacccgggg

SEQ ID NO: 120675 - DNA, 738 bp, Homo sapiens
  misc_feature: GYAE6OF02HTWE8.2.38.D05.1.454.CMB.1.raw
  modified_base (584)..(584): a, c, t, g, unknown or other
  misc_feature (584)..(584): n is a, c, g, or t
tcagacgctcgacacacgaccggtgctcgatttagtatctgatagttgggtttgggggtgggtccagggaggcagaactctgggtgtctcaccatggcctggatccctctacttcctccccctcttcactctctgcacaggctctgaggcctcctatgagctgacacacgccacccgtcggtgtcagtcgtccccaggacacgaccggaccaggactacaccttgacctcgtagggagatgactagttcgaccaaaagacaaattactgtactttaagttcggtaaccagtacaaggaacgccgaggcccgaccggccccctaggtcgtcgtaggtacgaataagtaaagtaaaacgaactaggtagaacggtaacggtcccgtacggaacgggtacttcccggtagacggcgttactttctcgtcggacctaccgacggtactacggaacgggaaccaacgtacgtaccgtacgttacgaaccgtataaccggtaaggtacgggacgtaccgaaggacaaggaacgttaggacggtaggacgttaacgaccttaagttactacgttaacgaactacgaacganaacgaccgaggttacgtagggttttacggttacgggttttttacggggtacgggttccgggaaccggggttaaccgaccgtaaacgggtaccgttaccggtaaccccggttacggtaaccggttaccgaacccgggtaccccgtaagggtcccc

SEQ ID NO: 120676 - DNA, 722 bp, Homo sapiens
  misc_feature: GYAE6OF02JS1V5.2.38.D05.1.454.CMB.1.raw
  modified_base (226)..(226): a, c, t, g, unknown or other
  misc_feature (226)..(226): n is a, c, g, or t
  modified_base (326)..(326): a, c, t, g, unknown or other
  misc_feature (326)..(326): n is a, c, g, or t
  modified_base (401)..(401): a, c, t, g, unknown or other
  misc_feature (401)..(401): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagcccaccctcggtgtcagtcgtccccaggacagacggccaggactcacctgctacgtggantcgctattcgaccaaaagcaaagtatagtctttagttacggtaccaggtcaagaacgccgaggaccacgggccctggtcgcgtaggtgtaacttagtaanaagtacgagtaggacggacggcccttacggagggtactaccccggtggaacgtcgttaatttctcgtcggtaccnccgacgtacgtacggaaagggaacccaaacgtaccgtccgtaacggttacgtaaacccgtactacggtaacgggttcgggaacccggttacgaacgggtacaagggtaaacgtgttaacggcggtacgtacgtaaccgttattaccgttaggtaacctacgttaaccgaggtaccgtaacacgtacgttacgtacgggttttacggttttagggttttcggggtacggtacccggggtaacggggtaacgtaaccgtaggttcccggttaaccggacggtttaccgtacggtacggtaccgtacccggtaacgtccccggg

SEQ ID NO: 120677 - DNA, 721 bp, Homo sapiens
  misc_feature: GYAE6OF02H4BME.2.38.D05.1.454.CMB.1.raw
  modified_base (197)..(197): a, c, t, g, unknown or other
  misc_feature (197)..(197): n is a, c, g, or t
  modified_base (533)..(533): a, c, t, g, unknown or other
  misc_feature (533)..(533): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacncgacggccaggactccacctgctcgtaggagtatcgctaagttcgaccaaagcaattacgtgtactttattggtaaccagcaaggaacgccgacggccgacggcccctggtcgcgttggtgtaatatagttaaaagacgaaggttgacggtaccggaccttcgaacggggtaccttacccgaggacggtccggtaacttttccgtaccgttcggtccgtcccgtagacctttacggaaacggggtaacccaaacgtaccgtaccgttaacggttaccgaaccgtacgtactacgggtacggtaaccggttacgacggactaaggaagagtgacggntacgaacttacgtaactcgtactaacgtacacggaactaacggactaggacttaacgggtttcgggtttttaacgtttttgggggttccggttacgggggtaacgggtaaccgggtaccggtaaggtcctaacccgggttacccgtaccggttacggtacccgaaccggtacccgacgggtaccccgg

SEQ ID NO: 120678 - DNA, 795 bp, Homo sapiens
  misc_feature: GYAE6OF02H31KJ.2.38.D05.1.454.CMB.1.raw
  modified_base (337)..(337): a, c, t, g, unknown or other
  misc_feature (337)..(337): n is a, c, g, or t
  modified_base (545)..(545): a, c, t, g, unknown or other
  misc_feature (545)..(545): n is a, c, g, or t
tcagacgctcgacacacgaccggtgctcgatttagtatctgatagttgggtttgggggagccccagccctgggattcccagctgtttctgcttgctcgatcaggacctgcacacagagaactcaccagtggtagtttgggctgagcgttgggttttccttgttgcttaattttaaaaggtgtccagtgtggtaggtgcagcgtgggtgggacggtccgggggaggtcttaggttcaggtccggtggggggtccctggacgactccgtctggtgcacgcctgtggtacttcctacctttcgagtacgctaacgtggaatgcgtacgtcggggtacccncgaaccgtccgaccggaaggggggtaagggtcgtagggttgtcgggtacttacgtaacgttaagtttagtaggtaggtaacggtgggagtacgactaagaagccgtaacggccggtacgtacggacgggtaacggggtaccgtacgtaccgtaaccctagtccctacggaaacgtaccgaacccgaacgtaaccgaaacgttaaaccnccggtacttagtaacctacgttacggaaacctaaggttacgaaagtacgttaccgtagggaaaccgtccgggacgtaaacggtacccgtaaggggttccttagggttaccgttaacgttttcggtaccggttaacggtaaccgaaagggtaaccggttaggtaaacccggtacgaccggggtaacttacgggttacccgggttacccggggtttaacccgaccccgggttaaaccggtttcccggggggg

SEQ ID NO: 120679 - DNA, 707 bp, Homo sapiens
  misc_feature: GYAE6OF02GZQ3Q.2.38.D05.1.454.CMB.1.raw
  modified_base (501)..(501): a, c, t, g, unknown or other
  misc_feature (501)..(501): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtcccgaggacaggaccggccaggactcacctgtctctagggagatgctattgaccaaagcaatatgtacttagttacggtacaggacaagaacgaccgacggccgacggccctgtcgacgtggtacgaataagtaagtaaagacgtaggtacggacgacggccctacggacggtactcccgtaggacgtacgtactttcgtacgttcggctaccgacgtcgtacggacgaacctaacggtcgtaccgtaccggttacgaacctagtaccgaggtaggtaccgtaccggagggtacctaaaggactaggttaacggngttagttacgacgttaaactttcggacttaactacggacctaggtaacgtacgtaacgtacgtaggtttacggtttacgggttttacggtttcggggggtacggttcggggaaacggggtaccgggtaaccctacgggtaccggttacccggttaccggttaccgggtacggttacccggaccggtacccggtacggtacccccgg

SEQ ID NO: 120680 - DNA, 716 bp, Homo sapiens
  misc_feature: GYAE6OF02GCMZO.2.38.D05.1.454.CMB.1.raw
  modified_base (456)..(456): a, c, t, g, unknown or other
  misc_feature (456)..(456): n is a, c, g, or t
  modified_base (516)..(516): a, c, t, g, unknown or other
  misc_feature (516)..(516): n is a, c, g, or t
  modified_base (525)..(525): a, c, t, g, unknown or other
  misc_feature (525)..(525): n is a, c, g, or t
  modified_base (543)..(543): a, c, t, g, unknown or other
  misc_feature (543)..(543): n is a, c, g, or t
  modified_base (574)..(574): a, c, t, g, unknown or other
  misc_feature (574)..(574): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggaggtcttagtcagccgtgggggtccctggagactctcctgtgcacgcctcgtggtacttcctaccttcgtaagtacgaccttacgtggtagtgccgtaaccggtcgggtcccgaccgaacgtccgtaccggaacgggggaacggggtccggtgggtgggttacggtcctacgtaacgttaattaagtaggtaggaaggttgggagacgacaacgtaacgacgtacggaccggtaacgtccggaggtacggtacgtactaccaactactaccgacgacgaanacgaacgaaccgaaacgaaccgacgtacgtagtactccgtaagaacaaagtcgaaacttnaccggtaanacggacgcggaaggtacncgtgttagtacgtataccgtgagaataacgntaagccagtacgcgtacgtaacggttcccggaaggaccccgttaacgggtcccgggaaccgggggttaaacccgaaccggggttaaccccggttcgaacccgttcccgttaccgccccccgtaatacccccggggaaccccc

SEQ ID NO: 120681 - DNA, 609 bp, Homo sapiens
  misc_feature: GYAE6OF02JV0PX.2.38.D05.1.454.CMB.1.raw
  modified_base (484)..(484): a, c, t, g, unknown or other
  misc_feature (484)..(484): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggaggtccgggggaggcttagttcagccgtgggggtccctgagactctcctgtgcagcctctggattccaccttcgagtagctacgtggatgcacgtgggtccaccgaagcctaccgaaggggaagggtctgggtgtagggtctacgacgttaagttaagtaggtgagtaggggagtacgcgaacgaagtcgacggtccggacgtcggtaggaacggcctattaccacctactcacgagacgacaacgacaaggaccaacgtctagtactcgtagaactaaagcgaaacgtacttacgaggataccggcggaagaccgacgtntgttacgtacttacgtgacgtacgaaacgtagacttcgagacgtacgagtcgacggtacaccggtacgttacggcggtaaccgaccggtaccgtcgaccgtccgttacgccctacgccctacccg

SEQ ID NO: 120682 - DNA, 579 bp, Homo sapiens
  misc_feature: GYAE6OF02JCTIV.2.38.D05.1.454.CMB.1.raw
  modified_base (392)..(392): a, c, t, g, unknown or other
  misc_feature (392)..(392): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtgggtccgccaagcctccgaaggggaagggctgggtgtgggtctcacgttattaatgtgagtgggagtagcaacaagctacggcggactcggaggaacggccgtattccactatcctacagacgacaacgcaaagaccncgctgtactctgacaaagtcgaaactgtactaggaagtacgaccggtaaggaccgacggtctgttacgtactttacgtgttacgcgtaaaggagtaagtacgactggaacaggtcgtacggaccaccggtacgttacggcggggaaccacgggtaccctggacctaccgtcctcctcgacgtccccg

SEQ ID NO: 120683 - DNA, 685 bp, Homo sapiens
  misc_feature: GYAE6OF02IZLSD.2.38.D05.1.454.CMB.1.raw
  modified_base (155)..(155): a, c, t, g, unknown or other
  misc_feature (155)..(155): n is a, c, g, or t
  modified_base (229)..(229): a, c, t, g, unknown or other
  misc_feature (229)..(229): n is a, c, g, or t
  modified_base (418)..(418): a, c, t, g, unknown or other
  misc_feature (418)..(418): n is a, c, g, or t
tcagacgctcgacacacgaccggtgctcgatttagtatctgatagttgggtttgggggaagaggaagactgacggtcctgccacaggtggtgcgtgggcacggtgggcactcgacacaacattttgcgctcaactgtcttgtccagtgtgaggtncagctggtggagtccgggggagcttagttcagccgtggggggtccctgacgactctcctgtgcagcctcgtgtnttcaccttcagtagctactggatgcacgtcgggtccaccagctccgaagggacggggctggttaggtggtctcgaacgttattaagtgtgagttgggatacgcacaagtcgacgcgccgtcgaggacggcgtattccaaccgtatcctacgtaaggagtaaaccgaaccgacccgaaaacggtaaaccnccgtacgttacgtactttaccgaaggttaaccaaaggtacgaaactacgggtttcgaacgggaacgaaccggcggttaaaggaacccgacgggttaccttgggttaaaccttaggtttacccgttagcgtaaaggtaaaggtagagttagaccgacgtaacgcgttacgtacgggtaccgaccggtaacttccggggagggaaccccgtaaccgggacccgtttcgggttaccctaccggttccccgtattacccgacggttacccc

SEQ ID NO: 120684 - DNA, 681 bp, Homo sapiens
  misc_feature: GYAE6OF02IT4HN.2.38.D05.1.454.CMB.1.raw
  modified_base (263)..(263): a, c, t, g, unknown or other
  misc_feature (263)..(263): n is a, c, g, or t
  modified_base (420)..(420): a, c, t, g, unknown or other
  misc_feature (420)..(420): n is a, c, g, or t
  modified_base (498)..(498): a, c, t, g, unknown or other
  misc_feature (498)..(498): n is a, c, g, or t
tcagacgctcgacacacgaccggtgctcgatttagtatctgatagttgggttgggggaagagaagactgacggtcctgccacaggtggtggctgggcacggtgggcactcgacacaacatttgcgctcaactgtcttgtccagtgtgaggtgcagctggtggagtccggggagcttagttcagcctgggggtccctgagactctcctgtgcgagcctcgtggacttcacctttcaggtacgctactggactgctactggtccnccaagctccagggaagggctggtgtgggtctcacgtataagtagtgatgggactagcacaagtctacgcggactccggtgaaacggtccgaattccgaccagtcctaccagacgaaccaacggcccaaaggaaccacgggcttaggtacttacctanaccaaaacgttgaaactcgttaccagggtagaactccgggaaaggacctaacgggctacgggttagtacgtttaacgnggttaacgaccgtaaaaggtagtaacgttacgtaaccaaggttccaaacgggtcccgtttaggggaacccggtacccgggttaaccgttaaaccggggtccgggggtaacccctaaaggggggtttaaccccctggggttaacccctaaccccggttcggttaaccctccgaaccggtccccg

SEQ ID NO: 120685 - DNA, 529 bp, Homo sapiens
  misc_feature: GYAE6OF02IYRPL.2.38.D05.1.454.CMB.1.raw
  modified_base (465)..(465): a, c, t, g, unknown or other
  misc_feature (465)..(465): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (494)..(495): a, c, t, g, unknown or other
  misc_feature (494)..(495): n is a, c, g, or t
  modified_base (502)..(502): a, c, t, g, unknown or other
  misc_feature (502)..(502): n is a, c, g, or t
  modified_base (520)..(520): a, c, t, g, unknown or other
  misc_feature (520)..(520): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcacgtcgggtccgaccaagcctccggaggggaaggggcgtgggtggtgggtctcgtacgtattaagtaggtagagtgggagtagacacgaagcgtacgcggactcgtaggacgggccgtatccactatccacaagacaacaacgccaaagacacgctgtactcagacaaagtgaaacagtnaggagacgcgaggacncggntgtntatgnngacaagnatgcagcagcgtggaccncgatacggg

SEQ ID NO: 120686 - DNA, 667 bp, Homo sapiens
  misc_feature: GYAE6OF02I202Y.2.38.D05.1.454.CMB.1.raw
  modified_base (309)..(309): a, c, t, g, unknown or other
  misc_feature (309)..(309): n is a, c, g, or t
  modified_base (391)..(391): a, c, t, g, unknown or other
  misc_feature (391)..(391): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccacctcggtgtcagtcgtcccaggacagacggccaggatcacctgctcgtggacgtatcgctattcgaccaaagcaatatgtcttattacggacctagcaagaacgccgacggtccacgggccccttggtcgcgttgggtanattaagtaagtaaaacgaccgtaggttggaacggtaccggtccctagggacgggtacctccgtggaacgtccgtaatttccncggtacggcccttaccgacgtccgtacgaacgggtaacctacggtacgttcgacgtttcgaactacgtcgaaggtcggacgtccgaggacaagaacgtagttacggacgttagtacgtaactttactcgtactaccgtaagtccgagaccgaagtacgtaacgtcgttagggtttacggttttacggttttggggacgttacgggacgggtaacggtaccgaacgtcgtaccggtaccgttccgtaggtacccgtaccgtaccggtacgtccccgg

SEQ ID NO: 120687 - DNA, 611 bp, Homo sapiens
  misc_feature: GYAE6OF02HDSRS.2.38.D05.1.454.CMB.1.raw
  modified_base (266)..(266): a, c, t, g, unknown or other
  misc_feature (266)..(266): n is a, c, g, or t
  modified_base (282)..(282): a, c, t, g, unknown or other
  misc_feature (282)..(282): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcggtggtttcgtgtaggctatttaaagtgtcagtgtgaggtgcagcgtggtggagtccggggagtcttagttcaggccgtgggggtccctgagactctcctgtgcagcctcgtggattcaccttnagagtctactgatgcngtcggcgcaagctcgagggacgggcgtgggtgtcggtctcgacgtattagtagtgtagtgggagtgacgaagacgactaacggcgtacgtccggtaggtacgggccgtattacgaacntcctcgaagganacccgaaacgacccgaaaagaccacggtaccttaggtaaccttcgtagactaaacgtagaactagttacgaggtaccggagacccggaggaaccgtcgggttactcggttaagttacttagttcggtaagaccggaaggacgtaacgtagccgtaaacgcgtacggtacgtacgggtaccgtccggtaacgtaccgggg

SEQ ID NO: 120688 - DNA, 810 bp, Homo sapiens
  misc_feature: GYAE6OF02HYGXH.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggccttctatgagctgacacagcccacctcggtgtcagtcgtccccaggacagaccggccaggactcacctgctcgtggagtatgctatcgaccaaagctaatactagtcttagttcggtaaccagacgtaagaacgccgacggtaccgacggtccccgttgtcgcgttaggtacgtaagttaacgtaataaaacggacgaagggttacggaacggtaccggtcccgttacggaacggggtaccttcccgtaggaacgtacccggtattttcccgtacgtaccgggtccctaccgtacggtaccttaacggaaacgggtaacccgtaaaccgtacggtttaacccgtaccgggtttaccgaacccgttaacggtaccgtaaggggttccggtaccgtaaccgggtaacggacccggtaaaggaaacggtaagtacgggtaacgtacgtaacgttaacttaacgtttacgttacgtaacaaacgtcgaacgtacgaaccgtaagtacgtacgttaacggtttacgggttttacgtttttacggggtgggtttaaccggggacggggttaaccgggtaaccgttaacggggttacccgtacgggttaccccggttaccggttaacggtaaccccggttaccggaacccggttaccgggttacccccgg

SEQ ID NO: 120689 - DNA, 712 bp, Homo sapiens
  misc_feature: GYAE6OF02HRV3O.2.38.D05.1.454.CMB.1.raw
  modified_base (178)..(178): a, c, t, g, unknown or other
  misc_feature (178)..(178): n is a, c, g, or t
tcagacgctcgacacacgaccggtgctcgatttagtatctgatagttgggtttgggggtggtccaggaggcagaactctgggtgtctcaccatggcctggatccctctacttctccccctcttcactctctgcacaggctctgaggcctcctatgagctgacacagccaccctcggtntcagtgtccccgaggtacacggacggccaggactcacctgccttctgggacgtatggctagttcgacctaaagcctaaattatgtacctttagttcggtaaccagtaccaaggaacggtccgaacggtcccacggggtccccctggtccgtcgtggttacgaagttactaaacgtaagtactaggtcgaacggacggtacccctcgacggggtactcccgtaggacgtcggtattccgtgtcggtaccttccgacgtcgtacgacggtacaacgtacgtccgtaacggttcgaacctataccggaaggttcggtacgtaccgacggtacgaagtaacgaggtcggtacgcgttagtaacgtacttaccgttagttacgaacgttacgaccgtacgaacgtacgacgtacgtacggtttacggtttcgggttttacggtcgggttaccgggcggggtaacccggtacggtaacggttccgaaccggtttcccggtacggtaccggttacccggacggacccgttaaggtccccgg

SEQ ID NO: 120690 - DNA, 770 bp, Homo sapiens
  misc_feature: GYAE6OF02INVIV.2.38.D05.1.454.CMB.1.raw
  modified_base (622)..(622): a, c, t, g, unknown or other
  misc_feature (622)..(622): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacacgcccacccgtcggtgtcagtccgtaccccgaggacaggaccggccgaaggactccacctgcctcgtggagagtcgctattcggaaccaaagactaattctgtactttacgttacggtaccagacgtaaggacgcccgacggacccgaccggtcccccttggtcgtaccggtttgggtagtaacgttaagttaaacgtaaaacggtaccgtaagggttacgggaaccgggttaccgggtccccgttaacggaaccggggttacctaccccggtaggtaccggtacgttacgtttccgtcgtccgggtacccttacgacgtaccgtacggaaacggaacctaaacgtacggtaccgtacgtttacgaaccgtagtacggtaggtacggtacgtccgaggtacgaaggtaaggtgtacggtacggtacgttacgttaaacgttgttacgttaccgtanaacgttacacgacgtaacgacgtacgtacggttaaggtttcgttttacgggtttcgggttcgggttacggggaaccgggtacggtaacgtcggaccgttaccggtacccgttacggtacgtacccgaccgggtaccggaccgtcccgg

SEQ ID NO: 120691 - DNA, 952 bp, Homo sapiens
  misc_feature: GYAE6OF02I881J.2.38.D05.1.454.CMB.1.raw
tcagacgctcgacacacgaccggtgctcgatttagtatctgatagctgggttttccttgttgctattttaaaaggtgtccagtgtgaggtgcagctggtggaggtccgggggaggcttagttcagccgtgggggggtccctgagactctcctgtgcacgcctctggattccaccttcagtagctactggatcgcacgtcgggtcccgaccaagcctccggaaagggggaacgggggtcgttgggtggtcggggtcctacgtaacggttaaatttaagtaggtgtaacggtggggtaagtaggaccaacgaaacggtaccgtaccggaccgggtaaccgttcccgggtaagggaaaccggggtccgtaacttacccaacctaacgttcctaaccgaaggaacgaaccgaaccgaaccgaaacggaaaccgaccgtacgttacgtactaccgtacgaaactaaaagacgtaaacgtagttcgtaaggagggaccgggaaccgggtaacggaaccgtaccgggtacgttacggttaacgtttaaacgtttcggtaaggttacggaacgggtaaaacggaggtaaacgtacggacgtaaccgacgtaacgggtaccgggttaccgggtaacccggtaacccgggtaaccggtaacccgggtaccggggggtaacccggtaaacccgggggttacccggttaccgggttaccccgttaccccggttcccgttacccggtacccgtacccgaacccccgttaaccccgggaaaccccgggtaacccgggtacccccgttaacccgggttttcccccgttacccccggttcccccggtcccgggtaccccgtcccggttacccgtacccggtaacccgtaacggggtaccccgacccggtaccccggtaacgggacggaacccggtacgacccgggaccgggtccccgggtaccccggg

SEQ ID NO: 120692 - DNA, 845 bp, Homo sapiens
  misc_feature: GYAE6OF02G5FCY.2.38.D05.1.454.CMB.1.raw
  modified_base (492)..(492): a, c, t, g, unknown or other
  misc_feature (492)..(492): n is a, c, g, or t
tcagacgctcgacacacgaccggtgctcgatttagtatctgatagttgggtttgggggagccccagccctgggattcccagctgtttctgcttgctgatcaggactgcacacagagaactcacatggagttgggctgagcgttgggttttccttgttgtacttaagttttaaaaggtgtccagtgtgaggtgcgagcgtgggtggaggtccgggggaggtacgtttaggtcgtacggtccggtcgggggtcccgtggtaccgtacgtccgtccgtggtgccgtacgtccgtcgttaggtacctttacctacccgttacgaacggtacggtaccgttacgtaggtacgttcggaccgtacggttccggggtaccccgacccaaacggtccccgtaaccgggaacgggggtaaccggggtcggttgggtacggttcggggttccgtactaacggttaattaagtacggtaggtaggtgggtacgtacgacgtanaaggtccgtacggtacgtaccggtacggtaacggacgggtcccgtaactccgaaccgtactaccgaccgtaaggaaaccgtaaccgaaccccgggaaacaaaacgaaccgtaccgtaacgtacgttacgtaccgtaaggtaactaaagtacccgaaagttcggtaacgttagggaacgacccgggtaaccggacggtaacccgggacgttggttaaaccgttaggtttaaacgttacccgtggtaaaccggtaacggtaacggtaaacggtacttaagggaaccctacggaacgtacggggttccccggttaaacggggttacccgaacccgttaacggggttaaccccgggg

SEQ ID NO: 120693 - DNA, 888 bp, Homo sapiens
  misc_feature: GYAE6OF02HWLAE.2.38.D05.1.454.CMB.1.raw
  modified_base (814)..(814): a, c, t, g, unknown or other
  misc_feature (814)..(814): n is a, c, g, or t
  modified_base (850)..(850): a, c, t, g, unknown or other
  misc_feature (850)..(850): n is a, c, g, or t
tcagacgctcgacacacgaccggtgctcgatttagtatctgatagttgggtttgggggagccccagccctgggattcccagctgtttctgcttgctgatcaggacctgacacacgagaacgtaactccaactagtaggtggttgggctggacgtcggttttcgggttttccgttggttacgtacttttaaaaggttttaaacgggtccgtaccgtaggttcggtaggtagggtcgacgtacggtcgggttaggggtacgggtaccgggggtaccggggggtagttaccgttttaacggttccggaaccgggttcccgggggttaccggggggttccctaagggtaaccgttaccctttccttcggttcggtacgccgtaccggtccttcggtaggttaaccttccgttaacctttcggaacgttacgtaccgttacggtaggtaccgtcggacggttaccggtccgggtacccaaccgtaaccggtccggtaacggggtaacgggggaacgggttcggttagggttacggtcgggttacctacggttaacgtttaagtttaaagtcgggtagcgggttaaggggtactacgtaaccaacgtacgtaccgacggaccggtacgtacggtacgggaccggtactactaccaccgttactccgtaccaagggaaaccgtaaaccgaaccgaaacgtaaacgaaccgccggttacgttacaccgttcgtacgaaagttaaaccgtagaaccgtgtacgacgggtaacgcggtaaccgaacgggaccgtcgtcgttagaacgttacgttagtcggtaanacggaagttacgagttaaccgcggtaagtacccggnggttaccggaccgggtaaccctcggaacggtaccgggg

SEQ ID NO: 120694 - DNA, 788 bp, Homo sapiens
  misc_feature: GYAE6OF02IMQMS.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgacggcctcctatgagctgacacacgcccacccgtcggtgtcagtcgtccccaggacaggaccggccaggactccacctgctcgtggagatgactattcgaccaaagcaatatcgtactttagttacggtaccagacaaggaacgaccgacggccgacgggcccctggtcgcgtggtgtaattaataaacgtaaagactaggtagacggacggtccctaggacggggtactacccgtggacgtcgtactttccgtacgtcggtccctaccgagtccgtacgaacgggaaccaacgtacgttaccgtaacggtttacgaacctacgtacggtaacggtcgggtaacgttaccggacgggacgtaaaggaacggtaggtacgggtaacggtacgttaacgtaaccgtttaagttaccggttacgttaaccgttaaacgtaccggaaacgaccggtaacgtaaccggtaacggttacggttagggtttttacgggtttttacggggtttttttcggggggtacgggtttccggggggaaccggggttaaacgggtaccgtaaacgggttccggttaacccggtaccccgggttaccggttaccggttaacccgggttaccggttacccgggaacggtttacccccggg

SEQ ID NO: 120695 - DNA, 653 bp, Homo sapiens
  misc_feature: GYAE6OF02F6SXJ.2.38.D05.1.454.CMB.1.raw
  modified_base (380)..(380): a, c, t, g, unknown or other
  misc_feature (380)..(380): n is a, c, g, or t
tcagacgctcgacacacgaccggtgctcgatttagtatctgatagttgggtttgggggtgggtccaggaggcagaactctgggtgtctcaccatggcctggatccctctacttctcccccctcttcactctctgcacaggctctgaggcctcctatgagctgacacagcccaccctcggtgtcagtgtccccaggacagacggccaggatcacctgctcgtggagatgcattgaccaaaagcaatagtgtctttagttggtaccagcaagaagcccagggacccacggtccccctggtcgtcgtgggtagtattaataagtaaaacgacgtaaggtaggacggaccggaccctacgaggggtactcccgtagagaccgtnttacgtcctagggtccctccgagtccgtacgacgggaaaccaacgtacgtacctaccgttcgaaccctagtacgtaacggtgggaccgtcccggaacggacgaaggaaacgtagtaagggaccggtactaggaaccttatttaccgtgttaaccaactccgagaccgaagaccaagtcgttaaggttcggttttaggttttcgggtagggttccggacgggtacggaccgtaagtcgtacgtcccgtacggtcgacgacgtccgaacgtcccg

SEQ ID NO: 120696 - DNA, 909 bp, Homo sapiens
  misc_feature: GYAE6OF02IVS27.2.38.D05.1.454.CMB.1.raw
tcagacgctcgacacacgaccggtgctcgatttagtatctgatagttgggtttgggggtgggtccaggaggcagaactctgggtgtctcaccatggcctggatcctctacttctccccctcttcactctctgcacaggctctgacggcctcctatgagctgacacagcccaccttcggtgtcagtccgtccccgaggaccgacggaccggaccaagggactccaccgtcgtccgttcgtagggagtagtgctagttacgaacccgaaaagactaaatacgtgtacctttagttacgggtaccaacgacgtaaggaaccgccgaacggccgaccggtccccgttaggtcgtaccggttgggtagtaagttaagttaaagtaaacggaccgtaaggttacggaaaccgggtaccgggtccccgtaacgggaagggtacccgttccccgtaggtacggtacgttacgtttcggttcctcgggacctttcccgacggtaccgttacggaaccgggaactaaaccggacgttaaccgtaccggttaacgaaccgttacgtaaccggtagggttaacgggaccggttaacccggagggtaaccgtaaacgggtaacgggtaacggttaccggggacggttaccggttaaggttaaacccgtttacggtttaacccgtaagtacccggttaacgttaacgacgggttaccgaacggtaaacccgtacgacggttttaacgggtttacccggtttttttacggggtttagggggtttccggggtttaaccgggggcgggttaaaacccgggttccgggtaaacccggtttacgggtaacccccggtacccgggtttaaccccggttacgggtaaccccgggtaacccgttaacccccgggtaacggttccccccggg

SEQ ID NO: 120697 - DNA, 851 bp, Homo sapiens
  misc_feature: GYAE6OF02FNQ4G.2.38.D05.1.454.CMB.1.raw
  modified_base (108)..(108): a, c, t, g, unknown or other
  misc_feature (108)..(108): n is a, c, g, or t
tcagacgctcgacacacgaccggtgctcgatttagtatctgatagttgggtttgggggtgggtccaggaggcagaactctgggtgtctcaccatggcctggatccctntacttctccccctcttcactctctgcacaggctctgacggcctcctatgagctgacacagcccaccctcggtgtcagtcgtaccccaggacagaccggcaggactcacctgcttcgtggagatgctagttcgaccaaaaggcctaaatagtgtacctttagttcggtaaccacggtacaaggaaacgcccgaacggcccgaaccggtcccccgtggtccgtcggttggtagaagttaaagtaactaaaaagaccgtaggtacggaaggtacgggaccccctacgggaacggggtacccttaccccggttggaaacgtcgtaacgtttaccttccggttacggccctttaccggacgttaccgtaccgggtaaacgggtaacccaaacggttaaccggtccgttaacccgtttacggaacccgttaacgttacgtaccgggttacgggtaaccgtaccgtacgggaaccgtaaaggaaacggtacgttcggtacggacgtttacgtaacgttttaacgtcggtttaacctacgtaaacgttaccggataacccggtaagtaaccgaacggtacggttaaacggttttccggttttaacgggttttttcggggtaccggggtttaccggggtaacgggggtaaccggtaacccgggaaacggttcccggttaacccgggtaacccggtttccggggttaaaccggtaccggtacccggttaaccccggaaccgggtttcccccgg

SEQ ID NO: 120698 - DNA, 621 bp, Homo sapiens
  misc_feature: GYAE6OF02GBQ5Y.2.38.D05.1.454.CMB.1.raw
  modified_base (262)..(262): a, c, t, g, unknown or other
  misc_feature (262)..(262): n is a, c, g, or t
  modified_base (325)..(325): a, c, t, g, unknown or other
  misc_feature (325)..(325): n is a, c, g, or t
  modified_base (389)..(389): a, c, t, g, unknown or other
  misc_feature (389)..(389): n is a, c, g, or t
tcagacgctcgacacacgaccggtgctcgatttagtatctgatagttgggtttggggggaagaggaagactgacggtcctgccacaggtggtgctggcacggtgggcactcgacacaacatttgcgctcaactgtcttgtccagtgtgaggtgcagctggtggagtccgggggaggcttagttcagccgtgggggtccctgagactctcctgtgcagcctctggattcaccttcagtagctaactggatgacacgtgggccnccaagctcgagggaacgggtctggtgtggtctcgacgttattaagtgtagagtggatagcaanaacgctacgcggactcgtaggaacgggcctattcaccatcctcagacgacaacgccaaagaacncgactgtactctagacaaacgtgtaaacactacgttagacgtacgaaccggagacgtacggcttagtcgttattcgtgaacggtccaaaaggactaagtaacgaccgagtaccgacggtacgtaccgggtaacgccccggttaaagtacccggttacgggggacccgtaaacgggtaaccccgttcgggtacctaacccggttcgttaacccccgtcgtaacccgtcccccg

SEQ ID NO: 120699 - DNA, 565 bp, Homo sapiens
  misc_feature: GYAE6OF02FSEV0.2.38.D05.1.454.CMB.1.raw
  modified_base (290)..(290): a, c, t, g, unknown or other
  misc_feature (290)..(290): n is a, c, g, or t
  modified_base (354)..(354): a, c, t, g, unknown or other
  misc_feature (354)..(354): n is a, c, g, or t
  modified_base (415)..(415): a, c, t, g, unknown or other
  misc_feature (415)..(415): n is a, c, g, or t
  modified_base (436)..(436): a, c, t, g, unknown or other
  misc_feature (436)..(436): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggatcacctgctctggagatgcattgaccaaagcaatatgcttattggtaccagcagaagccaggccaggccccctgtgcgtggtnactataataaagacagtgagacggccctacgagggactccgtggagcgattctcgtggctccgnctacgaggacactacgctacgttcacatcaggtcggagtccaaggtacaagaagagtacgnggtctaggaacttagtttacnggttaacagttacgagtacgaacgacgacgagtaggttaggtttacgttttggggtcgttacgggacgggacggaaccgtagtaccgtacggtacccgttaccgtaggcctacggaccgtacggtcccg

SEQ ID NO: 120700 - DNA, 688 bp, Homo sapiens
  misc_feature: GYAE6OF02I54OJ.2.38.D05.1.454.CMB.1.raw
  modified_base (270)..(270): a, c, t, g, unknown or other
  misc_feature (270)..(270): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagttgggctgagctgggttttccttgttgctatttaaagtgtcagtgtgaggtgcagcgtggtggaggtccggggagcgttagtcagccgtgggggtccctgacgactcgtccgtgtgcgagtcctctggtacttcaccttnagtagcctactggatcgctacgtcgggtcccaccgaagccgtaccgaaggggtaacgggcgtggtcggtacggtctacgaacgttattaagtagtgagtgggagtagcgaacgacgactacggcggacgtccggtaggaacgggcccgtagttaccaccgtactccgaccgtaaggaacaacccgtaaacgaccaacgaaactcgtactagtaactcgtaagactaaacgcgaaatcgtacgtaggaacggacgaccgggaaggaccgaacgggtacttaggttaaccgtttaaggttacccgtaggtacgtaaccggtaaaggtaaccggtaaacgttaacggacgttaaaccggcgggtaaccgtacgggttaacccggtaacccggtaaccccgttacgggtttaaccccggggg

SEQ ID NO: 120701 - DNA, 896 bp, Homo sapiens
  misc_feature: GYAE6OF02F4G22.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctctatgagctgacacagcccaccctcggtgtcagtcgtccccaggacagacggcaggatcacctgctctggagatgacattcgaccaaaaggcaaatatgtacttattcggtaaccagacaaacgaagacccgacggaccgaacggtcccccgtaggtcgtccgttggggtagtaagttaattaaagtaaaaacggaaccgtaagggttacggtaacgggaaccgggtacccccgttaaccggtaaacgggggtaccttacccccggtaggtaacgtaccggtaacgtttacccgttacgtaccgggtaccctttaacccgaaacggtcccgttaaccggtaaacgggggaaaccctaaaaaccgtcggttaaccgtaaacccgggttttaacgaaacccctaaaacggttaccgtaaacgggttaacgggtaaccggttacccggaaacgggggtacccgaaaaagggtaaaccgaacggtttaacggaacgggttaccgttaacggtaaaacgttttaaactttaaccggttacggttaaccgaaactttaccggaagtaaccgaaacgaaccgaacgtaaacgttagggtttaacggttttaaccgggttttttggggttaaccgggttaccgggggtaacgggtaaccggggtaaaccgtaaacgggtcccggtttaacggtaaccccggtttacgttaaccgggttaccggtaaacccggaccccgttaaacgggtcccccg

SEQ ID NO: 120702 - DNA, 634 bp, Homo sapiens
  misc_feature: GYAE6OF02JE0BL.2.38.D05.1.454.CMB.1.raw
  modified_base (268)..(268): a, c, t, g, unknown or other
  misc_feature (268)..(268): n is a, c, g, or t
  modified_base (615)..(615): a, c, t, g, unknown or other
  misc_feature (615)..(615): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagtcagccgtggggggtccctgagactctcctgtgcagcctgtggattcaccttcagtagctacgtggatgctacgtggtccacgaanctaccgaaggggaagggcgtggtggtcggtctcgtaacgttaattaataggtcggagtgggtagtagcaacgaaaggctaacggcgtaccgtcggtaggaacgggcctataccacctatcctaccgaagaacacaaccgacaaacggtaacacgtactagtactctagaacgaaaagtcgaagtacgttactagaaggaccgtaacggacggtacgaccggtgttaagttactagtttacgtgtacgacgaaagtacaagtacgctagacgtgcgtaccgtaacggaccgtaacggtacgggcgggaacccggtacggtaaccccgttcggacccgttaccgtcccnccgtacccgcggtaccccc

SEQ ID NO: 120703 - DNA, 720 bp, Homo sapiens
  misc_feature: GYAE6OF02FT7BI.2.38.D05.1.454.CMB.1.raw
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
  modified_base (394)..(394): a, c, t, g, unknown or other
  misc_feature (394)..(394): n is a, c, g, or t
  modified_base (431)..(431): a, c, t, g, unknown or other
  misc_feature (431)..(431): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctcgtggacttcaccttcagtagctacgtggatgccacgtcgggtccgccaagctcggaaggggaagggctggtggtcgggtctcacgttattaagtagtgagtgggatacgcacgaacgctacgcggactccggtagacggcnttcacagtctcgagacgaacacgacaacgacacgntacgtactacagacaaagtnaacctagtactagaggacgaccggtaaggacgaacggngttacggtattaacgttcgtcgtagaacgaagagtanagcgaacgcacggtcgtacggaccgccggtaaccgtacgggtccggggtaaccgaaccgggtacccgttcggtacccgtaccggtacctcccgtacgacccggttaccctacccgtaaaccggaccggaacccgttaccgtccccggtttaccctccccgggttggtacccccggcccgttacccggtaaccggttacccggaaccgggttaccgacccggtaacccgtaacccggggtactaacccgggaacctaaccgggtacccgggtaccccggtaccccggggg

SEQ ID NO: 120704 - DNA, 854 bp, Homo sapiens
  misc_feature: GYAE6OF02IE0C6.2.38.D05.1.454.CMB.1.raw
  modified_base (170)..(170): a, c, t, g, unknown or other
  misc_feature (170)..(170): n is a, c, g, or t
  modified_base (209)..(209): a, c, t, g, unknown or other
  misc_feature (209)..(209): n is a, c, g, or t
tcagacgctcgacacacgaccggtgctcgatttagtatctgataggttgggtttgggggtgggtccaggaggcagaactctgggtgtctcaccatggcctggatccctctacttcctccccctcttcactctctgcacgaggctctggacggcctctatgagctgacacngcccacccgtggtgtcagtcgcccaggacaggcgcaggntcacctgctgtaggagactgctattacgaccaaagctaatgtgtacttttaagttcggaaccagacgaacggacgacccggaagggtccccaacggggtcccccgtggttccgcggttacgggttagaatttaaagaaaccgttaaaggaaccgtaggttagggggaaccggtaacccggcccccggttaagggaaaacgggggtcccttcccggaggaacggccgtttacttccggtccgtcgggttaacccctaccgggcgttaccggtacggtaaaaaccggggacccttaaacgtacgggtttacccggtaaaccggttttacggaaaccccttaagtccgggtaaaacgggggtttccgggaaccgttacccgggaagggggtaacccaaggggaaacggtagttaacggggagtccgttaaagtttacttaacggttctaacggttacccaacgttacgacggacaaacggtacgtaaccgtagggttaaccgggtttttgggttttaccggggttttagggtccggggtttaccggggacggggtaaccgtaacccgggagttttcccgggacccgggttaaccggtttaccccggaagggttacccgaaccgggttaccccgtacggttcccccggg

SEQ ID NO: 120705 - DNA, 690 bp, Homo sapiens
  misc_feature: GYAE6OF02JT7RT.2.38.D05.1.454.CMB.1.raw
  modified_base (227)..(227): a, c, t, g, unknown or other
  misc_feature (227)..(227): n is a, c, g, or t
  modified_base (448)..(448): a, c, t, g, unknown or other
  misc_feature (448)..(448): n is a, c, g, or t
tcagacgctcgacacacgaccggtgctcgatttagtatctgatagttgggtttgggggtaaggaggaagactgacggtcctgccacaggtggtgctgggcacggtgggcactcgacacaacatttgcgctcaactgtcttgtccagtgtgaggtgcagctggtggagtccgggggaggcttagtcagccgtgggggtccctggagactctcctggtcgcagcctcgnggtattctaccttttaggtaactttgtctagttggaggttcggtccgccaggtctccgagggaaacgggctaggagtgggtctcgagtctattgagttggtggttctggttcgtcccaagctacggccgccttcggtgtaacgggtccggttcaccgtatcgtccgaagacgacctaagtaccgaaaagccgtatagtacgtctagactaaatcgaaaccnccgtagagacgccgtaagacgaccggacatacttaagttatcgagtacgaaggaccgtaaggtacggggtccgacgggtacggggacgtacggtaaagtcgtaccggtttacgggcggggaacccggtaacgggtaccccgttgggtaccccgtaaccttcccggtaacccgccgttaacccgtcccggtaaccctaacccgggacccgggtaccccttacggttaccccggttccccccgg

SEQ ID NO: 120706 - DNA, 669 bp, Homo sapiens
  misc_feature: GYAE6OF02HOKN1.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccaccctcggtgtcagtcgtccccaggacagacggccaggatcacctgctctggagatgcattgaccaaagcaatatgtacttagttggtaaccagacgaagaacgccgaggccacgggcccctggtacgcgtgggtagtaattaagtaataaacgacgtaggtagaaggacggtccctacgagggtacttcccgtggacgtcgtatttccgtagtcggcttccgagtcctacgacgggtaacaacgtagtccgtacgttacgaccgtagtcgaggtacggacgtaccgaagggtacgaaagagtagtaggaacggtacgttagtaacttacgttacgtaggtaccaagttaccgaggaccaacgacgtaacgacggttagggtttacggtttacggtttttgggtacgggttccgggtaacgggacggttaccggaaggttccgtaaccggtacccggttaccggttacgggtaccgtaaccgtacccggtaaggtccccgg

SEQ ID NO: 120707 - DNA, 406 bp, Homo sapiens
  misc_feature: GYAE6OF02I3FAZ.2.38.D05.1.454.CMB.1.raw
  modified_base (320)..(320): a, c, t, g, unknown or other
  misc_feature (320)..(320): n is a, c, g, or t
  modified_base (331)..(331): a, c, t, g, unknown or other
  misc_feature (331)..(331): n is a, c, g, or t
  modified_base (356)..(406): a, c, t, g, unknown or other
  misc_feature (356)..(406): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgacggcctcctatgacgctagacacacgcccacccgtcggtcgtcagtcgtaccccaggacacgacggcaggactcacctgctgtgagctgctagtcgaaccaaagactaaatcgtcgtcttagtacgacagaacgaagaacgccgaacgaccgtaccgcccgtggtcgcgtggtanacgttaataanaaaacgtagagtaggaacggaaccnnnnnnnnnnnnnnnnnnnnnnnnnnnnnnnnnnnnnnnnnnnnnnnnnnn

SEQ ID NO: 120708 - DNA, 603 bp, Homo sapiens
  misc_feature: GYAE6OF02F2FGI.2.38.D05.1.454.CMB.1.raw
  modified_base (351)..(351): a, c, t, g, unknown or other
  misc_feature (351)..(351): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtgggtccgccaagctccgagggaggggctggtgtgggtctcacgttattaatagtgagtgggatagcacagctacgcgctcgtgaggcatcacatcncagacacaacgcaagacacgctgtactctagacaaaactgaaactagtctaggaacggacggaccggaaggaaccacgggtctaggttagtttaattaccggtagttacggaaccaaaggtagtaagttacggacaacggcaagggtccgtacgggaacccggtccggtaaacgtaaccgggtcgggggaacccgaaccgggtaaccccgtgggtaccctacccggttccttacccgtccgacgtacccccg

SEQ ID NO: 120709 - DNA, 685 bp, Homo sapiens
  misc_feature: GYAE6OF02HQQDE.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccggggagcttagttcagcctgggggtccctgagactctcctgtgcagcctctggattcaccttcagtacgctactggatgcacgtgggtccgccaagcctccgagggagggctggtgtggtctacacgttattaatagtgatgggatagcacaagctaacgcggactccggtagaacgggccgtattccgaccatcctaccgaagacgaaccaacgacccaaagaaccacgcttagtaactccgtagaacctaaagtcgaaactcggtacctaggaacgtacgcccggaaaggtaccgacgggtcttagggttacgttaactttaccgttggtactaaccgtaaaggtacgaacttaacggacctaaaggaccgttaacggtaccgtttaccggggtaaccgtaccccgggttaaacgttaacccgggtacccgggggtaacccgtaaaccgggggttaacccccttagggtacccctaacccgtttcccgtaccccgttacgacccgttaacccccg

SEQ ID NO: 120710 - DNA, 651 bp, Homo sapiens
  misc_feature: GYAE6OF02GFDW1.2.38.D05.1.454.CMB.1.raw
  modified_base (182)..(182): a, c, t, g, unknown or other
  misc_feature (182)..(182): n is a, c, g, or t
  modified_base (228)..(228): a, c, t, g, unknown or other
  misc_feature (228)..(228): n is a, c, g, or t
  modified_base (439)..(439): a, c, t, g, unknown or other
  misc_feature (439)..(439): n is a, c, g, or t
  modified_base (492)..(492): a, c, t, g, unknown or other
  misc_feature (492)..(492): n is a, c, g, or t
tcagacgctcgacacacgaccggtgctcgatttagtatctgatagttgggtttgggggtgggtccaggaggcagaactctgggtgtctcaccatggcctggatccctctacttctcccccctcttcactctctgcacaggctctgaggcctcctatgagctgacacagcccaccctcgggtntcagtcgtccccaggacagacggccaggatcacctgctcgtggganatcgctattcgaccaaacgcaaattagtgtacgtttatttacggtacccagacaagaacgcccgacggacccgacgggccccctggtcgtcgtgggtgataataagtaaagacgtagtagagacggtccctacggacggtacctccgtagagtcgtatttctacgtcgcctcgagcctacgacggaacaacgcgtactacgtacgacctancgtaggtgacgtcgaaggcgagaagagtaggacgtctagtacttacgttacgngttaccaagtacgacgactaacgacgacgtacggttagttacggttttacgggtttttgggtccgggttacgggacggggtacggaccggtaaggtcccgtacgggttaccccgtaacgggttccggtaccgtaccggtaccggtaccggttaccccgg

SEQ ID NO: 120711 - DNA, 763 bp, Homo sapiens
  misc_feature: GYAE6OF02JE45U.2.38.D05.1.454.CMB.1.raw
  modified_base (203)..(203): a, c, t, g, unknown or other
  misc_feature (203)..(203): n is a, c, g, or t
  modified_base (344)..(344): a, c, t, g, unknown or other
  misc_feature (344)..(344): n is a, c, g, or t
tcagacgctcgacacacgaccggtgctcgatttagtatctgatagcgtggggtttccttgttgctatttaaaggtgtccagtgtgaggtgcagctggtggagtccggggaggcttagttcagcctggggggtccctgagactctcctgtgcagcctcgtggattcaccttcagtagctactggatgacaccgttagggtcccnccgaaagtccgtacccgagggggaacggggtccttggggtcgtggggtcctacgacgttaattaagtaggtgagtgggacgttagcgacctaagtcctacgcggactcccggtagaacgggccaattcccaaccgtacgtntaccgaaaggtcgaaccaaccgtaccaaaacgtaccgaccgtcgttagtaactccgtagtaccaaaaagttcgaaacgtccggtactagggagtaccggacggaacgggtacctcggtacgtagtttaccggatttaacccgtggaggaaccgtaagaacgtacgtaaacggtccgaggtacccgaggtaccgtacggggttaccaaccgggttaaccgtacggtacggggaccgaccgggtaaccggttcggtaacccgtacccggtaccgtcccgttacgaccggtaccccgtaccgtaaccgtaccgggccctaacggtcccggttaccctcccgggtcgacccgtcgtcgacccgttacgaccgtaggcccgtaccgtacccggagcccggataaccgcggtaccccggtaccgg

SEQ ID NO: 120712 - DNA, 699 bp, Homo sapiens
  misc_feature: GYAE6OF02GNVFO.2.38.D05.1.454.CMB.1.raw
  modified_base (592)..(592): a, c, t, g, unknown or other
  misc_feature (592)..(592): n is a, c, g, or t
  modified_base (625)..(625): a, c, t, g, unknown or other
  misc_feature (625)..(625): n is a, c, g, or t
  modified_base (632)..(632): a, c, t, g, unknown or other
  misc_feature (632)..(632): n is a, c, g, or t
  modified_base (652)..(652): a, c, t, g, unknown or other
  misc_feature (652)..(652): n is a, c, g, or t
tcagacgctcgacacacgaccggtgctcgatttagtatctgatagttgggtttgggggagccccagccctgggattcccagctgtttctgcttgctgatcaggactgcacacagagaactcaccatgggtagtttgggctgagcgttgggttttccttgttgcttaagttttaaaaggtgtccagtgtggaggtgcagcgtgggtgggacgggtccggggggaggtcgtttagttcgaggtccggtcggggggtccctggacgaccttctccgtgtcgcacgtccttcgtggtacttccgtaccttcgaggttacgtcgttacgttaggtagtcgccgacggttcgggtacccgaccgaacggtcctaccgggaaggggggaacggggtcgttggggtggtcgggttcgtacgtaacggtttaagttaagtaggtaggtagtaggggtagtagacaagaacgacgtaccggcggtacgtccgggtagggacgggtccgtacttaccgaaccacgttcccaaccgaaggtaccaaaccgaaccgaccaaagaccgacgtctagtaacgtcgagaactaaatcgaaactcgtanaggaggacgaccggaggactcggattgtagttnttaggtnacggaacgtaaggacgtaancggacagtacgcggtacggtcggtaaccggcccgtaacggtcggggg

SEQ ID NO: 120713 - DNA, 714 bp, Homo sapiens
  misc_feature: GYAE6OF02GR04O.2.38.D05.1.454.CMB.1.raw
  modified_base (159)..(159): a, c, t, g, unknown or other
  misc_feature (159)..(159): n is a, c, g, or t
  modified_base (256)..(256): a, c, t, g, unknown or other
  misc_feature (256)..(256): n is a, c, g, or t
  modified_base (312)..(312): a, c, t, g, unknown or other
  misc_feature (312)..(312): n is a, c, g, or t
  modified_base (452)..(452): a, c, t, g, unknown or other
  misc_feature (452)..(452): n is a, c, g, or t
tcagacgctcgacacacgaccggtgctcgatttagtatctgatagctgggttttccttgttgctattttaaaaggtgtccagtgtgaggtgcagctggtggagtccggggaggcttagttcagcctggggggtccctgagactctctgtgcagcctcgnggacttccaccttcagtagctactggatcgctacgtcgggtccaccaagcctcgaagggaggggctgggtggtcggtctacgacgtaattaagtagngagtgggatagcacgaagcgtaacgcggactccggaaggacggcctattccacctntccgtaccagaacgaccaaccggcaaaacgaccgacgcttaggtactcgagaacaaaagtcgaaatcggttccaagggagaaccggtaccggaaggacccggtacggtcgttaaggttactttaaagttcggtcggtaanacgaaaggaacgagtaacggtacaacggcgtacgggcgttacggtaccggtaccggaacgttaccgggacgggtaccgaacgggtaacccgtcggtaccgtacctacgtccgtaccgacgtcccctaccgaacccggaccggtacccgttaccgttcccggttaccccgttcccgtccggtacccctccggtaccggccgtaccggtccggaccgacccgtacccgaccgacggaccgacggacgtaccggccggtaccggg

SEQ ID NO: 120714 - DNA, 805 bp, Homo sapiens
  misc_feature: GYAE6OF02HOZC1.2.38.D05.1.454.CMB.1.raw
tcagacgctcgacacacgaccggtgctcgatttagtatctgatagttgggtttgggggtcgggtccaggaggcagaactctgggtcgtctcaccatggccctgggatccctctacttcctccccctcttcacctctctggccacacggctactcggacggtccctcctaagtggacgctagaccaacgtcgcccaccccgttgggtctcgtaacgtccgtacccccgaggaccaacgggtcccggccgaacgggctccgacccgttgaccgttcggtaggacgtatcggactagttacgaccgtaaagacctaagttacgtcgtacgttttaagttacggtaaccgacgtacctaacgggaaccgacccgacggccccgaacgggtccccccgttaggtccggtaccgttgggtacgtaaccttaagtaagtaaaccggtacgtaggtaggaacggtacccggttaccgtaccgggtacgggttaccctacggttagaacggtccgttctttaccgtgtaccgtccctacgcgtacgtcggaaacggtcaaccgtgtaccgtacgtagaccctagtacgtggtacggtcgtaccggtcggtactacggtaaggtacgacggttaacggcgttaacgtagttaaccgtacgtcgtaacgtaccaggactcgacggtaacctcggtacgttacggttagttttacgggttcgggttccggtaacggggtcggaaccgggttcgaccgttccggtacccggtaccggttacggccggttacccaccgggtaccgtaccggttccccgg

SEQ ID NO: 120715 - DNA, 698 bp, Homo sapiens
  misc_feature: GYAE6OF02HRVPW.2.38.D05.1.454.CMB.1.raw
  modified_base (586)..(586): a, c, t, g, unknown or other
  misc_feature (586)..(586): n is a, c, g, or t
  modified_base (675)..(675): a, c, t, g, unknown or other
  misc_feature (675)..(675): n is a, c, g, or t
tcagacgctcgacacacgaccggtgctcgatttagtatctgatagttgggtttggggggaagacggaagactgacggtcctgccacgaggtggtggctgggcacgggtgggcactcgacacaacatttgcgctcaactgtcttcgtccagtgtgaggtgcagctggtggagtccgggggagcttagtcagcctgggggtccctagagactctcctgtgcagcctctggacttcaccttcagtgctatggatcgctacgtgggtcccgcctaacgctccggaaggggtacggggcttagggtcggtcgggttactccgaacggttatttaacgtagttagtagtcgggatacgacaataacggcctaacggcggtaacctaccggtacggtaacggtccgtacgttccaccctagtccgtacccgaagaccgaacaaccggccaaacggaccaaccggtctaggtacctcggtagaactaaacgtcggaaaactcgttacgcgaacggaccgtaccggaagtaccgaacgggcttagggtattaacgttcgttcgggaacaccgaaagggtcaacgttagcccgaanccgtagaccgttcggggtaaccacccgtaagggtacccgtgggggaccccaacggggttaccccgttacggaccctaccccggtttacncccgttaccgaccggtaaccccg

SEQ ID NO: 120716 - DNA, 537 bp, Homo sapiens
  misc_feature: GYAE6OF02I67RW.2.38.D05.1.454.CMB.1.raw
  modified_base (324)..(324): a, c, t, g, unknown or other
  misc_feature (324)..(324): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
  modified_base (468)..(468): a, c, t, g, unknown or other
  misc_feature (468)..(468): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtggtccgccaagcctaccgagggaagggctggtgtgggtctcagtattaagtagtgagtggagtagcaanagctacgcgactcgtagacggtcatcacatcncaganacacgcaagacncactntactntanacaaatanaactagtactagacgacgaccgaaggacacggntgtactaattacgtgtacgagaagagatagacagcagtcgngtacgaccgtataaccgtgggaccctacgggacccttggaccctaccgtcctccctacgaccgtacccg

SEQ ID NO: 120717 - DNA, 753 bp, Homo sapiens
  misc_feature: GYAE6OF02FXUSK.2.38.D05.1.454.CMB.1.raw
  modified_base (199)..(199): a, c, t, g, unknown or other
  misc_feature (199)..(199): n is a, c, g, or t
  modified_base (241)..(241): a, c, t, g, unknown or other
  misc_feature (241)..(241): n is a, c, g, or t
  modified_base (388)..(388): a, c, t, g, unknown or other
  misc_feature (388)..(388): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattcaccttcagtagctactggatgcactgggtccncaagctccgagggaagggctggtgtgggtctcacgtattaanagtgagtgggagtagcacgaagctacgcggactccgtgaagggccgattcgaccagtcctaccagacgaccaacgccaaagacacgcgtagtatcgtcgaactaaagtgaactggttacctaggaagacggcccggaagggtaaccncgggtacttgtacgttaacgtttcgtagggttagaccgtaaaggaggtattaaggacagacgacggtacggtacggtaaccggcccgtaaccgtacccggtcggggacccggtaacggggtaaccccgttacggcccgtaacccggttccctacccgttaccgtacccggaccccgttaccccgaaacccggtaacccgggtaccccttaacggtccccgggtttacccccgtttaccccccgggcgggttaccccggccccgtccggtacccttaccccggaccggggtaacctaccccggtaacccgttacccgggacggtaacccggacccggaaccgtaccgggtccccggtcccccgggg

SEQ ID NO: 120718 - DNA, 685 bp, Homo sapiens
  misc_feature: GYAE6OF02JRR1Y.2.38.D05.1.454.CMB.1.raw
  modified_base (319)..(319): a, c, t, g, unknown or other
  misc_feature (319)..(319): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccaccctggtgtcagtcgtccccgaggacaggaccggccaggatccacctgcctcgtggacgatgactattcgaccaaagcaatattgacttagttcggtaccagacgaagaacgccaggccgacggtcccctagtgcgtaggtagattanaaataaagacctaggtagacgacggcccgtacgagggtacctccgtgacggacgtactttccgtcgcggtacctccgacgtcgtaacgacgggaaacctaaccgacgtttaccgtacggttaccgacctacgtaagacgggtcggtaaccgtccgaagggtacaacgggaagtagtagggacgtacgtacgaacgtttacttaacgttcgtaacaacttcgaacgtacgacgaacacggtaccttagggtttacgtttcggttttacgggttacggccggggtaacggtaacgggtaccgtaaggtacccggtacggtaccggttccgggtaacgtaccggaaccggttacccgaacggttcccgg

SEQ ID NO: 120719 - DNA, 787 bp, Homo sapiens
  misc_feature: GYAE6OF02IDMKA.2.38.D05.1.454.CMB.1.raw
  modified_base (601)..(601): a, c, t, g, unknown or other
  misc_feature (601)..(601): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggaggtccgggggagtctttagttcagccgttgggggtcctgacgtactctccgtgtgcacgcctcgtggtacttctaccttcgagtacgacttacgtggatcgacctacgtcgggtacccgaccgaacgtccgtaccggaaggggaacggggtcgttagggttggtcgggttaccgttaccgtaacgttaacgtttaaagttaggttacggtaaggttagggtaacgtacgaccgaacgtaaacgtaccgtaaccggaccggtaccgttaccgggtaagggaaaccggggaccgtacgttaccgaacctaacgttaccgtaaccgaacgaaaccggtaaccgaaaccgaacccgaaaagtaaaccgacgtcgttacgtattccgtagaactaaaagtcgaaacgtgtcgaaggacgacgaccggaacgtaccgacggtnttaggttataaacgtttcgaggtacgacaaaagggtcgtaacgttagacgaggactaacggtcccggttaacggtaaccccggaccggtaaccgttaaccggggcccgggggtaaccccgtaaacgggttaccccgtggttaacccccgtaccgtttacccggtcccgtacccgacgtaccccccg

SEQ ID NO: 120720 - DNA, 760 bp, Homo sapiens
  misc_feature: GYAE6OF02IHFEU.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctgggtggaggtccgggggaggtcttagttcaggccgtgggggtccctgacgactctcctgtgcagcctctggtattcctacctttcgagtacgtctacgtgatcgctacgtcgggtccgccgaagtcctaccgggagggaacggggtctgggtggtcggtctacgtaacgttattaagtaggtggaagtaggggagtacggcaaacgagtccgtacggacggtacccgttaccggaagggtaaccggtccggtaacttccaaaccgtacttacctaccgaacggacgtaaaccgaaccgaccaaaggtaacccagtcctagtactcaagtaacaacgtacgaaagtcgtactacggaagtacggaacccggtagggaaccgtccggtacgtggtttacgtttacgttaacgtcggtaacgtaacgaaaggtaacgttacgtaaacggccgaagtaccgggacgttaccgggttacggggaaccccgttcccggtaacggtacccgggggtaacggggtaacccgggttaaacccgggtacccgtttaccggggtacccttacccgggttacccctaccggttacccgtaaccgtaccccccgg

SEQ ID NO: 120721 - DNA, 756 bp, Homo sapiens
  misc_feature: GYAE6OF02FKLQ2.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagcttagttcagccgtggggggtcctgacgactctcctgtcgcagcctctggacttcaccttcagtagctactggatcgcaccgtcgggtcccaccgaacggcctaccggaaggggacggggtcgttgggtcggttggggttcctacgtaacggttaacttaacgtaggttacggaacggttacgggggtaacgtacggtaccgaacgtaacggtaccgtaaccggtaccgggtaaccgttaccgggtaaggggaaacggggtcccgtaacgttttacccaacccgtacttccccgttaccgaacggtaacgaaacccgtaaccggacccgtaaaaggaacccctaccggtcttaacggttactccggtagaacctaaagtcgaaaccgttacgtacggtacggaacgaccggtacccggaaggaaccgtccggtaactggtttacggttactttacggcggttacgacggtaaaggacggttaactaggaccgacggtaaccgtcggttaccggtccgtaaccgggtaccgtaacgttacccggggg

SEQ ID NO: 120722 - DNA, 780 bp, Homo sapiens
  misc_feature: GYAE6OF02H9EIO.2.38.D05.1.454.CMB.1.raw
  modified_base (184)..(184): a, c, t, g, unknown or other
  misc_feature (184)..(184): n is a, c, g, or t
  modified_base (236)..(236): a, c, t, g, unknown or other
  misc_feature (236)..(236): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggccttcctatgagctagacacacgacccacccgtggtntcagtcgtccccgaggacacggacggccgaggactcacctgctcgtggacgntgactagttcgacaaagcaatactgtacttagttacggtaccagtacgaacgaacgccgaggcccgacggtcccctggtacgtccggttaggtagtaacttaaacaaagttaaacgaacgtaggtacggaacggtaccggtccccttacgggacggggtacctcccgtaggacggtcgtactttcgacgtcgcctcgagtcgtaggacggtaccaacgacgtaccgtagttccgaacctagtacgtaggtacggtaccgtacggacggaacgaaggtaaacgtacggtacggtagtacgttacgtaaacgtttacgtttaacgtcgtaacgaacgttacaacgggtaccaggtaaccgacggtacggttaaggggttttacggttttaccgggttttagggggtttaccgggttcccgggggtaacggggtaacccggggtaaaccgtaaccgggtttacccgggttaccgggtttaaccccgtaccgggtttaacggtacccccgggtaacccgtacccccggggtaaggtttcccccccggg

SEQ ID NO: 120723 - DNA, 821 bp, Homo sapiens
  misc_feature: GYAE6OF02GO9N9.2.38.D05.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
tcagacgctcgacacacgaccggtgctcgatttagtatctgatagttgggtttgggggtgggtccaggaggcagaactctgggtgtctcaccatgcctggatccctctacttcctccccctcttcactctctgcacaggctctgacggcctcctatgacgctacgacacacgcccacccctgggtcgtcacgtccgtaccccgaggacaggaccggcgaggntcctacctcgccttcggnggacgagtcgctaacgttacgaccgaaaacggacctaaatacgtggttaacctttagttggtaacccacgtacgaaaggaacgtaccgaccgggaccccgaccgggtacccgtggtaccgtcggttgggtacgtaattaacgttaaaagtaaaccggataacgggttagaccgggaccggtacccgtaggaaccggggtaccttcccggtaggtaccgtacgtaccgttcgtacggtaccggtaccaccgttaacgtcccgtaacggaacggggtaaaccaacggttccggtaaccttaccggggttaccgtaaacccgtaacgttacggttacgggtaacccggttaacgggacctaacggggtaaccgaaacggtaaggacggttaaggaccgggtaacggttacgtaaacctttaacgttacggttactaacgtaaaccgcgtaaaccgtagaaaccgtcgtacgtaaacggttcgtttacgggtttacggtttacgggtgttacccggggttaacggacggtaacccgaagttccgaacggtaccgttcggtaacgcgaaccggtacggaccgtccg

SEQ ID NO: 120724 - DNA, 750 bp, Homo sapiens
  misc_feature: GYAE6OF02I8WWB.2.38.D05.1.454.CMB.1.raw
  modified_base (195)..(195): a, c, t, g, unknown or other
  misc_feature (195)..(195): n is a, c, g, or t
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
tcagacgctcgacacacgaccggtgctcgatttagtatctgatagctgggttttccttgttgctatttaaacggtgtccagtgtgaggtgcagctggtggagtccggggagcttagttcagcctgggggtccctgagctctcctgtgcagcctctggacttcaccttcgagtagcgtactggatgcacgtggccncaagctcgaaccggagggctggtgtgggctcgaacgttataagtagtgacgtggggaattagccgacgagctacggcgactaccggtgaaggccaattcacgtctctcgagacgacaaccgcaacgtacaccgntcgtaacgttcacgtaccaaacgtgtaaccncgttacctggaacgaacggacccgacggacgtaccggngttacggtacgttaacgtacgttaacggngttaaacgaacggtacggtaagtaccgtacggaacgtaccgaaacggccggttaacgggttacccggaacccgggttaacgtacccgggtacggggtacccgggttaaacccgggtccccggttagggtacccctacccgggttaccctcccggtacgacccgtcccgttacccgaaaccggaccgggttacccgtaaccgttcccgggttacccctcccccggttacgggccccgtccgtcccggtaaccgtcccggtaaccggtaccgccccggtaaccgtcccggagaccgttcccgaacgtacccgggcccgtaccggg

SEQ ID NO: 120725 - DNA, 748 bp, Homo sapiens
  misc_feature: GYAE6OF02IQ2J3.2.38.D05.1.454.CMB.1.raw
  modified_base (229)..(229): a, c, t, g, unknown or other
  misc_feature (229)..(229): n is a, c, g, or t
  modified_base (399)..(399): a, c, t, g, unknown or other
  misc_feature (399)..(399): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacgacgcctacccctcggtgtcacgtggtccccagggacaggacgccgaggatcactgctctgganatgctattcgacccgaaagcaaactatcgactttattaggtaccagacgaagaaacgtccgaacggtcccgaacgggccccccttggcgtcgttagggtaggtattaaacttaaagtaaaaggacgtaaggtgtaaacggcgggtccctacggaaggggtacttccccgngaacgtcgtattcctcgtcggccctacgagtcctcggaacgggaacctaaacgcggtctacggttaccgaccgaactacgaggttcgggacgtaccgaaggacgtaaacgaagtagtacgaggcgtataacgttattacgttacgaactaacgtagtacgagtagaacccgtaggtaccggtttaaagttacggtttttaaccgggtttttcgggggtttaacgggtttccggggtaaccggggtaacccgggaaaccggttaaccgggtaacccggtaaggttaccccgggttaaccggttaccgggttacccgaacccgggtaaccccgtaaacgggtccccccggg

SEQ ID NO: 120726 - DNA, 975 bp, Homo sapiens
  misc_feature: GYAE6OF02J1INP.2.38.D05.1.454.CMB.1.raw
tcagacgctcgacacacgaccggtgctcgatttagtatctgatagctgggttttccttgttgctatttaaaaggtgtccagtgtgaggtgcagctggtggagtccggggaggcttagtcagccgtggggggtccctgagactctccgtgtgcagtcctctggacttccaaccttcgagtagcttactaggactgacctacggtcgggtcccgacgaacgtcctaccggaacggggaacggggtccgttgggtgtcgggttcctacgaacgttaattaagttaggtgtaggttacggggaagttacggtacctaacggtaacggtccgttaaccggtaccggtaacgttcccgggaaggtaaaccggggttcccgtactttacccgaacctactccgtaacgacggtaaccggaccaaccggactaaacgaccgtacgtaccttaggtagttacgtaccgtaataaacgtacgtaaacgtcggttcgtaacggacggaccggaccggaacggtaaccggtaccggtggttacggttacgttaaccgtttacgtaacgggtcgtaaaccgtaaagggtacgtaaggttaaccgtaacggaccgtaacggtacggttacccggttaccggggttaacccggtaccgggttaaacccgttaaccgggggtaccggggtaaacccggttaacccgggtaaacccggttaccgggtaacccgttaccccgggtaccccttaccggttacccggtaccccgtaccccgggttaacccgtaaacccccgggtaaccggttacccccggggtaaccctttaccccggggttcccccgtttacccccgggtaccgggtcccccgtaccggttaccccgtacccggaaccccggtaagggtaaccccgtacccggttaaaccccggttcggaaaacccggttcggtaaccccgacgggttaccccggtaccccgggttccccgggg

SEQ ID NO: 120727 - DNA, 656 bp, Homo sapiens
  misc_feature: GYAE6OF02FN0PV.2.38.D05.1.454.CMB.1.raw
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagcctccgagggaggggctggtgtgggtctcacgtattaatagtgatgggagtagcacaagctacgcggactccgtgaaggccgattcacatctcagtagacaacgccaagaacncgctntatctgacaaatgaacagtctgagacgcgaggacacggtctgtatattactgtgacaagagagtagacagacgagtcgtacggtaaccgaccggtaaccgtacggtacggggaccgaacggggtaacccgtcgggtacccgtacccggtccttcccgtaccgacgtcccctaccccgaacccggaaccgggtccccgtaacggttccccggtttcccgttccccccgttcgggtccccgtccccgtccggtccccgtacccggaaccgggaaccgtaccccgtacccgttacccggacgacccggtacccgaccgtaccgggcccgggtccccgg

SEQ ID NO: 120728 - DNA, 656 bp, Homo sapiens
  misc_feature: GYAE6OF02HTTCZ.2.38.D05.1.454.CMB.1.raw
  modified_base (327)..(327): a, c, t, g, unknown or other
  misc_feature (327)..(327): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagtcagccgtgggggtcctgagactctcctgtgcagcctctggacttccaccttcagtagctacgtggatgcacgtgggtccgccaagcctccgagggaaggggctgggtgtgggtctcacgttattaatagtgagtgggagtagcanaagctaacggcggactcgtaggaagggtccattcaccatcacagagacaacgacaaagaacacgctatatctgaactaaagtagaaacgtagtacgtaggacgacgaccggtacggacgacggtcgttaggtcgttaactttacgttaggtacgtaacgaaaggtaagaacgttacggacaacggacgtaacggtccgttacgggtacccggaacccggtaaccggttaaccgggtaccgggggggacccgtaaccggggttaaccccgtacgggttacccggtacccgtttaccccgttaccccgttaccggacccgttaccccccgg

SEQ ID NO: 120729 - DNA, 752 bp, Homo sapiens
  misc_feature: GYAE6OF02F4338.2.38.D05.1.454.CMB.1.raw
  modified_base (693)..(693): a, c, t, g, unknown or other
  misc_feature (693)..(693): n is a, c, g, or t
  modified_base (706)..(706): a, c, t, g, unknown or other
  misc_feature (706)..(706): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggtagtttgggctgagcgttgggttttccttgttgcttaattttaaaaggtgtccagtgtgaggtgcagcgtggtggacggtccgggggaggtctttagttcaggccgtcggggggtccctggacgtacttcctccgtgtgccacgcctcgtggtacttccgtaccttgtagtacgtctaacgttggatcgcgtacgtcgggtcccgaccgaacgaccgtccggaaggggtacggggcgtgggttcggtcggtcgtaccgtaagtttaacttaagttaggtagtaggtacggggtaagtacgaccgaaaccgtaagaccgtacggaccggtaccgttaccgggtacggaaccgggtacccgtacttacccaacccgtacgtacctaccggaaaggaaccgaaacgaaccccgaaccggtaaagaaacccgtaccggtacttaacggttacttaccgtagtaaacctaaacgtacgtaaaacctcggtaacgtaacgggaaggtaccggaaccggtaacgacggttaacgggtctaggttacgttaacttggttacgacgaacggtanaaggtaccgtaancgaagcctaggtcccggtaacggtacccgtccggtaacgtcccggg

SEQ ID NO: 120730 - DNA, 601 bp, Homo sapiens
  misc_feature: GYAE6OF02HH9IP.2.38.D05.1.454.CMB.1.raw
  modified_base (399)..(399): a, c, t, g, unknown or other
  misc_feature (399)..(399): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctataagctgacacagccaccctcggtgtcagtcgtccccaggacagacggccaggatcacctgctatggagatgcattgaccaaagcaatatgtcttattggtaccagcagaacgccgacggccgacggccccctgtcgcgtggtgtatataagtaaagacaggtgaagacggccctgagggctccgtgacgcgtattctcgtcggctccagcctacgaagggacaacgacgtcctacgttcaaccntcgtaggtggacgtccgaggacaaggaagatggaggtctagtacttaacttcgtagtactaataccgagtacagaactagtacgtaggtttcggtttacgtttttggggtcgttccggggacgggtaacgggaacctacgggtccgttacggtcccgttaccggtacggtacccacggtacccgaaggtccccgtaccccgg

SEQ ID NO: 120731 - DNA, 783 bp, Homo sapiens
  misc_feature: GYAE6OF02JM2T0.2.38.D05.1.454.CMB.1.raw
  modified_base (180)..(180): a, c, t, g, unknown or other
  misc_feature (180)..(180): n is a, c, g, or t
tcagacgctcgacacacgaccggtgctcgatttagtatctgatagttgggtttgggggagccccagccctgggattcccagctgtttctgcttgctgagtcaggactgcacacagagaactcacatggagtttgggctgagcttgggttttccttgttgcttattttaaaaggtgtaccngtgtgaggtgcagcgtggtgggtagggtccgggggaggtctttaggttacgacggtccggttcggggggtccctaggacgtaccgttcctccgtgtcggcacggtcctcgtaggtatttacccgaccgtttcgagttacgtaccgttcgtggtatcgcgtaacggttcgggtcccgaccgtacggtccgtccggaagggaacggggtcgtgggtgtcggtctacgtacggttattaagtaggtaggacgtagggtacgtgaccggtaacacggtaccgtacggaccggtaccgtacggtacgggaacggcccttacgtcgaaccctcgtacgtaccacggaacgaaccgtaaccgaccgtaaagaaccgtaccgtacgttacgttaaccgttcgttacgaaaccgtaagtaacgaaacgttacggtacgagggttaacgaccggaaccgggttaaaccgaccggtaccggtaccgttagtttaacggttaacttacggtttaggacgtaaccgggtaaatacggtaacggtcgttaacgggacgtaacccgttacgggaccgtttaaccgggacccggttaccccgggtagttaaccccgggg

SEQ ID NO: 120732 - DNA, 677 bp, Homo sapiens
  misc_feature: GYAE6OF02GN4TY.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtgtccccaggacagacggccaggactcacctgctctgggagatgacattcgaccaaagcaatatgtacttattggtaccagcagaacgccaaggccgacgcccctaggtcgctgggtgtataacgtaataaagacaggtagaagacggccctcggacgggtactcccgtaggacgtacgtactttctcgtcggtccttaccgacgaccttacgaagggtacctaaacgtacgtaccgtaacgtttacgaacctagtacgtaggtacgggacgtaccgagggacaaggaaggtataggacgggtactacggtaaacttagtttaaccgtagtaactaagtccgtaagacaacgaacgtagaccgtaaggtttacggttaacggttttttgggtcggtttaccgggaccgggtaacgggtaaccgtaacggtccgttaaccggttacccggttcggttaaacggtcccggtaaccggtacccggaccggttccccg

SEQ ID NO: 120733 - DNA, 662 bp, Homo sapiens
  misc_feature: GYAE6OF02JDERB.2.38.D05.1.454.CMB.1.raw
  modified_base (560)..(560): a, c, t, g, unknown or other
  misc_feature (560)..(560): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgagcctctatgagctgacacagcccaccctggtgtcagtcgtccccaggaccagacggccaggactcactcgctacgtggagactgactattcgaccaaagcaatactcgaacttttagtcggtaccagaccgaagaaaccgccgtaggccgaaccggcccctggtcgtcgttagggtacacgttaagtaacgtaaaacgccgtaaggtcggaaggtacccggtacccttgggaaacggttcctacccgtaggacgtccggtactttccgacgtcggtacctccaaggtctacgacggaactaccgtagtccgaacgttcgacctaagtccgagtacggtacgtaccgacggtcaaggacgtagtacggtacgtacgtacgtaattcgtacctagtaacctagtaccagactacganacgtacgtaaggttcgttaggttttggtacggtacgggacggtaacgggaccgtagtacgtaccgtacgtacggtcggttaccaccggtaccgacgtacccg

SEQ ID NO: 120734 - DNA, 614 bp, Homo sapiens
  misc_feature: GYAE6OF02HV6MW.2.38.D05.1.454.CMB.1.raw
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (363)..(363): a, c, t, g, unknown or other
  misc_feature (363)..(363): n is a, c, g, or t
  modified_base (468)..(468): a, c, t, g, unknown or other
  misc_feature (468)..(468): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcgttgggttttccttgttgcttaattttaaaaggtgtccagtgtgaggtgcagctggtggtagccgggggagcttagttcagccgtgggggtccctgagactctcctgtgcncgctctggattcnccttcagtagctatggatgcacgtgggtcccacaagctccgaggggaggctgggtgtggtctcgacttaattaagtgtagagtaggagagtacgaanaagcgacgaccggtacgtcggacggaacgggtccgtatccgactactcctaccgaagaacgaccgaaacgtaccaaaggaaccaccgcttacggattaccgttanaaccgttaaattcggaacttcgggtactaggaacgacgaacgtacgggactacggttctacgtgtttaagtcctagtaagacgtaaagacgtatacggagtaccgagtaccgtcggttaaccgggacggtccgtacgtaccggggg

SEQ ID NO: 120735 - DNA, 682 bp, Homo sapiens
  misc_feature: GYAE6OF02IJZN0.2.38.D05.1.454.CMB.1.raw
  modified_base (262)..(262): a, c, t, g, unknown or other
  misc_feature (262)..(262): n is a, c, g, or t
  modified_base (477)..(477): a, c, t, g, unknown or other
  misc_feature (477)..(477): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacgaggctctggacggccctcctaatggagtcctggaaccacgacgtcccctaccccgttcgggtgtccaggtccgtaccccgaggacacggaccggaccaaggctccacctggcctgtagggatcncgacagttcgaaccaaagaccaaagtctgtactttaagtcgaaccagacgaagacgacgaggtcccgaccggtccctggtcgcgtggtagtaataagtaagtaaacgagaggtaggacgtacggtcccgagacggtactccgaggtagtccgtacttcgtacgtcgactcgagtcaacggaggaacacgcgtgtaccgtagacacgtagtacggngtacgtcgaagccgaagcgaaggtacgaggtactagtactagtcgtacgtactaacgcgaagctaaccgagtgtaaccggtggtttacgggtttaccggttttgggacgtttaccgggtaacgggggaaccgtaacgggtagtacccgttaccggtaaccggtacggttaccggtacccggtacggcccggtaagttcccccggg

SEQ ID NO: 120736 - DNA, 671 bp, Homo sapiens
  misc_feature: GYAE6OF02H1VAD.2.38.D05.1.454.CMB.1.raw
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcactgggtccgcaagcctccgagggacggggctggtggtgggtctacgacgtattaataggtgagtggggatagacacgaagccgtacgcggactccggtaggaacggggcctattccaccatcctaccaagacgaacaaccgaccaaagaaccacgtacttagtaactctagaacaaagtacgaactagtctaggaagacggaccggaacggaccgacggtctaggttagtaatttcgtagtcgaacgaaaggaacgtagtacgacgaacgagtacggtaccgttacgggtaacccggtacccggtaacggtttaacccgggtacggggggtaaccccgtaaaccgggggtaacccccgtttcggggtacccctaacccggtttccccggtaccccttacggaccccgttaaccccccgg

SEQ ID NO: 120737 - DNA, 796 bp, Homo sapiens
  misc_feature: GYAE6OF02JR1AR.2.38.D05.1.454.CMB.1.raw
tcagacgctcgacacacgaccggtgctcgatttagtatctgatagttggggtttgggggaagaggaagactgacggtcctgccacaggtggtgctgggcacggtgggcactcgacacaacatttgcgctcaactgtcttgtccagtgtgaggtgcagctggtaggacggtccgggggaggtctttaggttcaggtccggttcggggggtccctgagactcctcgtgtgcacgtccttcgtaggtacttccgtaccttcgagttacgacctacgttggtattcgactaaccgttcggggtcccgtaccgaacgtccgtaccggaaagggggaacgggggtccgttaggggttacgggttcggggttaccctacgtaaaccggttagtttaaaacgttggttgtaaggtcggggaagtaacggaccgtaaacgtacggaccgttaaaccggcggtaccttccgggtaagggaacggtccgtactaccaccgattccgtacgaacgacgaacctaaccgaccctaaagaacgacgtcgttagtacgtccgtagaaacgtaaactggaaaccgttgtaacgtaggaacggtaccgaccggtaacgggaccgtacggttgttacgttacgtaactttcggtacggtacgaagtaagtaacgtacgaagttcaaggtaccgtagcccggttacggtacccgtacggtaaccggtacgggtacccgggaaccggttaacccggacccggtttacggtccctaacccggtttaccccggacttaccccggtaccgtacccccgg

SEQ ID NO: 120738 - DNA, 805 bp, Homo sapiens
  misc_feature: GYAE6OF02J2AI7.2.38.D05.1.454.CMB.1.raw
  modified_base (188)..(188): a, c, t, g, unknown or other
  misc_feature (188)..(188): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacaggctctgacggccttcctatgagcctagaccacacgccctaccctcggtntacagtcctacccgaggacacggacggccaggactccaccgtgctacgtggaagctgccagttacgacccaaagctattagtcgtacttagttacggaaccagacgaggaacgcccgaggacccgtaccggtccccttggtcgtccgtagggttagtaaacttaataaacgtaaacgaccggtaagggtcgaaacgggtcccggtacccgtacgggtaaccgggaaccgtccccgttaagggaaccggtacgttacgttttacccgttggttcccggtaacccgtttccggaccgttacccggtaacgggttaacccggggaaccttaaaccggtacgggtaaccgttaaccggtttaaccgcctaacggtccgggtaacggtaacgggttaccgtacccggtaaggaacgggttaaaccgaaggtaacgttcggacggtacgtttaccgagtttacttacggttacacgtaacttgaaccgacgtacgaacgtcgtaacggttggtttaacccgggttttagggtttgggtaccggtttacgggaaccggggttacgaaccgtacggttaccgttcggtaccgttccggtaagcccggaacctcggtacgtccccg

SEQ ID NO: 120739 - DNA, 675 bp, Homo sapiens
  misc_feature: GYAE6OF02IRBVT.2.38.D05.1.454.CMB.1.raw
  modified_base (175)..(175): a, c, t, g, unknown or other
  misc_feature (175)..(175): n is a, c, g, or t
  modified_base (532)..(532): a, c, t, g, unknown or other
  misc_feature (532)..(532): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccggggngtcttagtcagccgtgggggtccctgagactctctgtgcagcctgtgattccaccttcagtacgctacgtggatgctcgtcgggtccacaagctaccggaaggggtaagggctgggtgtgggtcctacgaacgttaattaaacgtaggttgaaggtacggggtagtacgacaacgaaacgcgtaccgacggtactccggtaaggacggcctagtaccaccagtcctccgaagacgtaaacaccgacgaaaagaaccgacgtactagtactcgtaagaactaaaagtcgaaacgtgtagacggaggtaaccgacggaacggccgtacgggtcttacgttaaagtcttaacggtcgtanaaccgaagtacggtaataccgacgtagtaccgaggttccgttacgggaccttaaccggacggtttaacccgggacggggtacccgtaacggggtaccttcggaccccttaccggttcccaccgttacgtacccgtaaccccgg

SEQ ID NO: 120740 - DNA, 674 bp, Homo sapiens
  misc_feature: GYAE6OF02GLAHJ.2.38.D05.1.454.CMB.1.raw
  modified_base (122)..(122): a, c, t, g, unknown or other
  misc_feature (122)..(122): n is a, c, g, or t
  modified_base (180)..(180): a, c, t, g, unknown or other
  misc_feature (180)..(180): n is a, c, g, or t
  modified_base (386)..(386): a, c, t, g, unknown or other
  misc_feature (386)..(386): n is a, c, g, or t
  modified_base (541)..(541): a, c, t, g, unknown or other
  misc_feature (541)..(541): n is a, c, g, or t
tcagacgctcgacacacgaccggtgctcgatttagtatctgatagttgggtttgggggtgggtccaggaggcagaactctgggtgtctcaccatggcctggatccctctacttctccccctnttcactctctgcacaggctctgaggcctcctatgagctgacacacgccaccctcggtntcgagtcgtaccccaggacagaccggccaggactccacgtgactctggagattcgctattgacccgaaagtctaattaactgtactttagttacggtaccagtacacgaacgccgacggccgacggccccttggtacgcgttggtagataagtaataaacgacgagtacggtagacggtccctacgacggtaccttccgtagacgngttactcgttccgtggtccctacgtacgttcacgtacgaactaacgcgtaccgtacggttcgacctagtaccgtagtaccgtagtccgagtacgagaagtacgtagagtaccgtagtactatttcgacgttgtacgtcacgaacgacgtaacganaccggttaggtttaacccggtttgttttacggggttacggttacccgggtaacggtacggtaacccggaacggtttccgacggtacccggtacgttacgggaacccgtacccggtaccccgggtaggtccccg

SEQ ID NO: 120741 - DNA, 891 bp, Homo sapiens
  misc_feature: GYAE6OF02HNKOB.2.38.D05.1.454.CMB.1.raw
tcagacgctcgacacacgaccggtgctcgatttagtatctgatagctcgggttttccttgttgctattttaaaaggtgtccagtgtggaggtgcagctggtggagtccgggggagcttagttcagcctggggggtccctgagactctcctgtagcagtcctctggattcaccttcagtagctactggatcgcacgtggtccgctaagctaccgaaggggacgggctgggtgtcgggtctcgtacgttattaatagtggagtaggggaagttacgacaacgaacgccgtaaccggccggtaccgttccggtaggaacggggccgtaattacccgacctactacccgtaccaaggaacgaacctaaccgaacccaaaacggtaaccaccggtacttagttaccttaccgtacggaacctaaaagtacggtaaacctacggttacgtacggaaacggaaccggtacccgggaaacggaccggtaacccggtacggtttacggttaaggttttaaaccgttttaacggtaggttacgggtaaaacctaaacgggtaagttaaacggtaacggaaccgaacgggtaaccgtaacgggttaccgggttaccggggttaacccgggtacccgtaaacgggtttaccgggaaccgggggttaaccccggtaacccgggggtaccccgtttaccggtacccgttacccgttacccttcccgtaacccggaccccgttccccgtaaccccgtaaccggaacccgggtccccgttaacggttccccgttccccgttaccccgtccggttccccgcccggttccgtcccgtacccggaacggtccgtaccccgacccgttaccggacggtacccaccggaccggtaccggcccggtccccggg

SEQ ID NO: 120742 - DNA, 778 bp, Homo sapiens
  misc_feature: GYAE6OF02JEX6B.2.38.D05.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
tcagacgctcgacacacgaccggtgctcgatttagtatctgatagcgtgggttttccttgttgctattttaaaaggtgtccagtgtgaggtgcagctggtggagtccggggaggcttagttcagcctgggggtccctgagactctctgtgcagcctctggtattcaccttcagtagctacgtggatcgcacgtgggtaccncgaagctaccgaaggggagggtctggtgtgggtctcgacgttattaagagtgagtgggatgacacagctacggcgtacgttcgaggacgggcctatccactacgtccnccgtaaggacgtaaccaaccgccgaaacgaccgaccgtctaggtactcgtacgactaaaggtacgaactagtccgaggaagaccggtaccggaacggtaacccgtcggtacgttaggtacctttaacgtttacgttcggacgtaaccgtaaaggtaggtacttaacggtaccgtaggtaaccgtaggtcccgtttacgggaaccccgggtaacgtaacccgggttaccggaccggggtaaccgtaaccgggacccgtttacggaccccgttcccgtaccgtcccgtacgtaccccgacccgtaacccggaaccggtaacccggccccgttaagttcccccgggtttaccctcccgggtacccgggtccgtaacccggtccgttaccggtacccggacgggtaaccctaccccgggtaccacccgggtaagcccggttaacgaccccggttacgggccccggttaccggg

SEQ ID NO: 120743 - DNA, 756 bp, Homo sapiens
  misc_feature: GYAE6OF02H2ZUR.2.38.D05.1.454.CMB.1.raw
  modified_base (245)..(245): a, c, t, g, unknown or other
  misc_feature (245)..(245): n is a, c, g, or t
  modified_base (388)..(388): a, c, t, g, unknown or other
  misc_feature (388)..(388): n is a, c, g, or t
  modified_base (604)..(604): a, c, t, g, unknown or other
  misc_feature (604)..(604): n is a, c, g, or t
  modified_base (610)..(610): a, c, t, g, unknown or other
  misc_feature (610)..(610): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgacggcctcctatgagctgacacacgcccacccgttcggtgtcacgttcgtccccgaggacaggaccggaccgaaggactccaccgtgtccgtcgtcggganatcggactaacgttcgaaccgaaaagtctaaattagtagttacgttttaacggtttcggtaacccgtaaggaccaacggaaaccgacccgacgggtaccccggaccgggttcccccgttagggttcggtaccgttggggttanaacgtttaataaacggttaaaacgacgtacggtttaggaacgggtacccggtcccctaacgggtaacggtacccttacccgtaggaacggtcgtacgttttccgtacgtcggtacccttacgacgttccgtaacggaaccggaaccgtaaacgtcggttaccgtacggtttacaacctacgttacgaggtcggtaacgtcggaagacgagaacgtntacggngtcgtacgtacttaactcgtacgtacagtcgacgaccgtagacgcggtacgttaggtttacgttttacggtttgggtcggtacgggtacggacggtaacgtacgtcggacgttacccgcgtacggaccgtacaccggtacgtcccg

SEQ ID NO: 120744 - DNA, 713 bp, Homo sapiens
  misc_feature: GYAE6OF02G09JJ.2.38.D05.1.454.CMB.1.raw
  modified_base (202)..(202): a, c, t, g, unknown or other
  misc_feature (202)..(202): n is a, c, g, or t
  modified_base (221)..(221): a, c, t, g, unknown or other
  misc_feature (221)..(221): n is a, c, g, or t
  modified_base (251)..(251): a, c, t, g, unknown or other
  misc_feature (251)..(251): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggaggtccgggggagcttagttcaggtccgtgggggtcccngacgacctctcctgtgacncgcctgtggattccacttcagtacgctagnggatcgcacgtcggtcccgacgtaagcctaccggaggggacgggcgttgggtggtcggtcctacgtaacggttaattaagtaggtggtaacggtgggtaagtacgacaacgtaacgtcgtaccggacggaccttaccgggtaggaaccgggtcctacgttaccgaccgtactccgtaccgaagtaaccgaacgaacccgaccgaaagaacgtaccgtactttacggatacgtaacgaaacgtaaaagtcccggaaattcgtacgagggaaccgaccggaccgaagacccgttacggtacttaggttccttaaacgttccgagtaacccggagtaaacgagtaataccggacgtagtccgacgtcggtacggtaccgaaccgttcggttaaaccgggccgggaaccggtaacgttaccgtacggggtcccttacccggtacctacaccccggaagtcccccgg

SEQ ID NO: 120745 - DNA, 883 bp, Homo sapiens
  misc_feature: GYAE6OF02FTXQ4.2.38.D05.1.454.CMB.1.raw
tcagacgctcgacacacgaccggtgctcgatttagtatctgatagttgggtttgggggtgggtccaggaggcagaactctgggtgtctcaccagtggcctggatccctctacttcctccccctcttcactctctgcacgaggctctgaggcctacctatgacgctagacaccacgcccacccgtcggtgtccgagtccgaccccgaggaccgacggaccggaccaggtactccaccgtgcctcgtaggacgtagtcgtactacgttacgaaccgtaaacgactaaacttagttacgttaccgttttaacggttaccggtaaccgtacggaacggtaaaccggaaaccggaaccccggtaaaccggggaacccccggtaacccggggttcccccccggttggggttaccggttaccgggtttacggggttaagttaaacgtttaaaacgttaaaacgttaaaaacggaaccggttaaaggttaacgggaaccgggtaaacccgggttaccccgttaccgggaacgggttaacccttcccggtaacggaccgttaccggttacgtttcccgtacgttccggtacccgtaccgtaacgacgtacggtaacggaaccctaacgtacgtacgtacgtacgaacgtacgtcgtaacggtcggacgacgacgggaacgaagtaaggtacgtagacgtcgtacttacgttacgttacgtacgtagtactacgacacgacgtaaccgtagtacggttacgttacggttttacgggtttcgggtacggggttacgggtaaccgggtaaccgggtaacttacgggtaccggttaacccggtacccgggttacggaaccggttacccggaccggtacccggtaccggttccccgg

SEQ ID NO: 120746 - DNA, 695 bp, Homo sapiens
  misc_feature: GYAE6OF02FPYOF.2.38.D05.1.454.CMB.1.raw
  modified_base (272)..(272): a, c, t, g, unknown or other
  misc_feature (272)..(272): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctggagtactctcctgtgcacgcctcgtaggattccacctttcagtacgctacgtggatgcacgtcgggtccnccaagcctaccgaggggaagggtctggtggtggtctcgaacgtattaatgtagagtgggagtagcgaacagctacggcggtactccggtagacgggtcctattccactatcacagaacaccaaacgaccaaagaccacgtcgtagtactcgtgactaaatacgtaactaggttccaggtaacggaacggtccggaaacggtacccgtacggggtacttacgggttacttaccgtttaacgtgggttacgtaacgaaacgtaacggtaagttaacgaccgaaagtccggtaaggaccggttaccggggtaccggtaacccgtaacggttaccggggtacccgggggtaacccgaaaccggggttacccccggtagggttacccggtaccccgttaccgtacccggttacctacccgtacccccg

SEQ ID NO: 120747 - DNA, 700 bp, Homo sapiens
  misc_feature: GYAE6OF02IDBVQ.2.38.D05.1.454.CMB.1.raw
  modified_base (344)..(344): a, c, t, g, unknown or other
  misc_feature (344)..(344): n is a, c, g, or t
  modified_base (391)..(391): a, c, t, g, unknown or other
  misc_feature (391)..(391): n is a, c, g, or t
  modified_base (488)..(488): a, c, t, g, unknown or other
  misc_feature (488)..(488): n is a, c, g, or t
tcagacgctcgacacacgaccggtgctcgatttagtatctgatagttgggtttgggggtggtccaggaggcagaactctgggtgtctcaccatggcctggatccctctacttctcccctcttcactctctgcacaggctctgacggcctcctatgagctgacacagccaccctcggtgtccagtcgtccccaggacagacggccaggactcaccgtgctctggagatcgctagttcgaccaaagacaaatgtagtacctttagttcggtaaccagacgaagaacgccgaacggacccgtaccggccccttgtcggcgtcggtagtaatactaaagtaacgacgngttacggacgaacggcccttacgaacgggtctccgtagacggtactnttcgtcgcgtcctcgagtccgtacgaacgggtacaacgtacgtacgtaccgttacacgtacgtacggtagtcgtacgtacaacggactaggaaacgngtaaggccgtagtacgtaactttagtaccttacggtaattacaccgtaacgacggaacgaacgtccgtaaaggtttacgggtttaccgggttttaccggtttttaggggtaccggttcccggggtaacggggtaaccgtacggtaaaccggtccgttacgggttaaccgtccgggttaacgtacgggtacccgtacggaccgggttccccgg

SEQ ID NO: 120748 - DNA, 619 bp, Homo sapiens
  misc_feature: GYAE6OF02ITDZ7.2.38.D05.1.454.CMB.1.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (411)..(411): a, c, t, g, unknown or other
  misc_feature (411)..(411): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctctatgagctgacacagccacccgtcggtgtcaggtcgtccccaggaccagacggccaggatccaccgtgctcgtaggacgatgacagttcgaccaaaagcaatatgtcttatcggtaccagcaagaagccaggccagcccctgngctggcatanataaagcagtgagagccctgaggtacacctaggactcggtacttacctcgtcggtaccttcgacgtccgtaacgacggtaacaacgtagtacctacgtcgaactacncgtaaggtcggacgttaccgaagtaccgaagaaacgtacggtaggtaacgtcgtaacgtaattacttacgtagtacctaagtacagtacacggaactaggactaggttaggttttaaccgtttggggtacgttcgggaacggtacggaaacgtacggtacgtacgtacccgggtacttaccggtacgaccgtaccgtacggtacccgg

SEQ ID NO: 120749 - DNA, 949 bp, Homo sapiens
  misc_feature: GYAE6OF02FKYAX.2.38.D05.1.454.CMB.1.raw
tcagacgctcgacacacgaccggtgctcgatttagtatctgatagttgggtttggggggtgggtccaggaggcagaactctgggtgtctcaccatggcctggatccctctacttctccccctcttcactctctgccacaggctctgaggcctcctatgagctgaccacacggcccacccgtcggtgtcagtcgtccccaggacaggaccggcaggactccacctgctcgtggagactgcattcgaaccaaagtcaaattcgtagtcctttaagtttacggtaacccgaagtacgaaacggaaccgaccggaacgggtcccgaaccggggccccccgttggtcggtccggttagggtcgaagtttaagtaaacgttaaaacgaacgtaaggttaggaacgggaccggtaccccgttagggaacgggggttaccttcccccgtaggaaccggtaccgttacttttccgttccggttacgggtcccttaccgtacggtaccgttaccgggaaccgggaaccaaccgttaccggttaccgtaaccgtttaaccggaaccgtagttacccggtaagggttcgggtaacccggtaccgtaacgggtaccgtaaagggagtaacggtacgggtaacggtcgttaaccggtaacgtttaacgtttaaccgtttacgttaacgtaacgttaacggaacgtaacccgaaacggtaaaccgtaccggttaacggttaccgggggtttttaacggttttaccgggggttttttttaccgggggtacccgggttttaaccggggggttaaccgggggggtaaacccggggtaaaacccgggtaaccgggttttaccccggggtacccggttttaacccccggggtaacccgggggttttaaccccgggtaaccggtaaccccccgggggttaaccggaccccggggttttaacccccccggg

SEQ ID NO: 120750 - DNA, 664 bp, Homo sapiens
  misc_feature: GYAE6OF02GV5B0.2.38.D05.1.454.CMB.1.raw
  modified_base (122)..(122): a, c, t, g, unknown or other
  misc_feature (122)..(122): n is a, c, g, or t
  modified_base (291)..(291): a, c, t, g, unknown or other
  misc_feature (291)..(291): n is a, c, g, or t
  modified_base (328)..(328): a, c, t, g, unknown or other
  misc_feature (328)..(328): n is a, c, g, or t
  modified_base (470)..(470): a, c, t, g, unknown or other
  misc_feature (470)..(470): n is a, c, g, or t
tcagacgctcgacacacgaccggtgctcgatttagtatctgatagttgggtttgggggtgggtccaggaggcagaactctgggtgtctcaccatggcctggatccctctacttctccccctnttcactctctgcacaggctctgaggcctcctatgagctgacacagccacctcggtgtcagtcgtccccaggacagacggccaggactcacctgctctggatatgcattgaccaaagcaatatgtctttagtcgtacagcagaagccacggcacggtccctgcgcgtggnatataagaaagcagtgagacgcctaggaggactccgngacgacgtatttccgcgttacggctccgacggtacctacggaacgggaaccaaaccggttcgtaccgtaaccgggtttcaaacccgtagtacggtaacgggtacgggttaccgtaccggaacgggtacgaaacgggtaacgnggttacgggacgtacgttaacgtaactttaacgttacgtacgtaacgtaaccttcgaagtaccaacggttacacgggtcttaacgggtttacgggtttagttttacgggtacggttaccgggtaaccggggaaggttaacccaaggttccgtacggttacctcggtacggtccctaacggaccgtacggtcccg

SEQ ID NO: 120751 - DNA, 756 bp, Homo sapiens
  misc_feature: GYAE6OF02FJSBK.2.38.D05.1.454.CMB.1.raw
  modified_base (231)..(231): a, c, t, g, unknown or other
  misc_feature (231)..(231): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgacggcctcctatgagctgacacagcccaccctcggtgtcagtcgtccccaggacacgaccggccaggatccacctgcctcgtggganatgctattcgaccaaagcaatatgtcttagttcggtaccaggcaagaacgcccgacggacccacggcccccttggtcgcgttggtagaacttaataacgtaaaacggacctaggtacggaacggaccggtccccgtacggacggggtacctccccggtaggacggtacccgttaacgtttccgtacggtcgggtacccttaccgacggtacctaacggaacggggaacctaacgtacgtaccgtacggtttacgaacctagtacgtaggtacgggtacgtacccgaggaccgaaggaagtcgtacggaggttacgtacgtacgttacgttaaccgtacgttaacaacgtccgaaggaccgtaacgaacgacggtacggttaacgggttacgggtttttacggtttttacggggtacgggttcccggggtaacgggggtaccggtaacccgtaacggtccggtaccccggtaccggttacccggttacgggacccggtaacccggtacccggtaccggtcccccgg

SEQ ID NO: 120752 - DNA, 645 bp, Homo sapiens
  misc_feature: GYAE6OF02FLZYB.2.38.D05.1.454.CMB.1.raw
  modified_base (209)..(209): a, c, t, g, unknown or other
  misc_feature (209)..(209): n is a, c, g, or t
  modified_base (526)..(526): a, c, t, g, unknown or other
  misc_feature (526)..(526): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccagganccacctgctctggagatgcattacgaccaaaagacaatagtcgtactttaagttcggtaaccaggacgaaggaacgtccacgggccctaccgggtcccccctgtcggtcgttgggtagtaataataaacgtaaaagacgtaggtcggaaggtacggtccctacggtacggactccgtacgagtacgtactttcctcggtcgtcctaccgaggtcctacggaggaacctaacgacggtacgtacgttacgacctaacgtcgaggttacgggacgtacgacgagaaggaagtagtaggacgcgttacgaacttagtacngtaacagtacgagtacaacgtacgagtacgtgttacgggtttcgtttagggtcggttacgggaggaggtaaccgagtacccggtcgtaccgtcgtagtaccgacggtccgacgtcccgg

SEQ ID NO: 120753 - DNA, 820 bp, Homo sapiens
  misc_feature: GYAE6OF02FQ9SU.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggtttttccttgttgcttattttaaaaggtgtccagttgtggaggtgcagcgtgggtggaggtccgggggaggtcttagttcacggccgtcggggggttccctgacgtacctctctgtgcagcctcgtggtacttcctacctttcaggttacgtccttagtaggattacgctacggtcggggtcccaccgaacgccgtaccggaaggggaaggggtcgttgggttggtcgggttcctacgtaacgttaagttaagttggtagtaggttagggggtaacgttacgaacgaacgtaacggtaccgtaaccggtaccgggtaaccgttccgggtaagggaaccggggtacccgttaacgttacccgtaccctaacgtttcccgtacccgaaacggtaacgtaaacccgaaacccggtaaccgaaaaccgaaaacccgccgggttactaacggtttacttaccgtaacggtaactaaaacgtggaaaccttaggttaccgttaagggaacggtaccgggaccggaaacggggtacccaacgggggttattacgggttttacgttaacgttttaccgtaggtacggtaaggtaaaggtaaggtaaacgttaaccggacggtaacggtaccggacggttaccggtacggtaacccgggtacccggttaacgggtacccgggg

SEQ ID NO: 120754 - DNA, 724 bp, Homo sapiens
  misc_feature: GYAE6OF02FVA5D.2.38.D05.1.454.CMB.1.raw
  modified_base (142)..(142): a, c, t, g, unknown or other
  misc_feature (142)..(142): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctcngacggcctctatgagcctgacactagcccacccgtcggtgtcagtcgtccccaggacaggacgcacggatccacctgcctcgtagggactatcgactagttacggaacccgtaaaagacctaaattaagttcgtaccgttttaagttaccgggttaaccaacggaccgaaaggaaaccggtcccgtaacgggcccgtaaccgggtcccccctaggtccggtgttacggtagtaactattaaacgtaaagaaccgtaggtaacgacggaccgtccgacgagggtacctccgtaggacggccgttaattccgtcgtacggtccgaccgtaacgtcctacggaaccgggaacaacgtaacgtccgtagtacggtaccagtacgaggtaccgtacgccgaggactaaggatgtacgcggtatacgtactagttacttcgtaactagtactaacgacgagtacgaggtacgtaaggtttcgtttacggtttacgggtcggtacggggtcgggaaacggttcccgtaaggttacccgttaccggccgttaacgtaccgggtaccgaccgtaccggtcgttaaccccgg

SEQ ID NO: 120755 - DNA, 792 bp, Homo sapiens
  misc_feature: GYAE6OF02HFADC.2.38.D05.1.454.CMB.1.raw
tcagacgctcgacacacgaccggtgctcgatttagtatctgatagtttgggtttgggggtgggtccaggaggcagaactctgggtgtctcaccatggcctggatccctctacttctccccctcttcactctctgcacaggctctgacggcctcctatgagctgacacagcccaccctcggtgtcagtcgtcccaggacagacgcaggatcacctgctcgtggagatgcattcgaccaaaagcgaaatagtacgtactttaagttcggtaaccaacggacgaacggaaacgaccgaacgggaccccgaaccgggtccccccgtggttacggtccggttagggtacgtaacgttaaattaaagttaaaaacggaaccgtaagggtacggtaacggaccggtacccccgttacggaacggggtaccttaccccggttaggaaccgtccggttaacgttttccgttacgtaccgggtcccttaccgacggtaccgtaacggtaaacggggaacctaaaacgtacgtaccttaccggttacgaaccctaagtacgtacggtaggtaacgtccgaacggacgaaagaagtaggttaggaagtcgttaagtaacgtttattaccgtagttaacgaactacgaagtaccgaacgtaacgacggtactaacgggttttaggttttaacggtttttcggggtcggttacggggtaaccggggaacgggtaacctaacggtaccgtaccgttacccggttaaccggttacggtaccgaccggtacccggtaacggttccccgg

SEQ ID NO: 120756 - DNA, 721 bp, Homo sapiens
  misc_feature: GYAE6OF02IT8VI.2.38.D05.1.454.CMB.1.raw
  modified_base (682)..(682): a, c, t, g, unknown or other
  misc_feature (682)..(682): n is a, c, g, or t
tcagacgctcgacacacgaccggtgctcgatttagtatctgatagttggggtttgggggagccccagccctgggattccccagctgtttctgcttgctgatcaggactgcacacagagaactcaccatggagtttgggctgagctgggttttccttgttgctatttaaaggtgtccagtgtgaggtgcagcgtggtgggaggtccgggggaggtcttagttcagccgtgggggtccctgacgactctcctgtgcacgcctcgtggtacttcctaccttcgaagttacgcttacgtggtactcgacaccgttacgggcccgtaccgaacgccgtaccggaaggggtaacggggtcgtgggtcggttcgggtacctacgtaacggttaagttaagtacggtaggtaggtaggggtacgtagaccgtaacgtaacgaccgtacggaccggtaccttaccgggtaagggaaccgggtcccgtaacttcctaaccgtacgtaccctacccgaaacggtaacaaccggtaaacccgaccgtaaaacgaaccgtaccgtaccttaagtaccttacgtaaagacctaaaagttacgaaccgtacgttacgaacggtacggacggtacgaggtaccgacgtcgtagtaacggtacttagtcgtacggaacgtaaggagtactagacggtancggtaacgtccgacggtacccgtacggaccgtaccgggg

SEQ ID NO: 120757 - DNA, 648 bp, Homo sapiens
  misc_feature: GYAE6OF02JBD0X.2.38.D05.1.454.CMB.1.raw
  modified_base (239)..(239): a, c, t, g, unknown or other
  misc_feature (239)..(239): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
  modified_base (372)..(372): a, c, t, g, unknown or other
  misc_feature (372)..(372): n is a, c, g, or t
  modified_base (602)..(602): a, c, t, g, unknown or other
  misc_feature (602)..(602): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggatttcaccttcagtagctactggatgcacgtgggtaccgccaagcctccgaaggggaaggggcttgggtgtggtcncacgttattaatgtgagtgggatacgcaacaagctacggcgactccgaggaaggccattcaccntcncgagcgacacgcaanaccgngactgtancagacaaatcgaangttcagaagacgcggagactcggnttgtagttaattacgtggtacgaacaaggtagaagtacgacgaagacgtacgacgttacgggaccgtaccggtaccgttacggtaccggggacccggtaaccgggtaacccgttaccgggtcccgtaacccgtccctcccgtccgtaccgtaccccgtaccgtaacccggaaccgggtcccctaacgtcccggttacccgttccccgacggtcccgtacccgtcgtcccnccgtacgcgccgacccgtcgaccgacgacgccgacgccggtcccgg

SEQ ID NO: 120758 - DNA, 696 bp, Homo sapiens
  misc_feature: GYAE6OF02JNEBB.2.38.D05.1.454.CMB.1.raw
  modified_base (505)..(505): a, c, t, g, unknown or other
  misc_feature (505)..(505): n is a, c, g, or t
  modified_base (541)..(541): a, c, t, g, unknown or other
  misc_feature (541)..(541): n is a, c, g, or t
tcagacgctcgacacacgaccggtgctcgatttagtatctgatagttgggtttgggggtgggtcaggaggcagaactctgggtgtctcaccatggcctggactccctctacttcctcccctcttcactctctgcacaggctctgaggcctcctatgacgtcagacacagccctaccctggtagtcagtcgtaccccaggacacggacggccagggactcacccgtgccgtacttgggaacggcttcggactacttgacccaaagtcaagtattcggactttacgttggaccagacacggaacgaccacggcaccggtccccgtgtcgtcggtcgtgtaactagtaaatcccgggaatacgaggttacgccggaccgtaccgtacggacggtcctacggaactcggtctttacgtccgttcggaccgtccgtcgtacgtaccgaacggaaggttaccaacggtttctacccggtacgtacgtcgttacgacgggtccgttaacggngtaaccgacgtaaggacgaagtacgtacggacgttnttaacgtacgttaccgtaagttacgtaccgtaatacgccgaaggaccttaggaccgttagtttacgttagggtttacgggttcggtacgggacggtccggaacgtaccgtgtccgttacggtcccgtagtcccggaagtccggtacccgtcccgg

SEQ ID NO: 120759 - DNA, 697 bp, Homo sapiens
  misc_feature: GYAE6OF02GE8QB.2.38.D05.1.454.CMB.1.raw
  modified_base (452)..(452): a, c, t, g, unknown or other
  misc_feature (452)..(452): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggccctcctatgagctgacacgacgcccaccctcggtgtcgacgtcgtccccaggacaggacggccaggactcaccgtgccttcgtggagatcgctagtcgaccaaagacaatatgtacttagttcgtacagcagacgccgacggccgacggccccgtagtgccgtggtagtataataagtaaacgacgtagagaggacgcccgtaggacggtacctccgtaggacggccgttacttcgtaccgtcgaccctcccgagtaccgtaccgaacgggtaaccacggtacgtcctaaccggtacgtaaccngtacgtaggtacgggacgtccgaaggaacgaacgaaaggtaggtaggaacgtacgtaacgtaacgttacgtttacgtacgttaacagtacgacgaacgtaacgtacgaagttacggttacggtttacgggttttacggtttttcggtaccgggtttaccgggaacggggtaacgggtaaccgtaaacggtccgttaccggtacccggttacgtaccggtacgtaccggaccggtaccgtccccgg

SEQ ID NO: 120760 - DNA, 751 bp, Homo sapiens
  misc_feature: GYAE6OF02F8OQM.2.38.D05.1.454.CMB.1.raw
  modified_base (731)..(731): a, c, t, g, unknown or other
  misc_feature (731)..(731): n is a, c, g, or t
tcagacgctcgacacacgaccggtgctcgatttagtatctgatagctgggttttccttgttgctattttaaaaggtgtccagtgtggaggtgcagctggtggagtccgggggaggcttagttcagccgtggggggtccctgagactctcctgtgcacgcctcgtggacttccaccttcagtagctacgtggatgcacgtcgggtccgaccgaagtccgtaccggaaggggaacggggtcgtagggttggtcgggttcctacgtacgttaattaagtaggtgaaggtgggagtacgacaacgtaaggccgtaccggacggtaccgtccgggtagggaacgggtaccgtacgttacccgacctattccgtaccgaaggaacggaaccgaaccggaaccgaaacgaaaccaccgtcgttacgttactcgtacgaaacgtaaactacgaaacgtagtcgaggaacggacgaccggaacggtaccgacggtcgttacgtacggttaacgtttacggtacggacgtaaccgaaaggacgtaaggtacgacgtacgacggtacgtcggtaaccggtacccgacgtacggtaccgggcgggaacccgtaacgggtacccgttccgaccgtacccgtcgtacccaccgtaccgcccgtacccgacgaccggtacctccgtcccggttcccgtcccgtacgccgtactcgcccgagtaccggcacccgtacgacgcgaccnccggtacgccggcgtaccgg

SEQ ID NO: 120761 - DNA, 664 bp, Homo sapiens
  misc_feature: GYAE6OF02IIVOV.2.38.D05.1.454.CMB.1.raw
tcagacgctcgacacacgaccggtgctcgatttagtatctgatagttgggtttgggggtggtccaggaggcagaactctgggtgtctcaccatggcctggatccctctacttctcccctcttcactctctgcacaggctctgacggcctctatgagctgacacagccaccctcggtgtcagtcgtccccaggacaggaccggccaggactccacctgctcgtggagatgctattcgacccaaaagcaaatatgtactttattacggtaccagccaaggaacgccgaggccaggcccctgtgctggtgaatactaataaggactggtagacgaggccctagaggctcccgtgacgcgtatttcgtctacgggctccgagctacggagggaccaacacggttctacggtttacgacctataccgtaggtacgggacgttacccgagggtaccgaaggaaggtagtacgggtaacggctacggtaactaacgtttacgtaggtaacttaacgtacacggtaacgaacggttaccaaggtacgttagggttacgtttttaacgggttttcggggtacggttttccggggacggtaacggggcccttaagggccgttaccgggtacccgttacggtacggtcgtaaccgacccggtaggttaacccccg

SEQ ID NO: 120762 - DNA, 598 bp, Homo sapiens
  misc_feature: GYAE6OF02HRJJ8.2.38.D05.1.454.CMB.1.raw
  modified_base (180)..(180): a, c, t, g, unknown or other
  misc_feature (180)..(180): n is a, c, g, or t
  modified_base (258)..(258): a, c, t, g, unknown or other
  misc_feature (258)..(258): n is a, c, g, or t
  modified_base (309)..(309): a, c, t, g, unknown or other
  misc_feature (309)..(309): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggtcctcctatgagctgacacagcccaccctcggngtcagtcgtccccaggacagacgggccagggtatccgacctgctcgtaggagatgcattcgaccaaaagcaaatatgnttacttggtacccagccgtagaacgccacggtccaggcccctgtagctggngtactatataaagcaggtnagagcctnaggntacctgangatcntggctacanctacagggactaaagntccgagttacgaccgtanacgtagtggtactccggagacgaagaanagtagacgacgacgtatttagttacgtagtacctaagtacgatacaacgaactacgaggtacgttacgggtttaacgtttggggttcggttacgggtacgggtaacggtaaccggtaacgtacggtaccgtacccgggttacgtacgttacccggaacgttaccggaacgtccg

SEQ ID NO: 120763 - DNA, 805 bp, Homo sapiens
  misc_feature: GYAE6OF02H01I9.2.38.D05.1.454.CMB.1.raw
  modified_base (198)..(198): a, c, t, g, unknown or other
  misc_feature (198)..(198): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccnccaagctcgaggggagggctggtgtgggtctcacgtattaatgtgagtgggagtagcanagctacgngactcgngaggctatcacntcncaganacaacgccaagaccacgtctgtaactcgtagacaaaagtgaaaccagttcgtaggaagacggaccggaagggacctaacggggtccttagggttacgtttaacgttttaaccgtgggttaccgaagtaaagggtaacggttaaacgtaggaccggtaagtaccggtaacggtaccgttacggggtaacccggtacccggttaaccggttaaccgggaccggggggtaaccccggtaaaccgggggtaaaccccgtttcgggtaaaccccgttaccccgggtttcccttacccgtttaacccggaaccgttacccccgttaaccccggtaaaccccggtaaaccgggggcccccttaaccgggtttcccggggttaccccctttacccccgggtccgggtaccccgtcccccggttacgtacccggtacccggtacgggtaaccctaccccgtacccggttacccggaaacggtacccgaccggtaacccggacccgggtccccggtacccggg

SEQ ID NO: 120764 - DNA, 781 bp, Homo sapiens
  misc_feature: GYAE6OF02HVOYR.2.38.D05.1.454.CMB.1.raw
  modified_base (660)..(660): a, c, t, g, unknown or other
  misc_feature (660)..(660): n is a, c, g, or t
tcagacgctcgacacacgaccggtgctcgatttagtatctgatagttgggtttggggggtgggtccagggaggcagaactctggggtgtctcaccatggcctggactccctctacttcctccccctcttcactctctgcacaggctctggacggccctcctatgagctagacacacgcccaccccgttggtgtcaggtccgtaccccgaggacacggacggccgagataccgacctgctacgtagggagtagtcgactacgttacgaaccgaaaacgactaatacgttagtacgttttaacggttacggtaacctacgtacgaaacggaacgaccgaacgggacccgtaaccgggtcccccgtggtacggcggttagggtaacgtaacgttaaacgtaaaagtaaaacgtacggtaaggtacggtacggaaccggtacccgtacggaagggaaccgttacccgtaggacggtacgtaactttcgtacgtcggtaccgtaccgtacgtacgaacgaaacgggaaccaacgtacgtaccgtacgtaccgactaacgacggtacggtacgggaacgtaccgtaaggaccgtaaagggaacaggacggtacgagttaacgtaacgttaactagttacgaactaagtacgaacgacgaacgtaanacggtacgttaggtttcgggtttacggtttcggggtacggttacggggacgggttaaccggaccaaggttaccgtacggtacccgttacggtacggtcccgaacggtcccgtacggtcccg

SEQ ID NO: 120765 - DNA, 736 bp, Homo sapiens
  misc_feature: GYAE6OF02GISZQ.2.38.D05.1.454.CMB.1.raw
  modified_base (181)..(181): a, c, t, g, unknown or other
  misc_feature (181)..(181): n is a, c, g, or t
  modified_base (616)..(616): a, c, t, g, unknown or other
  misc_feature (616)..(616): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagcccacccgtcggtntcagtcgtccccgaggacaggaccggccaggactccgaccgtgccttcgtggagattcgctagttcgaccaaagctaatacgtcgtactttagtcggtaccagacaagtacgccgtacggccacggtcccctgtacgcgttggtagtataacgtaataaaggacgtaggtacggacggtaccggtaccctacggaagggtacctcccgtaggactaccggtactttcgtaccgtcgggtaccttaccggacgtaccgtacgggaaccgggtaacctaaccggtacgttaccgttacggttacgaaaccctacgttacggtaacggtacgggtaaccgtaccgtaacgggtacgaaacgggtaagtaacgtcggaacgttacgtacgttaacttacgttacgtacgtaacaacgttcgaacgtacgacgtaccgtntacggttaggttcggtttacggtttgggcggtttaccgggacgggtaacggtaaccgtaccggttacgttacggacccgttacggtaccggaaccgtaccggtacccgaggttaccccgg

SEQ ID NO: 120766 - DNA, 669 bp, Homo sapiens
  misc_feature: GYAE6OF02HBSBB.2.38.D05.1.454.CMB.1.raw
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccaggacagacggccaggactccacctgctcgtggatatgctagttcgaccaaagcaatatgtactttattcggtaccagacaagaacgccgaggccacggtcccctgtcgctgggtnaatataanaaacgcagtgacgcggtccctagagggactccctaggacgtacgtatttccgtcgtcggcctccgagtcgtaccgagggaaccaacgtcgtaccgtacgttcaaccctagtcgtaggtacggaccgtccgaaggaccaaggaacgtgttaacggacggttacgtacgttaaactacgtttacgacgttacgtaactcgtaacgtcaacggtaaccgtacgtacggttaaggtttacgggttttaccggttttagggtcgggtttaccgggaaccgggttacggtaaaccgtacgtaccggttccgtaacccggttcgttaacggtccaacccgggtacccgtaacgtcccccgg

SEQ ID NO: 120767 - DNA, 553 bp, Homo sapiens
  misc_feature: GYAE6OF02HAETF.2.38.D05.1.454.CMB.1.raw
  modified_base (325)..(325): a, c, t, g, unknown or other
  misc_feature (325)..(325): n is a, c, g, or t
  modified_base (340)..(340): a, c, t, g, unknown or other
  misc_feature (340)..(340): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (439)..(439): a, c, t, g, unknown or other
  misc_feature (439)..(439): n is a, c, g, or t
  modified_base (453)..(453): a, c, t, g, unknown or other
  misc_feature (453)..(453): n is a, c, g, or t
  modified_base (460)..(460): a, c, t, g, unknown or other
  misc_feature (460)..(460): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagactctcctgtgcagcctctggattcaccttcagtagctactggatgcacgtgggtccgccaagcctccgagggaacgggctggtgtgggtctcacgttattaagtgtgatgggagtagcanagctacgcgactcgngacggcgatcacatctcagagacaacgacaaagacacgctgtatctanacaaangaacagtcagagacgacggagacacggctgtatacgttactgtanacaagagtatacgnacgacgngtacgtacggtaacggccgtaacgtacggtacggggaccgtaacgggtaacccgttcggtaccctcccggttacctccgtacgccgtaccccg

SEQ ID NO: 120768 - DNA, 799 bp, Homo sapiens
  misc_feature: GYAE6OF02IUUSZ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacacgccctaccctcggtgtccaggtccgtaccccgaggaccgacggaccggccaaggtactaccaccttggccttcggtaggagtatcgactacgttcgaacccaaagcaaattagtcgtactttagttacggtaccagacgaaggaacgccgacggcccgaccggtccctggcgtcggtggtagtataagtaagtaaacgacgtaggtacgaggacccggtaccctaggtaacgggtacctaccgtaggacgtacgtactttcgttaccgtcggtcccgtaccgtacgtaccgtaacggaacgggtaaccctaacggtccggtaaccgtaccgggttaaccaaccgtaacgttaccgggtaagggtaccgggttaccggtaccgggaaggtaaccggtaagaacggtacggtacgggaacggttacgttaacgtaaccgtttacgtaccgttagtaactaaccgtacgtacggaacgacgtaccgtaagtacggtttagggtttacggttttacgggttttggggtaccgggttaccggggtaaggtaaccggttaccgtaccggttaccggtaacccggttacccggttccggttaaccggtaccggaccggttacccggtacggtaccccgg

SEQ ID NO: 120769 - DNA, 776 bp, Homo sapiens
  misc_feature: GYAE6OF02HIM1N.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggtttttccttgttgcttagttttaaaaggtgtccagtgtgaggtgcagctggtggagtccgggggagcttagtcagccgtgggggtccctgagactctcctgtcgcagcctcgtggtacttccaccttcagtacgctacgtggatcgctacgtcgggtcccgacctaacggccgtaccggaggggaacggggtccgttggggtcgggttcgggttccgtacgtaacgttttaagttaagttacggtggtaaggttagggggtaacggtaacgacgtaaccgaaacggtccgtaaccgggaccggtaaccgttacccgggtaagggaaccggggtaccgtacgtttacccacccgtacttcccgtaccgaaggtaaaccgaacccgaaccggaaccgaaacgaaccgacgttccgttaaggtacttccggtaacgaactaaaagtcgaaactacggttacgagggaacgtaccggaccggaacgggtacgtaaccgggttgttaggtttaacgtttagttaccggtggtaacggtaacccggtaaaagggtacctaacggtacgaaccgtacgggaacctacgggtccgggttaacccgggtacccggtacccgggtaaccggttccggggg

SEQ ID NO: 120770 - DNA, 709 bp, Homo sapiens
  misc_feature: GYAE6OF02ITFTW.2.38.D05.1.454.CMB.1.raw
  modified_base (316)..(316): a, c, t, g, unknown or other
  misc_feature (316)..(316): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (421)..(421): a, c, t, g, unknown or other
  misc_feature (421)..(421): n is a, c, g, or t
tcagacgctcgacacacgaccggtgctcgatttagtatctgatagctgggttttccttgttgctattttaaaaggtgtccagtgtgaggtgcagctggtggagtccggggaggcttagttcagccgtggggggtccctgagactctcctgtgcagcctcgtggtattcaccttcagtagctactggatgcacgtgggtccaccaagctaccgagggaacgggtctggtgtggtcctgacgtattaagtagtgagtgggagtacgcacaagctacggcgtactccggtaggaacggctactccactatccgtacganacggaccaacgtccaagaaccgtacgcgttanactcngaacgtaaagtcgaacgtgtcgtagaacgcgtaccggtaacgaccgtggacttaggtacttaacttgngtacacgaaagtacgtagtacgacgacgacgacggtacgtacggtaaccgaccgtaacgttacgggcgggaacccggtacgggtacccgttcggtacccgtacccggtccgtccgtacgtaccgtaccccgtaccgtaacccggaacggttccctaaccgggttacccgttccccgttacccgtccggtcccccgtactccggtaaccgtacccgtaacggccgtaccccacccggtacccgtaacgggcccgtaaccgtaacccggtaccggaccccggttcccggg

SEQ ID NO: 120771 - DNA, 676 bp, Homo sapiens
  misc_feature: GYAE6OF02G82H1.2.38.D05.1.454.CMB.1.raw
  modified_base (254)..(254): a, c, t, g, unknown or other
  misc_feature (254)..(254): n is a, c, g, or t
  modified_base (302)..(302): a, c, t, g, unknown or other
  misc_feature (302)..(302): n is a, c, g, or t
  modified_base (603)..(603): a, c, t, g, unknown or other
  misc_feature (603)..(603): n is a, c, g, or t
  modified_base (621)..(621): a, c, t, g, unknown or other
  misc_feature (621)..(621): n is a, c, g, or t
tcagacgctcgacacacgaccggtgctcgatttagtatctgatagttgggtttgggggagcccagccctgggattcccagctgtttctgcttgctgatcaggactgcacacagagaactcaccatggagtttgggctgagctgggttttccttgttgctattttaaaaggtgtccagtgtgagtgcagctgggtggaggtccggggagcttagttcagcgtggggggtccctgagactctcctgtcgcagcctntggtattcacctttcagtacgtactacgtggatgctacgtcgggtccncaagccgtcgaaggggacgggcgtagggtcggtgggtactcgtacgttaattaacgtaggtgtacgtggagtacgactaacgaacgtcgtacgcggtaccggtacggcgggtaacgggccgtagttccaacctacgttcccacgaaggtaaccggaacctaaaaccggaccgaaaacgtaaaccgtacggtccttaaacggtcttacggtagtaaacgaaataacggactacggttcacgggtaaacgcggaaccggtacggaactaccggggttaactgtttaaaccgtagtttaaccgnggtacgaactaacggganaatacggcaaccggtgtaccgtcgtacggtaaccggtacccgtaggttacccggg

SEQ ID NO: 120772 - DNA, 671 bp, Homo sapiens
  misc_feature: GYAE6OF02HS668.2.38.D05.1.454.CMB.1.raw
  modified_base (527)..(527): a, c, t, g, unknown or other
  misc_feature (527)..(527): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggagtccgggggagcttagttcagccgtggggggtccctgagactctcctgtgcagcctcgtggacttccaccttcagtagctacgtggatgcacgtgggtccccgccaaacgtccgtaccgaaggggaacggggccttggggtggttcgggttctccgtacggttaattaaagttaggttggaaggttggggagttagacaacgaagcctaacggcggacctccggaggaacgggccgtacttccacctagtcctacgagacgaacaaccgacccaaagaaccacgctatagtcgagaactaaagtcgaaactgttacaggacgacgaccggtaacgacgcggtacttgtagttaactttacgngtagacgtaaagagtagtacgcgagtacgtacgcgttacggaccgcccggtaaacgtaccgggtcggggaacccgtaaccggggtaaccccgtttcgggaccctaccccggtttacccgtcccttaccgacccgttacccccgg

SEQ ID NO: 120773 - DNA, 748 bp, Homo sapiens
  misc_feature: GYAE6OF02G63YV.2.38.D05.1.454.CMB.1.raw
  modified_base (384)..(384): a, c, t, g, unknown or other
  misc_feature (384)..(384): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
tcagacgctcgacacacgaccggtgctcgatttagtatctgatagttgggtttggggggaagaggaagactgacggtcctgccacaggtggtgctgggcacggtgggcactcgacacaactatttgcgctcaactgtcttgtccagtgtgaggtgcagcgtggtggaggtccgggggagtccttagtcagtccggtggggggtcctggacgaccttcgtccgtgtcgcacgtcctcgtaggtacttcctaccgttcagtacgtcctaacgtggaacttgaccgtacggtcgggtacccgaccaacggccgtaccggaggggtaacgggtcgttgggttcggttacgggtctacgtaaggttaaacgtttaacgtaggttacggnggtaaggggacgtacgaacaacgaacggtcgtaacggaccggttaccgtaccgggtaagggacggggacccttacgtaccgaaccgtacgttcctaacgacggaacctaacgaaaccgaccggtaaaacacgtcgtactagttacncgtaanaacctaaagtacgaacgtacgtacgaaggacgtacgaccggaaggtaccggaccggttatacgggttattacgttacgaggttacgaacgtaaaggcgtaacgttacggtaccaggtaaccgagttaacgtccgggaaccgtacccggtacgtaccgggacgggcccggtaaacggccgttacggtcccgtactcccgcctacgcctacccg

SEQ ID NO: 120774 - DNA, 714 bp, Homo sapiens
  misc_feature: GYAE6OF02G3SMY.2.38.D05.1.454.CMB.1.raw
  modified_base (582)..(582): a, c, t, g, unknown or other
  misc_feature (582)..(582): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagcctgacacagccacccgtcggtgtcagtcgtccccaggacagacggccaggatccacctgctcgtggacattgctattcgaccaaagacctaaatatcgtactttaagttacggtaaccagtacgaagaacgccgacggcccgaaccggccccctggtcgaccgttgggtagaacttaagtaagtaaacgaaccgtaggtaggaacggaccgggtacccttacgggaacggtacccttcccgtaggacgtaccgttaactttccgtacgtccggtctccgacgtctacgacggtacaacgtgtaccgtacgtacaccgtatacgtacggtacggtacgacgtaggacaacggtaagacgtacggacggtactacggtaactttagtaaccgtacgtaacaacgttacgaacgacacggtaaccncggtaacggtttacgtttacgggttttacgggttttgggtacgggttaccggtcggggaaccggtacgtaacggttcgttacgtacccggttaccgtagggtcccggaaccgtaccggtaccggtcccccgg

SEQ ID NO: 120775 - DNA, 690 bp, Homo sapiens
  misc_feature: GYAE6OF02GD539.2.38.D05.1.454.CMB.1.raw
  modified_base (573)..(573): a, c, t, g, unknown or other
  misc_feature (573)..(573): n is a, c, g, or t
  modified_base (579)..(579): a, c, t, g, unknown or other
  misc_feature (579)..(579): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggagtcttagttcaggccgtcggggggtccctgagacctctcctgtgacacgccttcgtaggtacttcctaccttcaggtacgtacctacgtggactcgaccgtacggtcgggtcccaccgtaacgccgtaccggaagggggacggtcgttggtggtcggtctacgtacgttaataagtggtagaggtagggtagagtaccaacgacgcgtaccggacggtaccgtacggaggtaccggacctactaccactactaccacgaagtacgaaccgaacgtaaccaaacgtaccgtacgtcttataccgtacacggtaaatacgtaacgatgtacgaggaccgacggacgaacgtacgacggtcttggttacttactcggttagaacaggtaacgagtaacgngaacgngtaaccgcggtacggtaccggaccgaaccggttacgaccgggggttccgaaccggttaccgggaaccggttcgaccccttacggccctaacggtccaaccccggtaccccg

SEQ ID NO: 120776 - DNA, 896 bp, Homo sapiens
  misc_feature: GYAE6OF02FZHR3.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggaggtccgggggaggcttagttcagccgtggggggtccctgagactctcctgtgcagcctcgtggacttccaccttcagtagacttacgtggatcgactacgttcggggtccccgaccgaacgtccttacccggaagggggtaacgggggtccgttggggttcgggttcggggttaccttaccgtaaccgtttaagtttaaagtacggttaggtaaggttggggtaagtacgaccgaaacgaacggtccgttaaccgggtaccgggtacctttaccgggtaggtaaaccggggtcccgttaaacttacccgaacccgtacttacccgtaacccgaaaggtaaccgaacccgaaaaccggacccgtaaaacggaaaccctacccggtacgtttacggttaacttaccgtacggaaaccttaaaaggtaccggaaaaccgttacggttacggttaaggacgggtaaccggacccggtaacgggaaccgtccggggtacttagggtttacgtttaaacgtttaccgttggtaacggtacctaaagggtacgtaacgtacggtaccaagggtccgtaacggtacccggttaccggggttacccggaacccggtttaaccgggttaacccggggtaccgggggtaaccccggttaacccgggggtaaccccttccggggttaaccccgtacccccggtttacccgttaccccgtacccggtacccggtaacccccccgg

SEQ ID NO: 120777 - DNA, 706 bp, Homo sapiens
  misc_feature: GYAE6OF02H90CQ.2.38.D05.1.454.CMB.1.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (694)..(694): a, c, t, g, unknown or other
  misc_feature (694)..(694): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagtctggtggaggtcccggggggagcttagtcagccgtgggggtccctgagctctcctgtgcagcctntaggattcacctttnagtagctacgtgatcgctaacgtcggggtacccgcaaacgtccgtaccgaaggggaacggggcgttgggttacggtgggtctacgaacgttaattaagtacgtggagtagggatacgactaacgaagctaccgggacgtaccgtccggtaaggaacgggtacctaacttacgaacctacttcccgactaaaggaacgaacaaaaccgtacccgaaaagaacctaccgacgttagtactacgtacgaaacgaaaacgtagaaaacgtcgtacgtacggtaagaggaaccggaaaggtacgacggtcttaggtacttaagtttaccgtagtacgtacaaaggagacttaagaacaggtacctaacggtcgtacggtaaccgaccggtaaacgtaccggtaccggggaacccgaacgggtaacccgtacggtaacccgacccgttaccgtaccgtaccnccgtaaccccgg

SEQ ID NO: 120778 - DNA, 562 bp, Homo sapiens
  misc_feature: GYAE6OF02HQBLM.2.38.D05.1.454.CMB.1.raw
  modified_base (387)..(387): a, c, t, g, unknown or other
  misc_feature (387)..(387): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccggggaggcttagttcagcctggggggtccctgagactctcctgtgcagcctctggattcacctttcagtagctactggatgcactgggtccgccaaagctccagggaaggggctggtgtgggtctcacgtattaatagtgatgggagtagcacagctacgcggactcgtgaggccgattcacatctcagagacaacgccaaagacacgctagtatcgtnaccaaatggaaacagtctagagagaccgaaggaccacgggtcctggttagtaatttacgtggtcgacaaaggagaagtaacgcgagacaaggccttaggtaccacccgaacgtacgtcggggaccgtaacgggacccgttgggtaccaccggttcctccgtaccgagtacccccg

SEQ ID NO: 120779 - DNA, 733 bp, Homo sapiens
  misc_feature: GYAE6OF02HME4M.2.38.D05.1.454.CMB.1.raw
  modified_base (614)..(614): a, c, t, g, unknown or other
  misc_feature (614)..(614): n is a, c, g, or t
  modified_base (648)..(648): a, c, t, g, unknown or other
  misc_feature (648)..(648): n is a, c, g, or t
tcagacgctcgacacacgaccggtgctcgatttagtatctgatagttgggtttggggagccccagccctgggattccccagctgtttctgcttgctgatcaggactgcacacagagaactcaccatggagtttgggctgagcgttggttttccgttgttgcttagttttaaaaggtcgtccagtgtgaggtgcagcgtggtggtacggtccgggggagtacgttagttccgaggtcccggttcgggggtccctggacgtaccttcctccgtagtcgacacgtccttcgtaggtacttaccgtacccttacgaaggtacgtccgttacgtaggtaacgtcgacctacggtcgggtcccgaccgaacgtcccgtaccggaaggggacgggtcggttgggtacgttacgggtaccgttaccgtaacgttaagtttaagtacggttaggaacgttaggggtaacgttacgacgtaacgtaacggtaccgtacggtaccggtaccgtaccggtaacggaaccgggtccgtactaccgaacctactaccgtacgaagtaccgaaacgaacccgtacgaaaactaccgacgttactgttaacttcgacgaaactaacgtanaaccggtatcgaaggacgcgacgaacgcgtccgngttagtacgttcgtacgtgaacgaacgtaagtacgaacttacgacgaacgcgtaacggccgttacggaccgcccgaagtcccggg

SEQ ID NO: 120780 - DNA, 710 bp, Homo sapiens
  misc_feature: GYAE6OF02G363B.2.38.D05.1.454.CMB.1.raw
  modified_base (250)..(250): a, c, t, g, unknown or other
  misc_feature (250)..(250): n is a, c, g, or t
  modified_base (470)..(470): a, c, t, g, unknown or other
  misc_feature (470)..(470): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgacgcctcctatgagctgacacgacgcccacccgtcggtgtctaggtccgtaccccgaggaccacggaaccggcccgaaggtactccaccgttgcctcggtggaagntcgactagtcgaccaaagtctaatagtcgtacttagttacggtaccagacgaagaacgccgaggacctaccggtcccctaggcgtcgtacggtagaacttataagtaaacgacgtagtaggaacgtaccggaccctaggacggtactccgtagacgtcgtacttcgtcgtacggcctcgacgtcgacgaggaaccacgtcgtacgtacgtccgaactcgngtaggtcggacgtacgacgtacgaagtaacgagtacggacgtacgttagtaaccttaacgttacgttacgtaactaacgttcccgaagtaacgaacggtaaccgtagtacggttaacggttaccgggttttaacggttttcggggtacggtacgggtaaccgggtaaccggtaccgtagtaccggtccgttaacccggtccgggtaaccgtacggacccgttaccggtaacgtaccccgg

SEQ ID NO: 120781 - DNA, 900 bp, Homo sapiens
  misc_feature: GYAE6OF02IWH9P.2.38.D05.1.454.CMB.1.raw
tcagacgctcgacacacgaccggtgctcgatttagtatctgatagctgggttttccttgttgctattttaaaaggtgtccagtgtgaggtgcagctggtggaggtccgggggaggcttagttcagccgtggggggtccctgagactcctcctgtgcagcctcgtggattccaccttcagtagctactggatgcacgttcgggtccgaccaagcctccgaaggggaaggggctggtgtgggtctacacgttattaatagtgagtaggggatagaccaacgaagcctaaccggccggtaccgtccggtagggaaaccggggccctaacgttacccaaccgtaattcccgtacccgaaggtaaccggaacccgaaaaccgaacccgaaaacggaaacccgaccgtacgttaggttaaacttccgtaaggaacctaaaaagtcggaaaacctggttacgtaaggaacggaaccgggcccgggtaaaggacccgtacgggttacgtttggtttaacggtttaacctttaacggtaggtaccggaacgtaaaagggtaggtaacgtaacggacaaccggtacgtacggtaccggttacgggtaaccccgaacccggtaaccgttacccgggacgggggaaccccgtaaacccggggtaccccgttcgggtaccccgttacccggttccctacccgtcccggtaactacccccgttacccgaaacccgggtaacccggtaccccgttaaccgtttcccccggttaccccttaccccccggttccgggtacccccgtccccgttccgggtaacccttacccgggaacgggccccgttaaccccgacccggttaccggaccggtaacccggtaccgaacccgggtacccggccccgggttacccccggg

SEQ ID NO: 120782 - DNA, 738 bp, Homo sapiens
  misc_feature: GYAE6OF02I6KIP.2.38.D05.1.454.CMB.1.raw
  modified_base (436)..(436): a, c, t, g, unknown or other
  misc_feature (436)..(436): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
  modified_base (592)..(592): a, c, t, g, unknown or other
  misc_feature (592)..(592): n is a, c, g, or t
tcagacgctcgacacacgaccggtgctcgatttagtatctgatagcgtgggttttccttgttgcttattttaaaaggtgtccagtgtgaggtgcagctggtggagtccggggaggcttagttcagcctggggggtccctgagactctcctgtgcagcctctggtattccacctttcagtagcttactggatgctacgtcgggtcccgaccaagccttaccgaaggggaacggggcgtgggttacggttcgggttactaccgtacggttaatttaagtaggtagtagtgggaagtagacaacgagtccgtaacggcggtaccgttcggtaggaacgggtccattacccgaactacgtccctccgaagtacgaaccaaacgacccgaaaacgaccgacgtcgttaacgtactcgtagaactaaagtcgaatagttcgngagaccgcgacgaccgagtntgttactnttacgtgacgaacgtaagacgaatcgagacgaccgaggtcgtacggtaccggcccgttacgacccgggtacggggaccggtaccgggtaacccgttacggttacccgtccgttacccgtccgtacccnccgtaccctacccggaaaccgtacccggtacctacccggtcccgtttaccccgtccctcccgggtcctcccgaccgtcccctacggtaccgcccgtcccgaaccggtccaacggccgaccgaccggacccggtccggtaccccggg

SEQ ID NO: 120783 - DNA, 820 bp, Homo sapiens
  misc_feature: GYAE6OF02GPEX6.2.38.D05.1.454.CMB.1.raw
  modified_base (176)..(176): a, c, t, g, unknown or other
  misc_feature (176)..(176): n is a, c, g, or t
  modified_base (695)..(695): a, c, t, g, unknown or other
  misc_feature (695)..(695): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggngcttagttcagtccgtggggtcctgacgactcctctgtgcacgcctcgtgtacttcctaccttgaacgtacgtctaacgtggacttcgaccgtacggtcgggtaccccaccgtaaagtcccgtaccggggaagggggtaacggggtcggtttaggggtagggtacgggtttaccttaaccgtaacggtttaaatttaacggttaagggtagtacgggtttacggggtacgtaacggacgtaaaccgacggtaaccggtaccggaccgggtccgttaacccgggtaacgggaacccgggtaccgtacttaacccgtaccgtacgttaccgtaacccgaaaggaaccgtaaacccgaaacccgaaccgaaaaccgaaccgtaccgtacgtttaacgtacttaccgtagtaaactaacggtagtaaacctagaccgtaacgggaacgaccggacggtaagtaaccgcggtttaacgtagttagttacggtacgttacgaaggtaacctagggaacttaacgngtaaccgagtacgttacgccgggtttacgacccgggtaccgtcggttaaccgggccgggtaacctacccggggtaacgttcccggtacctacccgttccacccggttacctaccgtaacccccgg

SEQ ID NO: 120784 - DNA, 742 bp, Homo sapiens
  misc_feature: GYAE6OF02G9FZR.2.38.D05.1.454.CMB.1.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (618)..(618): a, c, t, g, unknown or other
  misc_feature (618)..(618): n is a, c, g, or t
  modified_base (639)..(639): a, c, t, g, unknown or other
  misc_feature (639)..(639): n is a, c, g, or t
tcagacgctcgacacacgaccggtgctcgatttagtatctgatagttgggtttggggggaagaggaagactgacggtcctgccacaggtggtgcgtgggcacggtggccactcgacacaacatttgcgctcaactgtcttgtccagtgtgaggtgcagcgtggtggacggtccgggggaggtcttagttcacggtccggttcggggggtccctggacgacttctccgtgtcgcncgccttcgtggacttcctaccttnaacccgtagtctacgtggatgaccgacggtcgggtccgaccaacgtccgtaaccggaagggggtacggggtccgttgggtggttcggggttcctaaccggtaacgttaagtttaaacggttaggtcggtaaggtggggtagtaacgaacgaacgaaagtccgtaacggccggtaccggtaccggaggtaaccggccgttactaccgaacgtactaccgtacgaagaaccgaaccgaaacgacccaaagaccgacgtcgttacgtacttcgacgaaagtaacgtacgaaattcggttagacgggtaacgacggaccggaacgaccgtcggtccgttagtacgttacgttcgagtaccgaanaaggtaagaagtacgacgagngtaaccggtcggtacgaccggtaccgtaaccggtacgggtaccggacggtaacccggtcccgttacggtaccctccgttacgtacccgtcgtaccctaccccg

SEQ ID NO: 120785 - DNA, 695 bp, Homo sapiens
  misc_feature: GYAE6OF02JD5R3.2.38.D05.1.454.CMB.1.raw
  modified_base (385)..(385): a, c, t, g, unknown or other
  misc_feature (385)..(385): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctctgtgcagcctctggattcaccttcagtagctactggatcggcacgtgggtcccgccgaagcctccgaaggggacgggcttgggtggtgggtcctcacggttataagtagtgagtgggagtagcacagtcctacggcgactcccggtaggaacgggccattccacgtatccctccgaagagaacccgtaaccgaccaaaagaccgaccgtctaggtactctaggactaaagtcgaaacncgttcaggaacgccgtacggaggtacgacggtctgtagttaagtttactggcgacgtaaagtagaagttagacgaagcgagccgtaggtacccgacctacgtcgaccggggacgaacccgggtaccgttcggaccgtcccgtcctccctacgacccgcccgtacccgaaccggtaaccgggacccttacggtaccccggttccccgttacccccgtccggtcccgtcccgtcggaccctaccggacgtaacccgtaccgacccggttaccggacggcgaaccgaacccggtccgaacccgggttcccggg

SEQ ID NO: 120786 - DNA, 812 bp, Homo sapiens
  misc_feature: GYAE6OF02H6OHF.2.38.D05.1.454.CMB.1.raw
tcagacgctcgacacacgaccggtgctcgatttagtatctgatagttgggtttgggggaagaggaagactgacggtcctgccacaggtggtgctgggcacgggtgggcactcgacacaacatttgcgctcaactgtcttgtccagtgtgaggtgcagctggtggaggtccgggggaggtctttagttcaggcccggttcgggggggtcccctaggacgaccttccgttcccgtgtgccgacgtcctcgttaggtacttccaccctttacgaggttacgcttacgtggtatcgacgtaccgttcgggtaccccgacctaaggtcccgtaccggaaggggggaaacggggtcgttggggttggggttacgggttaccttacgtaacggttaactttaaggttagttaggtaaggtggggaaattacggactaacggaacgtcgtaaccggtcggaacccggttcggaagggacggggtacttacgtaccgaaaccgtcttaccgtaccgaaaggtaaccaacccggaaaacccgaccgtaaaaacggaccgtaaccggctttaacggtaactcgtacaaacgtaaagtaacgaaacgtagtacgtacggaggtaccgaaccgggtaacgaccgacggttcgttggttactacgttacgtcgaggtaacgaagtagtaagtagacgtacgagtacgacggttacggtaccccgacggttcccgtaacgggtccgggtaaaccgggtacccgggtaacccggttccggtaaccgtacccgtttacccgtacgttaccccggaccgttaccccccgg

SEQ ID NO: 120787 - DNA, 736 bp, Homo sapiens
  misc_feature: GYAE6OF02IALE2.2.38.D05.1.454.CMB.1.raw
  modified_base (190)..(190): a, c, t, g, unknown or other
  misc_feature (190)..(190): n is a, c, g, or t
  modified_base (394)..(395): a, c, t, g, unknown or other
  misc_feature (394)..(395): n is a, c, g, or t
  modified_base (428)..(428): a, c, t, g, unknown or other
  misc_feature (428)..(428): n is a, c, g, or t
  modified_base (551)..(551): a, c, t, g, unknown or other
  misc_feature (551)..(551): n is a, c, g, or t
  modified_base (566)..(566): a, c, t, g, unknown or other
  misc_feature (566)..(566): n is a, c, g, or t
  modified_base (627)..(627): a, c, t, g, unknown or other
  misc_feature (627)..(627): n is a, c, g, or t
tcagacgctcgacacacgaccggtgctcgatttagtatctgatagctgggttttccttgttgcttattttaaaggtgtcagtgtgaggtgcagcgtggtggaggtccgggggaggcttagttcagccgtggggggtccctgagactctccgtgtgcacgcctcgtggtattccaccttcagtgcttacgnggatcgccacgtcgggtccgaccaagtcgtccggaaggggaaggggtctgggtggtcgggtctacgtaacggttattaaagagtggagttgggagtagacaagtacgaccgtacggcggactaccggaggaacggctacgtacacctactcacgaagacgaccgtaacgacaaaagtacacgtcgtattacgctagaactaaannaaacgtgtcgtaagcggacgagacgtcgaccgngtacggttattattacgtggtacaacggaagaggaatacgacgtaggactacggtcggtaccggtaccgaccggaacgttaccggaccgggttaacgggaacccgggtcctaacgggtacccnccgtcccgttaaccnccgaacgttcccgacccgttaaccggacccgtacccgttaccgttacccgggtttaccccncccgggtcccgtacccgtccgtccggtaacccggtaaccgggaccgtacccgtaacccgtacccgggtaacgtacgacccggaacgaccggtcccggtacccggtcggg

SEQ ID NO: 120788 - DNA, 780 bp, Homo sapiens
  misc_feature: GYAE6OF02F7OJG.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagtaactcaccatggtagtttggctgagtcttggtttccttgttgtcttaagtttaaaggtctctagtgtgaggtgcagtcgtggtaggtacgggtccggggtagtcttagtcacggtccggttcgggggtccctggacgtaccttccgtaccgtgtcgacgtacgtcccgttacgttaggtacttcctaccgttacgtagtacgtaccgtacgtaggtacttcggtaccgtaccggtcgggttaccccgaccgaacggtccgttaacggaggggtaacgggtcgttacgggtcggtcggtacctacggtaaacttaagttaagtaggtaggtaaggtcggaagtacgtactaacgacgtacgtaccggacgtaccgtacggtaggaccggtcctataccgactgtaccgtacgagtaacctacgaaccgtacaaacgtaccagttacccagttacgtcgaaacgtaactaacgtagtaacctgggtactaagggaccgtacgggacccgaaggtacccgttacgggttacttaacggttacgtttaacgttaccggttagaccgggttaaacgtaacgggttacgacgttaacccgggacttacgggacctttacggtcccgggttaaaaccgggttcccgttaaccggacccggtttaccgggg

SEQ ID NO: 120789 - DNA, 689 bp, Homo sapiens
  misc_feature: GYAE6OF02IVBEK.2.38.D05.1.454.CMB.1.raw
  modified_base (122)..(122): a, c, t, g, unknown or other
  misc_feature (122)..(122): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
tcagacgctcgacacacgaccggtgctcgatttagtatctgatagttgggtttgggggtgggtccaggaggcagaactctgggtgtctcaccatggcctggactccctctacttctcccctnttcactctctgcacaggctctgacgcctcctatggacgctagacacgtacgcccacccgttggtatcacgtccgtcccgaggaccaacggccggccgaaggtctccacgcgtcttcgngggaatntcgcattcgaccaaagtcaatgacgtcttagttcgaccganacgagaacgcccgtaggaccncggtcccttggtctcgtggtacgtaatagtaaacttaacgaancggttgaagtccggccctaggacggtactccgtaggactcgttacttcgtcgcgtaacctcgaggtctaacggaggtacctacgggactttaccgaacgttcgaccagtacccgaggttacggacgtacgacgaccgtaaggacgttagccgtaaggtcgttaacgacgttaacgttcgaacgttacggaacttcgaacgaccgagtaccgaaggtcgttccggtttaagggtttccctttagggggtaccttccgggggtaaacggccggttaacgtaacggttcgtaaccggttccggacgtttaccggacgtaccggtacccagggttccccgg

SEQ ID NO: 120790 - DNA, 685 bp, Homo sapiens
  misc_feature: GYAE6OF02GT1PW.2.38.D05.1.454.CMB.1.raw
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctcgtggattccaccttcgagtagctacgtggatgcacgtcggtccgaccgaagctaccgagggaagggctggtggtgggtctcgacgtattaagtagtgagtggatcgacagagcgtacgacggtactcgtaggaacggccgtacttccgaactacgtcgtacccaggaacgaccgaaccgaccgaaacgtaaccgacggacttagtaacgttctacgaacctaaatcgaattcgttcgacggagaccgacggacggaacgacggtcgtgtatttaagttctacggtagtacgaaggtacgaacgtacgacgtacgacgtacgtacgtaccgggtaccgacgtaccgaggtccggacggtacgggaccgtacgtccgtacgtaccgtccacgacccgtaccgacccgtaccgaccggtacccgttacggttccctacccgttccccgagcccgtccggtaccgtccgtaccggacggtaccgccctaaccggaccgtacgaccgtaccgacggccggaccggtccgg

SEQ ID NO: 120791 - DNA, 745 bp, Homo sapiens
  misc_feature: GYAE6OF02G7RUY.2.38.D05.1.454.CMB.1.raw
  modified_base (592)..(592): a, c, t, g, unknown or other
  misc_feature (592)..(592): n is a, c, g, or t
  modified_base (642)..(642): a, c, t, g, unknown or other
  misc_feature (642)..(642): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggacggtccgggggaggtcttagttcagccgtcggggggtccctgagactctctgtgcacgcctcgtggtacttccgtaccttcgagtacgcttaccgtggactcgctacggtcgggtcctaccgaacgtccgtaccggaaggggtaacggggtccgtgggttcgggtacgggtccgtacgtaaccggtttaaagtttaacggtaaggtggtaacggttacgggggtaagttaaccggaccgtaaccgaaaacgggtccgaaccggtaccggtaccgttaccgggtacgaaacggggtacctacgttacgaacctactcgtaccgagaacgtacgaaaccgaccaaacggaacctacgtacgtagtactacgacgtaacctaaagtacgaacgtagtcgtaacggacgaccgacgtaacgggactaccgngttacgttacgtattaacggtgtagacgtagaacgtagtaccgacgtacncggacgttccgacggtaccgaccgtaacggtcggtaacgggaccgtaccgggttaacccgtcggttaaccgtaccgttacccgacgttcccgtacgtaccccg

SEQ ID NO: 120792 - DNA, 702 bp, Homo sapiens
  misc_feature: GYAE6OF02IO38L.2.38.D05.1.454.CMB.1.raw
  modified_base (85)..(85): a, c, t, g, unknown or other
  misc_feature (85)..(85): n is a, c, g, or t
  modified_base (452)..(452): a, c, t, g, unknown or other
  misc_feature (452)..(452): n is a, c, g, or t
  modified_base (511)..(511): a, c, t, g, unknown or other
  misc_feature (511)..(511): n is a, c, g, or t
tcagacgctcgacacacgaccggtgctcgatttagtatctgatagttgggtttgggggaagaggaagactgacggtcctgccacnggtggtgctgggcacggtgggcactcgacacaacatttgcgctcaactgtcttgtccagtgtgaggtgcagctgggtggagtccgggggaggcttagttcagtccgttgggggtccctgagactctcctgtgcagcctgtggattcaccttcagtacgtctacgtggatgctacgtgggtccacgaagccgtaccgaaggggagggtcgtggtggttacgggtcctacgacgttaattaagtagtaggagtgggatagacaacgagcgtacgcgtacgtccggtaggaacggtcctagttaccactactccacgtaaggaacgacgtaaaccgacaaacgaaccgacgtactaggtaactcgtaaanacctaaaagtcgaaactggtactaggaacgacggtaaccggaggtaaacccacgggttntaggtttaacgtaattttaccgggagttaagaaccgaaaagttacggtacaacgcgtaacaacggtacgtacgtacccggggaacgtacccaaagggtttacccgggacgggggaaccccgttaacgggtaacccgttcggtaaccccctaccggttaccccgttaccgtaaccgaacccgttaacccccg

SEQ ID NO: 120793 - DNA, 799 bp, Homo sapiens
  misc_feature: GYAE6OF02G70TR.2.38.D05.1.454.CMB.1.raw
  modified_base (275)..(275): a, c, t, g, unknown or other
  misc_feature (275)..(275): n is a, c, g, or t
tcagacgctcgacacacgaccggtgctcgatttagtatctgatagttgggtttgggggtgggtccaggaggcagaactctgggtgtctcaccatggcctggatccctctacttctcccctcttcactctctgcacaggctctgaggcctcctatgagctgacacagccacccttcggtgtcagtcgtcccaggacagacggccaggatcacctgctcgtggacgatgctagttcgaccaaagcaatatcgctttattcgtacctagctaagaacnccggtaggcccgacggccccctggtgcgtgggtcgaattaactaagttaaaaggaccgtaaggtacgtaacggaacggtcccctacggtacggggtacctcccgtggtaacgtcggtaatttccgtacgtgggtccttaccacggtccgttaggaaaccgggaacctaaacgtacgtttaccgtaaccggtttacgaaccgtaacgttcggtacgggttaacgggaccgttaccgggtaacggggaaccctaaaggggaaacttacgggttaacgggtaacgggtacctaacggttaacctttaacgtttaacggttacgttaacgaaacgttacgtaacggacgttaaagaacccgtaacgggtacttaacgggggttttcgttttaaacgggtttttttcgggggttacgggttacccggggaaacgggggttaaccggaacgggttaaccgttccggttaccgggttaacccgttacggttaccgggtaccgttacccggaaccggtaacgttccccgggg

SEQ ID NO: 120794 - DNA, 859 bp, Homo sapiens
  misc_feature: GYAE6OF02J1IEI.2.38.D05.1.454.CMB.1.raw
  modified_base (141)..(141): a, c, t, g, unknown or other
  misc_feature (141)..(141): n is a, c, g, or t
  modified_base (806)..(806): a, c, t, g, unknown or other
  misc_feature (806)..(806): n is a, c, g, or t
tcagacgctcgacacacgaccggtgctcgatttagtatctgatagttgggtttggggggagccccagccctgggattcccagctgtttctgcttgctgatcaggactgcacacagaagaactcacatggagtttgggctgngcttgggttttccttgttgcttaattttaaaaggtgtccgagtgtgaggtgcgagtcgtgggtgggtacggtccgggggtaggtccgttagttcgacggtccgggtcgggggtccctaggcgtactctccgtgtcggcacgtcctcgtcggtactttccaccttacgacgtacgcttacgtacggtagtcggcctaccgggttccgggtccccgaccgtaacggccgtaaccgggaagggggtaacggggtcggttccggggttgggttcgggttacctacggttaaaccgttaaggtttaacggtaggtaccggtaggtaacggggacgttaaccgtaccgtaaacgtacgtacccgggtaaccggtaccgggtaaccgtacccgggttaacgggtaaccgggggttaccccttaacgggtttaaccctaacccgttaacgtacccgtaacccggtaacggtaaaccggtaaaaccgtaacccggaaacccgtaaacggtaaaccgtaccgtacgttaacggtaccttaacggtaaccgtaacgtaaactaaccggtaaacgttccggtaaccggttaaggaaccgggttaaccgggaccgggtaaccgggaccgtaacgtcgttaggttaacgttacgtacgtcgtacgaacgtaggtaacgngtaactaggaacgtcgaccgtacggtaacgtacggtacccgtacgtaccgggg

SEQ ID NO: 120795 - DNA, 742 bp, Homo sapiens
  misc_feature: GYAE6OF02HFC5Q.2.38.D05.1.454.CMB.1.raw
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
tcagacgctcgacacacgaccggtgctcgatttagtatctgatagttgggtttgggggagccccagccctgggattcccagctgtttctgcttgctgatcaggactgcacacagagaactcaccatgggagtttgggctgagcgtggttttcctgttgctaagtttaaagtgtcagtgtgaggtgcagctggtggaggtccggggagcttagttcngccgtgggggtccctggagtactcctcctgtgccncggtcctcgtggtctcctaaccttcagttcgctactggatgcctacgtcgggtcccgaccacgtcgaccggagggaggggctagggtggtcggttctacgtaacttaagttaacgtaggttgtaggtagggtagtacgtaccaaagtacggtacccgtacggacggttaaccgtacgggttacgggaaacggggtccctaacggttccaaccgttacctccgtaccgaacgaaccgaaaccgaaaccggaaccaaaaccgtaaccgaaccggtaccgttaggttaacccccctgtaccgtaacgtaaacgtaacgtaaaccggtaggtacgtaacggaaggaccggaccgaacgggaaccgtaaccggtcggttaggtttcgtaacgtttaggtacgtagtaaccggtaaaggtaagtaacggtacggtaacgtacggaccgtacggtaaccggttacccggggaaccgtacccggtaccggtaaccgggg

SEQ ID NO: 120796 - DNA, 833 bp, Homo sapiens
  misc_feature: GYAE6OF02GUXPW.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagtcttagttcagtccgtgggggtccctggagacctctcctgtcgcacgcctcgtaggtactttccaccttcgaagtacgaccttactggaacttcgctacggtcgggtccgaccaagcctaccggacggggaacgggtcgtggtaggtcgggtcctacgtaacgttacgttaagtggtacgtacggtggggaacgttacgccgaacgaagtccgtacggaccggtacgttcccggtaaggaacgggtaccgtagttaccgtacctacttccgtaccgaggaacgaaccgtaaccgaccaaacggaaccgtaccgtacgttactaacgttaccgacgaaaccgtaaagttcgaaaacgttacgtaccggtaacggaccggaaccggccccgggtaaacggaaccgttacccgggtatttacggtttaacggttaactttaacggttcgggacgttaacggtaagaacgggtttaacgacccgttaacgacggtaccgtacgggttaccggttaacggggttccccaacccgggggttacccggttaaccggggttaccggggggaaccccgtaaacccggggttaaccccgttggggttaacccccttacccgggttcccttaaaccccggttaccccacccggggttttaacccccccg

SEQ ID NO: 120797 - DNA, 765 bp, Homo sapiens
  misc_feature: GYAE6OF02IL320.2.38.D05.1.454.CMB.1.raw
  modified_base (137)..(137): a, c, t, g, unknown or other
  misc_feature (137)..(137): n is a, c, g, or t
  modified_base (244)..(244): a, c, t, g, unknown or other
  misc_feature (244)..(244): n is a, c, g, or t
  modified_base (434)..(434): a, c, t, g, unknown or other
  misc_feature (434)..(434): n is a, c, g, or t
  modified_base (464)..(464): a, c, t, g, unknown or other
  misc_feature (464)..(464): n is a, c, g, or t
  modified_base (504)..(504): a, c, t, g, unknown or other
  misc_feature (504)..(504): n is a, c, g, or t
  modified_base (584)..(584): a, c, t, g, unknown or other
  misc_feature (584)..(584): n is a, c, g, or t
  modified_base (599)..(599): a, c, t, g, unknown or other
  misc_feature (599)..(599): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacnggctctgaggcctcatgagctgacacacgcccacccgtcggtgttcgacgtcgtaccccgaggacgacggaccggccaaggactccaaccgtgctacgtgggaagtntgactagttacgaacccaaaagcaaaagtactcgtactttaacggttcggtaaccctaaggacgaaggtaacgacccgaacgggccccaaccgggtcccccgttggttccgcggttagggtagtaacttaagaaattaaaacgagtacggttaggacggacggtccctacggaggggtacctccgtaggngtacgtacgtttctacgttcggactaccgngtaccgtacggaacgggaactacgtacggtcgtacgttanaccgtaatcgaggttacggacgtacgacggataacggtagacgttacggaagtcgttaacgttaacgtacttaccggttntaaaccaggtaaccngtaacggaactaacgacggttacgtaaggtttaccggttttacggttttggggtccggtttacgggggaacggtaccgggtaaaccgtaccgttaggttaacccgggtacccgttaaccgggttaacccggtacgaacccgggttacccgtaacgggttccccggg

SEQ ID NO: 120798 - DNA, 795 bp, Homo sapiens
  misc_feature: GYAE6OF02HH61H.2.38.D05.1.454.CMB.1.raw
  modified_base (124)..(124): a, c, t, g, unknown or other
  misc_feature (124)..(124): n is a, c, g, or t
  modified_base (142)..(142): a, c, t, g, unknown or other
  misc_feature (142)..(142): n is a, c, g, or t
  modified_base (166)..(166): a, c, t, g, unknown or other
  misc_feature (166)..(166): n is a, c, g, or t
  modified_base (197)..(197): a, c, t, g, unknown or other
  misc_feature (197)..(197): n is a, c, g, or t
  modified_base (587)..(587): a, c, t, g, unknown or other
  misc_feature (587)..(587): n is a, c, g, or t
tcagacgctcgacacacgaccggtgctcgatttagtatctgatagttgggtttgggggtgggtccaggaggcagaactctgggtgtctcaccatggcctggactccctctacttcctccccctnttcactctctcgacacgnggtctctaggacggccttacgtanggacgctgaacaacgcgccctaccgtgggtntacacggttccgacccgaaggacgacggtaaccgggcgaagtactacccaccgtgtccttacggtaggagtactggaccttagtaccgaaaccgaaataccgtaagtacgttacttacgtttaacggtttccggaacacggaacgtaaggaaacccgccggtacgggacccccgtacgggtcccccgttagggttgtccgggtttagggaactaattaaacgtaaaagtaacggaacggtaacggacggtaacggaccccggtacgtacgggacggtacttccgcggatacgtcctcggtagtaccggtcacgtccgttacgacgggtaacactacgtcgtccgtaacggtaccaactagtcgggacgtacgtacgacggagacgaaagngtaacggtaggcgaagttcgttaacttcgttagtaccaagtaccgacgacgacgtaacgaaccggtgtaacggtttacgggttttggggttttaaggtcggggttaccggggtacgggggtaacgtaaccggttaccggaccgttcgggtacccgtttacgggtacccggtaaggtccccggaaaccggtacccggtccgttacccgg

SEQ ID NO: 120799 - DNA, 833 bp, Homo sapiens
  misc_feature: GYAE6OF02FGJLV.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagtcgttcggggtttttccttggttcgtactttaagttttaaaaaggtcgtccgtagtggtggtaagggtgccgaggtcgtgggtacgggccggtaccgggggtgtactttagtcgaccggtccggtccggggggtccctaggacgttacctccgtcctggtcgacgtacgtcccgtcgtaggtacttaccgaccttacgacgtcgtcctaacgttcggatcggactaccggttccggggtaccaccgtaacggtccgtaaccggaagggggtacggcgttagggtcggttcgggttacctacgttaacgttaattaacggtaggtacgacgggtaggtacgtacgccaagaccgtcgacggtccggtacgtcggaggaccggtcctactaccgcccgtattacccgacgacggtaccgaaacccggtaacccgaaaccggtaaaccggaacccttaacccggtgtaacgggtttaccaacgttaccgaaacgttaaccgtaacgtaacccgtcgttagtaaccgggaacggtaacccgggacccggtaaggtaacccgttaggggacttttacgggaacttttacgtacggtttcggaacgtaacggtaacggtactaacgggtcacccggtaggtaccggtacgggtccccgtaacggggtttaccccgccggttaaacccggtacccgggg

SEQ ID NO: 120800 - DNA, 958 bp, Homo sapiens
  misc_feature: GYAE6OF02GZN7Q.2.38.D05.1.454.CMB.1.raw
  modified_base (235)..(235): a, c, t, g, unknown or other
  misc_feature (235)..(235): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttttcgctcaactgtcttgtccagtgtgaggtgcagctggtggagtccgggggagcttagttcagccgtgggggtccctgagactctcctgtgcagcctctggattcaccttnagtacgctactggatcgctacgtcgggtcccgaccaaggcctaccgaaggggaacggggtcttagggtggttcgggtcctacgaacgttaatttaacgtaggttagtacggtttagggaaggttaacgtaccgaaacgtaacggtaccgttaacccgggtaccgggtaaccgttacccggggtaaggtaaaccgggggtccccgtaacgttttcccgaaacccgtaccgtttcccgtaaccgaacggtaaacggaaacccgtaaaaccccggaccgtaaaaacggtaaaccgtaacccggttaccgttaaggtttaaccgtccttaacgggaaacccttaaaaagttaccggtaaaaccgtacggtttaacccgtaagggtaaacccggaaccggggttaccccggaaaaggggtaacccgtaaccccgggggtttatttacgggtttaacgggtttaaacctttttaaccgggaggttacccgggaaaacttaaaggggaaacgtaacgttaacgaccgggttaaaccgtacgggtaacggtccggttttacggggaaaccccggttacccggtaaaccgttttcccgggggaaccggggggttaacccccggtaaacggggttttaacccccccgtagggggtttaaccccccttaccgggtttaacccccggttccccggtaacccggttaacccggtaccccctttaaaacccccgggg

SEQ ID NO: 120801 - DNA, 686 bp, Homo sapiens
  misc_feature: GYAE6OF02GKYIE.2.38.D05.1.454.CMB.1.raw
  modified_base (490)..(490): a, c, t, g, unknown or other
  misc_feature (490)..(490): n is a, c, g, or t
  modified_base (528)..(528): a, c, t, g, unknown or other
  misc_feature (528)..(528): n is a, c, g, or t
  modified_base (564)..(564): a, c, t, g, unknown or other
  misc_feature (564)..(564): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagctgggttttccttgttgcttaattttaaaaggtgtccagtgtgaggtgcagctgggtggaggtccgggggaggtcttagttcagccgtgggggtccctgagactctcctgtgcacgcctcgtggtacttcctaccttcagtagctactggatcgcacgtcgggtcccgaccaagccgtccggaaggggacgggcgtggtggtcgggtctacacgttaattaagtagtagagtagggagtacgacaacgaagccgtacgcggaccgttacgggtaggtaacgggccgtaacttaccgaaccgtaccttcctaaccgacgaaacgaaccaaaccggacccaaaagaacccncgtcttagtactccgtagaacaaagtacaaactaggtntacggaaggacccgaaccgggacggacgacccggtnttaggttaacgttaattaccgtaggtaccgaacgtaaggtaaagtactacggaacccgtaaggacccgtaagggtccggtttaaccgggaccgggttaccccggtaacgttaacccgggggg

SEQ ID NO: 120802 - DNA, 853 bp, Homo sapiens
  misc_feature: GYAE6OF02FNXKZ.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgaggcctcctatgagctgacacagccaccctcggtgtcagtcgtccccgaggacagacggccaggatcacctgctcgtaggagagtgacattcgaccaaagcaatagtgtcttagttcggtaccagacgaagtaacgaccgacggaccgtaccggcccccgtggtggccgtcgggtagtaataagttaaagtaaaacggaacgtaacgggttagaacgggtaaccggtaccccgttacgaacgggggtaccttaccccgtaggacggtccggttaatttcccgttccggtacggtacccgttacccgacgtaccgtacggtaacggggaaacctaaacggtacggttaccggtaacggtttacccgtaacctacgtaaccggtaacgggttacggtaaccggtaccggtaacgggtaacaaacggggaaaggttacggttacgggtaaacggggttcttaaccgggtaaccttttaacgttaacccggttagttaaacccgtaagtacccgtaacggtaacggttaacgaaacgtaccgggtaagttaacgggttttacgggttttttacggggtttttcgggttacggggtttacccgggggaacgggggttaaaccggggtaacccgtaacggttaccgggtaccggttacccggtttaccgggttaaccgggtaccggaacccggtaccgggttagggtccccccgg

SEQ ID NO: 120803 - DNA, 801 bp, Homo sapiens
  misc_feature: GYAE6OF02HSBC5.2.38.D05.1.454.CMB.1.raw
  modified_base (219)..(219): a, c, t, g, unknown or other
  misc_feature (219)..(219): n is a, c, g, or t
  modified_base (644)..(644): a, c, t, g, unknown or other
  misc_feature (644)..(644): n is a, c, g, or t
tcagacgctcgacacacgaccggtgctcgatttagtatctgatagttgggtttgggggaagaggaagactgacggtcctgccacaggtggtgctggcacggtgggcactcgacacaacatttgcgctcaactgtcttgtccagtgtgacggtgcagctggtgagtccgggggagcttagttcaggcctggggggtccctggagacgtctcctgtgaccngtcctcgtggtacttctaccttcacgttacgtcctacttggattcgcgtacctgggtcccgccgaacgctccgagggggaagggtcgttaggtggttaggggttaccttacctacggtttaaactttaattaaggtcgtaaggttggggaatacggtaccaacgtaaaggtcccgttaacgggccggaaccgtttcccggaagggaaccggggtcccgtaaactttccgaccaactttcccgtacaacggaacgaaccgaaaccccgacgtaaacgaaccctacgaccgttacgtacgttcctacgtaaccgtaaacgtaggaaaccaggtacccgtagtacgggaacgggtaacccggaaggtaacccgaccgggttaccgttggtacgtttaacttacgtaggtttacggacgtaaggaagtnttaaaccggcggtacgaccgtaacggggtcttaccggggtaccgtacccgggtaacgtaccggggttacccggggaaccgttaaaccggggttacccgtaccggtacccggttaaccccgttccctacccccggttttaccgacccgttacccccgg

SEQ ID NO: 120804 - DNA, 685 bp, Homo sapiens
  misc_feature: GYAE6OF02I9U6V.2.38.D05.1.454.CMB.1.raw
  modified_base (208)..(208): a, c, t, g, unknown or other
  misc_feature (208)..(208): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctctgacggcctcctatgagctgacacagccacctcggtgtcagtcgtccccaggacagacggccaggntcacctgctctggacatcgctagttcgaccaaaggcaatatgtactttagtacggtaccagcgaaggaacgcccagggccctaacggccccttagtcgcgtgggtgattataagtaaacggactaggtgaacgtcggacccttcggaagggtacctaccgtagacgtaccgtactttccgcgtacggtacctccgaaggccttacgggaaacgggtaccaaaccgtacgggtacctacgggttacaacccgtaatcgtaagggtcggtacgttaccgagggactaaagggaacgtaggtacggacggttagtacgtacttaacgttaccgtagttaacgattacggacgccgaaggtacccaggtaccttaagggttagtttccggtttttaggggaccggttaccgggacgggtaacggaaccgtggtaccgtcggtaccgttcgttaacgggaccacggtacccggagttcccgg

SEQ ID NO: 120805 - DNA, 725 bp, Homo sapiens
  misc_feature: GYAE6OF02HEPR7.2.38.D05.1.454.CMB.1.raw
  modified_base (142)..(142): a, c, t, g, unknown or other
  misc_feature (142)..(142): n is a, c, g, or t
  modified_base (180)..(180): a, c, t, g, unknown or other
  misc_feature (180)..(180): n is a, c, g, or t
  modified_base (240)..(240): a, c, t, g, unknown or other
  misc_feature (240)..(240): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgcacaggctntgaggccttctatgagctgaacacacgcctaccctggntcaggtcgtcccgagacacggaccggccgaggtactccaacccgtgcttcggtaggacgntagctaagttcgaccaaagtcaatgtcgtacttagttacggtaaccacgtacagtaacgccgacggaccgacggccccgtggtcgtcgtaggtacgtaatagtaaataaaggacgtacgtacggacgacggtaccgtcggaacgggtactcccgtagacgtcgtacttacgtcgtcggtacccgtccgacggtactacggtacgggtaaacccgtaacgtacgggtacgtaaccggtaacgtaccgtagtacccggtacggtacgggtaacggtaccgacggtaacgtaaggaaagtacggttacggacggttactacggttaacgttaacttaacgttacgtacgaacgtactacgacgaacgtacgacggtacgtaggtttagggtttacggtttgggttacgggtttacgggacgggtacggaacggtacgttccggtaccgtaccgttacggtcggttaccggacgtacccgaagtcccgg

SEQ ID NO: 120806 - DNA, 674 bp, Homo sapiens
  misc_feature: GYAE6OF02F9BB2.2.38.D05.1.454.CMB.1.raw
  modified_base (265)..(265): a, c, t, g, unknown or other
  misc_feature (265)..(265): n is a, c, g, or t
  modified_base (305)..(305): a, c, t, g, unknown or other
  misc_feature (305)..(305): n is a, c, g, or t
  modified_base (404)..(404): a, c, t, g, unknown or other
  misc_feature (404)..(404): n is a, c, g, or t
  modified_base (507)..(507): a, c, t, g, unknown or other
  misc_feature (507)..(507): n is a, c, g, or t
  modified_base (632)..(632): a, c, t, g, unknown or other
  misc_feature (632)..(632): n is a, c, g, or t
tcagacgctcgacacacgaccggtgctcgatttagtatctgatagctgggttttccttgttgctattttaaaaggtgtccagtgtgaggtgcaactggtggagtccgggggaggcttagttcagcctggggggtccctgagactctcctgtgcagcctctggattcaccttcagtagctactggatgcacgtgggtccgaccaagctccgaggggaagggctggtggtgggtctcacgtaattaatagtgagtgggagtagcaanaagctacgcgactccgtagaaggccatcacatctacaganacacgcaagacacgctagactctagacaaatcgaactagtctaggaacgtacggaccggaaggaccgaacggtctaggttagtaactttcgagttaganaaaggactagtacgacgtacgacaggtcgtaacgggtaccaccgtactaacgggtacgggacctaaaccggggtccctagggttcccaacccgtcttacccgnacccgtaccctaacccgaaccggtacggtaccctaccgttcccggttaccccttccccggaccggtacccgtacccgtcgtacccgtacccgggaacggccgaacccgttaccccgtaccggaanacccggtaccggaacccgtcggggacccgttcccggtacggg

SEQ ID NO: 120807 - DNA, 722 bp, Homo sapiens
  misc_feature: GYAE6OF02IU2AX.2.38.D05.1.454.CMB.1.raw
  modified_base (164)..(164): a, c, t, g, unknown or other
  misc_feature (164)..(164): n is a, c, g, or t
  modified_base (179)..(179): a, c, t, g, unknown or other
  misc_feature (179)..(179): n is a, c, g, or t
  modified_base (282)..(282): a, c, t, g, unknown or other
  misc_feature (282)..(282): n is a, c, g, or t
  modified_base (565)..(565): a, c, t, g, unknown or other
  misc_feature (565)..(565): n is a, c, g, or t
tcagacgctcgacacacgaccggtgctcgatttagtatctgatagttgggtttgggggtgggtccaggaggcagaactctgggtgtctcaccatggcctggatccctctactctcccctcttcactctctgcacgaggctctgacggcctctatgagctgacanacgccaccgtcggtntcagtcgtacccaggacaggacggccaggactccgacctgctcgtaggacatcgactagtcgtaccgaaagcctaagtactcggtacttaagttcggtaaccnggtacaacggtagacccgacgtaccggtaccggtcccctgggtacgtccgtaggtacgtaagttaactaacgtaaaaggcctaggcgtaaacggaccgtaccggtacggaacgggtacgttcccgtaggaccgtacgtaactttcgtaccggtcgttcgtacccggagtaccgtaaccggtacggaaccacgtacggttacgtaccgtagtacctacgtcgtaacgggtcacgtccgaagtacgaagtaacgtatacgtagtcgtaataccgtaatacggttnaaccgtatccgtacgagttacaacggtacgtacgtagtttacccggtttagggttagggtttcggtaaccggtcggggttaaacgcggttaaaccggtcggttacaacccggttaccggacggtaaccgggtcccgtaacccgggtagttccccggg

SEQ ID NO: 120808 - DNA, 934 bp, Homo sapiens
  misc_feature: GYAE6OF02H84C0.2.38.D05.1.454.CMB.1.raw
tcagacgctcgacacacgaccggtgctcgatttagtatctgatagtgggtttgggggtgggtccaggaggcagaactctgggtgtctcaccatggcctggactccctctacttcctcccctcttcactctctgcacgaggtctcgtggacggcccttcctatgagctagacacacggccctacccgtcggtcgtacaggtccgtacccgaggacgaacggaccggaccgaggacctcctaccgtgtcctaggtggaacgtagtcgactaagtttaccgaaaccgtaaaagtaccaaattagttcggttaaccgttttaacggttaccggtaaccggaagaacggtaacggaaaccgccgggtaaccggtacccggtcccggggtaccccggttaggttccgggtccgttaacggggtaataaacgttaaaacttaaaaggaaaccggtacggtaaggacgggtaaaaccgggggtccgaaccccgttaggggtaacggtaacccggtacccgggtaaggtacccggttacggttaaccttttccggtacggttccggcccctaacggaccggtccgtaaacgggtaaccgaaccgtaaacgtaccggtttacccgaccgtttaacggaaccgttcccggttaaaggtaccgggtacggtaacccgtaggaccgtaaacggaggtaaccggtagaaccggttagacgttaaccttagttacgtaccttagttaaccgacggaccgtaagaacccgtagtaacggtaccgttaacggttaagggttttaccggtttacgggttttacgggggtaccggggtttacgggggaaccggtaaacccgggtaaaccggtccggttttaaccggaccggtttacccgggttacggagggttccccggaaacccgggtttaccccgggcccttaccccgggg

SEQ ID NO: 120809 - DNA, 711 bp, Homo sapiens
  misc_feature: GYAE6OF02HPKZZ.2.38.D05.1.454.CMB.1.raw
  modified_base (122)..(122): a, c, t, g, unknown or other
  misc_feature (122)..(122): n is a, c, g, or t
  modified_base (173)..(173): a, c, t, g, unknown or other
  misc_feature (173)..(173): n is a, c, g, or t
  modified_base (242)..(242): a, c, t, g, unknown or other
  misc_feature (242)..(242): n is a, c, g, or t
  modified_base (495)..(495): a, c, t, g, unknown or other
  misc_feature (495)..(495): n is a, c, g, or t
  modified_base (589)..(589): a, c, t, g, unknown or other
  misc_feature (589)..(589): n is a, c, g, or t
tcagacgctcgacacacgaccggtgctcgatttagtatctgatagttgggtttgggggtgggtccaggaggcagaactctgggtgtctcaccatggcctggatccctctacttctccccctnttccactctctgcacaggctctgaggcctcctatgagctgacacagacccncccgttcggtatcgagttcgtccccgaaggacaggaccggcctaggactccaccttgctcgtgggaagntgctaactcggaaccaaagctaaatagtcgtactttaagttcgggtacctaggacgtaagaaccgaccgacgggacccgtacggccccctggtcggaccgttggggtactaagtataaacgtaaaggtactaaggtggaacgtccggtacccgtaggtaacggggaccttccggcggaacgcggtaacttctacggttcgtaccttcgactcgtacgaacggaccaacgtagtccgtaacgtacgaccgttanacggaaggtaggtacgtacgacggtagaacgtaaggcggtagacggacgttactaactagttcgttacacgtaatactagaccgtagtaacggngtacttacgggtttacgtttacggttttcgggtcggtacggggaccgggtacggtaaacgtcggtacgttcccgggaacgttccgtaacggggtccaacgggttacccacgggtacccccgg

SEQ ID NO: 120810 - DNA, 623 bp, Homo sapiens
  misc_feature: GYAE6OF02IYGAI.2.38.D05.1.454.CMB.1.raw
  modified_base (222)..(222): a, c, t, g, unknown or other
  misc_feature (222)..(222): n is a, c, g, or t
  modified_base (318)..(318): a, c, t, g, unknown or other
  misc_feature (318)..(318): n is a, c, g, or t
  modified_base (394)..(394): a, c, t, g, unknown or other
  misc_feature (394)..(394): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggaggcttagttcagcctggggggtccctgagacctctcctgtgcagcctntggattcaccttcagtagctactggatgcactgggtccacaagacctccgtagggaagggtctgggtgtgggtctacaccggttaattaagtagtnaggtagggtagtagcgacaagctacgccggtactccgtaggaacgggtccgaattcgaacccatccgtaccagganaaccaaccggacaaacgaaacgaccgtntaggtactctanaacgaaatcgaaacaggtctaggagacgtaccggaagaccacgtctagtgtaatcgttagacgacgaagtaagagttacgacagaccgtagcgttaacgggtaccgtacggtaacctaacggtcggggaacccggtaaggaaccccgttcggtaacccggtaccgtacccttccgacccgtagcccccg

SEQ ID NO: 120811 - DNA, 903 bp, Homo sapiens
  misc_feature: GYAE6OF02JEZ4F.2.38.D05.1.454.CMB.1.raw
  modified_base (228)..(228): a, c, t, g, unknown or other
  misc_feature (228)..(228): n is a, c, g, or t
tcagacgctcgacacacgaccggtgctcgatttagtatctgatagttgggtttgggggtgggtccaggaggcagaactctgggtgtctcaccatggctggatccctctacttctcccctcttcactctctgcacagctctgagcctctatgagctgacacacgccacccgtcggtgtcagtcgtaccccgaggacacggacgccaggactccacgtcgctcgtagganagtgactagttcgaaccgaaagactaaattagtacgtactttaggttacggtaccaggtacaacgaacgccgacggacccgaccggtccccgtgtccggtcgttaggtagtaacgttaagtaaacgtaaaacggacgtaacggtacggaacgggtaccggttaccccgtaccggtaagggggttaccctccccggttaaggaaccggtaccgttaaccggttttccggtccggttaccgggtaccctaccgggtaaccggtaccgttaaccgggaaaccggggtaaacctaaaccggtacggtttaacccggttaccggtttaaccggaaccgtttaaccgaccggttaagggggtaccggtaaccggtaccggtaacggaaccggaaaggtaaaccggtcgggttaaggtacgggttacttaaacggttacccgtttaaagtttaccggtaccgttaaacgtaaccggttccaagggttaccggaaccggtacgtacgttccggttaagggtttttaccggggttttacggttttgggggttaacccgggttacgggggtaaccggggttaaccggaacccgttaacgggttacccggtacccggtttaacccgggttccggtaaaccgggttacccggaaacccgggttacccggttacccgggtccccccgg

SEQ ID NO: 120812 - DNA, 845 bp, Homo sapiens
  misc_feature: GYAE6OF02JAIQE.2.38.D05.1.454.CMB.1.raw
tcagacgctcgacacacgaccggtgctcgatttagtatctgatagttgggtttgggggagccccagccctgggattcccagctgtttctgcttgctgatcaggactgcacacagagaactcaccatggagtttgggctgagcgttgggttttccttgttgcttaattttaaaggtgtccagtgtgaggtgcagcgtggtggacggtccgggggaggtcgtttagttcgaggtccggttcggggggtccctggacgtacctcgtccgttgtgccgtacgtcccgtcgtcgggtaactttcctaccgtttcgaaggtacgcctacgtggtatcgacctacggtccgggtcccgaccgtaacgccgttaccggaagggggtaaggggtccggttggggtcgggttcggggttccctccggttaacgtttaagtttaaacgttggtaggtaggttaggggtaagtaacggtaccaagtaacggaccgtacggaccgggtaccgtaccggtagggaaccgggtacccgtacgtttacccgaacccgtacgtacccgttaaccgaaccggaacggtaaaccccaaaaccggccgaaaacgaacccgtaccggtacgttaacgttagttacctacggaaacctaaagtaccgtaaacggtaggttacgtaacgggaaggtaacccgggacggtaacgggaacccggttacgtcgtttaacggtttaacggttattttaccgggcggttaagaaccggaaaggggtacttaaacggttccgggaacctagggtacccttaaccggggttcgtaacccgggggtttccaacccccgggttaggttacccggggg

SEQ ID NO: 120813 - DNA, 752 bp, Homo sapiens
  misc_feature: GYAE6OF02F9RZS.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagtacttagttcagccgtggggggtccctgagctctcctgtgcagcctcgtggacttcaccttacagtagctacgtggatcgactacgtgggtcccgaccaagcctcgaaggggaaggggcgtgggtaggtgggtactccgtacgttaagtaagttaggtagtacggtagggaggtacggaccaacgaagacgtaccggacggtaccggtaccggtagggaaacggggtaccctaagttaccaaccgtacttaccgttaccgaaacggaacggaaacccgaaaccggtaacccgaaaacggaaaccgaaccggtaccgttaagttactttaccgacgtaaactaaaataccggtaaactacgttaacctagggaaaagcccgggacccgggtaaaagggtacccgaccgggttattacgggttacgtttaatttccgtaggtaccgaacgtaaaaggcgtaaacgttacggactaggaccaggtaccgttcgggtaacacccggttaactaccgggtcgggaacccaaccggggtacctcgggtccaacccggttctacccgtacgtaccgtacccccg

SEQ ID NO: 120814 - DNA, 753 bp, Homo sapiens
  misc_feature: GYAE6OF02G13JR.2.38.D05.1.454.CMB.1.raw
tcagacgctcgacacacgaccggtgctcgatttagtatctgatagttggggtttgggggagccccagccctgggattcccagctgtttctgcttgctgatcaggactgcacacagagaactcaccatggagtttgggctgagtcgttgggtttttcctttgttgtcttaagttttaaaaggtcgtccgtaggtgtggagggtgcacggtcgtgggtcgggacgggtccggggggaggtcgttagttcgacggtccgggtcggggggtccctggacgtactcctccgtgtcgcacgtccgtcgtcgtacttacctaccttcgagttacgctacgtacggtagcgtcgtacggttccgggtcccaccgacgtccgtaccgggagggggacggggtcgttgggtcgggtcggtcgtacgtacgttaagttacgtggtagtaggtagggagtacgacgtaacgacgtcggtacgtaccggtaccgtacgggtacggacggggtacctacgtaccactactccgacgaacgtaccgaacgaaccgaccgtaaacgaaccgtacgacgttgtaacttccgacgtaaacgtactaacggtactaacggtccgaagggtacggaccggtaccggacggggtaaccggtcggttacggtttacggttacgttacgtttaacggtcgtaacggtacgaagggtacgtacgtagtcgagaccgacggttacggtacgggaccggtaccggtaccggtaacgggg

SEQ ID NO: 120815 - DNA, 1003 bp, Homo sapiens
  misc_feature: GYAE6OF02FGR8K.2.38.D05.1.454.CMB.1.raw
  modified_base (119)..(119): a, c, t, g, unknown or other
  misc_feature (119)..(119): n is a, c, g, or t
tcagacgctcgacacacgaccggtgctcgatttagtatctgatagttgggtttggggtggtccaggaggcagaactctgggtgtctcaccatggcctggatccctctacttctcccctnttcactctctgcacaggctctagacggtcctaccgtatgacgtctgaaccacacgcccacccgttcgggtagtactacggttccgtacccccaaggtaccgaacggaccggacctaagggaacttccgacccgttgacccgttcgtacgggaagtacgtccgtccgtaacgtttacggaaccaaaacggtccgtaaaatttagttccggttaacgttttaagttaccgggttaaacccgaacggtaccgtaaacggtaaccggaccccggtaaggggaaccccgtcccgggtaccccgttggtaacggttaccggttcggggttaactaactttaaacggttaaagttaaaaacccgggagtaacgggtttaacggaacggaaccccgggttcccccgttaagggtaaacccggggtaccttttcccgggtaaggggaaccggttcgttaccgtttaccgtccggtttaccgggtaccttaccccgaggtacccgtagggtaaccggtaaactaaccggtacggttaacccgtacgtacgtaaccgtacgtaaccggtgttaaaccgggaacttaccgggaacgtacgaacgtaaacggtggtaaaccggtggttaaccgtacgtaaacgtttaacggttaaacccgtaacgtttaccgaaaaccgttacgggaaacccgttaacgtaaccgaaacgggttaccgtaaaaccggttttgggtttttaaacccggggtttttaacgggttttttcggggtaaaccggggtttcccggggttaaaggggtaacccgggttaaccgaacgggttacccggtaaccgggttacccggttaacggtacccggtaccggtaacccgtacccgggtaccttaacccccggg

SEQ ID NO: 120816 - DNA, 703 bp, Homo sapiens
  misc_feature: GYAE6OF02GMPLS.2.38.D05.1.454.CMB.1.raw
  modified_base (209)..(209): a, c, t, g, unknown or other
  misc_feature (209)..(209): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (348)..(348): a, c, t, g, unknown or other
  misc_feature (348)..(348): n is a, c, g, or t
  modified_base (448)..(448): a, c, t, g, unknown or other
  misc_feature (448)..(448): n is a, c, g, or t
tcagacgctcgacacacgaccggtgctcgatttagtatctgatagttgggtttggggggaagaggaagactgacggtcctgccacaggtggtgctgggcacggtgggcactcgacacaacatttgcgctcaactgtcttgtccagtgtgaggtgcagctggtggaggtccgggggaggcttagttcagccgtgggggtccctgagctcnctgtncacgtctgtntctcctacctagtagtcnctagtagntacgcctacggtccggtccacgtacgccgacgggaaggggacggtcgtgggtggtccgtctaccgtacgttaattaaggtgagtaggtaggtatcganaacgacgtacgacggacgttacgtacggtaagggccgactactacgacctacgtccacgaggacaaccgaaccgaacgtaacgaactcggtatcgtaacncgtacaaacgtaagacgtacgtagtactagggacgaccggacggtaacgaccgtcgtggtattacggtacttacggtagtacggaagtagtaaacgtagtacgcgtaaggcccgaaggtttcccggaacggttacccgaacccgggtccggttaacccggggaacgggtaaccccggttaacccggggttaccccggttacgttaacccccggttcgttacccccgacccgttaccggcccccgttaaaccccgg

SEQ ID NO: 120817 - DNA, 675 bp, Homo sapiens
  misc_feature: GYAE6OF02IZKKU.2.38.D05.1.454.CMB.1.raw
  modified_base (191)..(191): a, c, t, g, unknown or other
  misc_feature (191)..(191): n is a, c, g, or t
  modified_base (621)..(621): a, c, t, g, unknown or other
  misc_feature (621)..(621): n is a, c, g, or t
  modified_base (626)..(626): a, c, t, g, unknown or other
  misc_feature (626)..(626): n is a, c, g, or t
  modified_base (631)..(631): a, c, t, g, unknown or other
  misc_feature (631)..(631): n is a, c, g, or t
  modified_base (636)..(636): a, c, t, g, unknown or other
  misc_feature (636)..(636): n is a, c, g, or t
  modified_base (642)..(642): a, c, t, g, unknown or other
  misc_feature (642)..(642): n is a, c, g, or t
  modified_base (645)..(645): a, c, t, g, unknown or other
  misc_feature (645)..(645): n is a, c, g, or t
  modified_base (651)..(652): a, c, t, g, unknown or other
  misc_feature (651)..(652): n is a, c, g, or t
  modified_base (654)..(654): a, c, t, g, unknown or other
  misc_feature (654)..(654): n is a, c, g, or t
  modified_base (656)..(657): a, c, t, g, unknown or other
  misc_feature (656)..(657): n is a, c, g, or t
  modified_base (662)..(663): a, c, t, g, unknown or other
  misc_feature (662)..(663): n is a, c, g, or t
  modified_base (665)..(665): a, c, t, g, unknown or other
  misc_feature (665)..(665): n is a, c, g, or t
  modified_base (670)..(672): a, c, t, g, unknown or other
  misc_feature (670)..(672): n is a, c, g, or t
tcagacgctcgacacacgaccggtgctcgatttagtatctgatagttggggtttgggggctttgcctgggtctcctggacagtcagtcaccatctcctgcactggaaccagcagtgtactttgtgcttataactatgtctcctggtaccagcaccaccaggacaaacgcccccaaatccttgttttgagtnagtagcggccctgagacgtccctgacgttcggttctctcgcctacctaagtcgtcggacaaccgtaccggtccctcccgtcggaccccttcgtcgtcgggtaccctccggaacggtcgtaggaaggtacgtacgggacggtaccttaggtaacgtttaccttaacgtcggacgacgccggtacctaagttaacccgttaccgaaccccgggtaacccctaaagggttaggggttccggtttacggggaccgggtaaggttaaccgttaaaggggccgttaacccggttccggttcgggaaccaccgggtacccgtaacggccttccccgtaaccccgtttcggaaccttccgttcgtttaccccggtcccctaccctccgtacctacgttactcgtcgcgtacggcggtacgcgtacggacgcgactagngtcangcagntcgangacgtnctnagtcanngncnntcgtnncncgagnnntcg

SEQ ID NO: 120818 - DNA, 861 bp, Homo sapiens
  misc_feature: GYAE6OF02HLNXG.2.38.D05.1.454.CMB.1.raw
tcagacgctcgacacacgaccggtgctcgatttagtatctgatagttgggtttgggggtgggtccgaggaggcagaactctgggtgtctcaccatggcctggactccctctacttcctcccctcttcactctctgcacaggctctgacggcctcctatgacgctgacacagcccacccgtcggtgtccagtcgtacccgaggacacggaccgacgaggaactcctacgtgcttcgtacgggaagtagtcgacgtacttacggaacccgtaaaagcgtaaagtaacgttcggtactttaacgtttacggttaacccgtaagacgtaaacggaacggaccgaacgggaccccgaaccggggtccccccttggggttaaccgtacccgggttgggttaaccgtaacgttaaaagttaacgttaaaaacggaaccgtaaggggttaggaaacgggttaacggaccccggtaccggtaaacgggggtaacccgttcccgttacggggaacggtaccggttaaacgtttacccgttacggttccgggtaccgttaaccccggtaacgggttaccccttacggggaaaccggggtaaaccgtaaacctacccggggtttaactaacccggttttaacggaaccctaaacggtaacccttaagggtacggtacggtaccgaacggaccggtaaagacggtaaagtacgggaggtaaccgtaggaactttaccggtattaacgggtcaaacgtcgtaacgacgaacgaagaccgaggtaatacgggtttgttttgggtacggttcgggaacggaacggtaccgaacggtcgtacggtaccgtctagggtccaagtacccgagttacccgg

SEQ ID NO: 120819 - DNA, 739 bp, Homo sapiens
  misc_feature: GYAE6OF02JFA4K.2.38.D05.1.454.CMB.1.raw
  modified_base (452)..(452): a, c, t, g, unknown or other
  misc_feature (452)..(452): n is a, c, g, or t
  modified_base (511)..(511): a, c, t, g, unknown or other
  misc_feature (511)..(511): n is a, c, g, or t
  modified_base (569)..(569): a, c, t, g, unknown or other
  misc_feature (569)..(569): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggaggtccgggggagtcttagttcagtccggttcggggggtcccctggacgaccttccgtccgtggtgcacgtcccttcgtaggtacttaccctacccgtttcgtaacggtacggtccttaccgtagggtatcgcctacggtcgggtcccgtaccaagccgttaccggaaggggtacgggcgttgggtggtcgggtcctaccgtaagttaagttacgtagtgaaggttgggaagtcgactaacgacgtacgtaccggcgtaccgtccgtaggacggtccgtatcgaacctnactcgaagtacgaacgaaccgacgtaacgaaccgcgttacctaggtaactcccggtaanactaaacgcgtaactggtactaggacgtacggaaccggcggtaaacgccgggttaacnggttttacccgtaagtttccgtggtacgaacgtaggggtaactaacgcggtaaacctgaaacccgtgttaccgtacgggtaccgacccgtaaggggtacccgggacggtaacccggaacccgggttcctaccggtcccttaaccggtccctactaccgccgtaacccccg

SEQ ID NO: 120820 - DNA, 909 bp, Homo sapiens
  misc_feature: GYAE6OF02HGRS2.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggaggtccgggggagcttagttcagccgtgggggtccctgagctctctgtcgcagcctcgtggtacttccaccttcgagtacgcctacgtggatcgaccacgttcgggtccccgaccgaacggtcccgttacccggaaggggggtaacggggtcgttggggttcggttacggggttccttaccgtaaccgggtttagtttaggtaacggtttaagggttacgggtaaggttacgggggaacggttaacggacccggtaaaccgaaaacgggtacccgtaaccgggaccggggttaacccgtacccggggttaaggggaaaccggggtacccgtaacgtttacccgaacccgtacgtttaccccgtaccgaaacggtaaccgaaacccgtaaacccggaacccaaaaacggtaaacccgtacccggtaccgtttacgggtaaactttcccggaacggtaaaacccgtaaaacgttacggtaaaaccgtaacgggtttaccgtaagggaaaccgggtaaccgggaaccccgggtaaagggacccgtaacccgggttcgtttaacgggtttacggtttaaacgtttaccggttacgggtaacgtaaccggtaaaacggtagtaacgttacgacgtaacggaccgttaaggtccggttacggacccggtacccggttaacggtacccggggacgggtacccgaaccggggtaccgttcgggtaccctacccggtccctccgtacggaccccg

SEQ ID NO: 120821 - DNA, 855 bp, Homo sapiens
  misc_feature: GYAE6OF02FRJZ8.2.38.D05.1.454.CMB.1.raw
tcagacgctcgacacacgaccggtgctcgatttagtatctgatagttgggtttgggggtgggtccgaggaggcagaactctgggtgtctcaccatggcctggatccctctacttctcccctcttcactctctgcacaggctctgaggcctcctatgagctgacacagcccaccctcggtgtcagtgtccccaggacagaccgggccaggactccaaccgtgaccttcgtgggaagattcggaccaagtttacgacccaaaaacggtacctaaagttaacgtggtacctttaagttttcgggtaacccacgtacgaaacggaacgaccgtaagggaccccgaggtccccccgttaggtcgtaccggttagggttcgaagttacgttaaacgtaaaaaggaaccgtaaggttacggaggaaccggtccccgtacgtaacggggtactccccgttaggaccggacgtacgtttactcgttacgggccttacccgacgtccgtacggaacgggacctaaaccggtacgtacgtaaccgtttacggaacctacgtacgtacggtacgggtacgtacccgtagggaccaaggtaaaggaggttaacggacgggtaccgtaaggtaacctttaagtttaagtaccggttaaacgttaacgttacgacggaaccgtaagggaacccgtaggtaacccggaagggtttaccggggttttacgttttttaggggtaccgggtttaccggggaccgggttaaacgggggtaaccctaaacgggtaccggttaccggttaacccgggttcccggtttaacgggggttaacccgaccgggttacccccggaagggtttaccccccggg

SEQ ID NO: 120822 - DNA, 740 bp, Homo sapiens
  misc_feature: GYAE6OF02JB6U1.2.38.D05.1.454.CMB.1.raw
  modified_base (154)..(154): a, c, t, g, unknown or other
  misc_feature (154)..(154): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (570)..(570): a, c, t, g, unknown or other
  misc_feature (570)..(570): n is a, c, g, or t
  modified_base (636)..(636): a, c, t, g, unknown or other
  misc_feature (636)..(636): n is a, c, g, or t
  modified_base (732)..(732): a, c, t, g, unknown or other
  misc_feature (732)..(732): n is a, c, g, or t
tcagacgctcgacacacgaccggtgctcgatttagtatctgatagttgggtttgggggaagaggaagactgacggtcctgccacaggtggtgcgtaggcacggtgggcactcgacacaacatttgcgctcaactgtcttgtccagtgtgaggtncgagcgtggtggagtccgggggagcgttagttcagtccgtgggggtccctggacgtactctctgtcgctaggtcctgtggacttccacgttcaggtactctacgtggtangtaccncgtacggtcccgaccttaaggcccgtaccggaaggggtacgggtccgttagggttacggttgggtacccttacggtaaacgtttattaaaccgtaggttaggtaaggtacggggtaagttacgacgaaaccggtaacgttccgaaccggtccgggtaacccttcggggacggtaaaccgggtcccgtaacgtttacccgaacccgttactaccgtaccgaaacggaataacccgaaaccgaacgtaaacaacccgtagtaccgtaagtaacctcgtaacgaagtaacggacgtaaaccgntacgagtacgaacggtacgacgtaccggagttaccgagtacgttagtacacgttacgaccgtaagngtaacgtccgaacgtacggcacgggtctacggtaccacggttacgaggttaccggacgtaaccgacccgtcctaaccgtaccgtccctcggtaccngtcccccg

SEQ ID NO: 120823 - DNA, 711 bp, Homo sapiens
  misc_feature: GYAE6OF02JGFKA.2.38.D05.1.454.CMB.1.raw
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagccgtggggggtccctgagactctcctgtgcagcctctggattccaccttcagtagctactggatgcacgtgggtccgccaagctccgaggggagggctggtgtgggtctcacgttattaagtagtgacgtgggagtagacacaagctacggcggactccgtaggaacgggccatcaccatctccagacgacaacgacaagaacncgntagtactcgtacgacaaagtcgaactacgttctagacgacggaccgaacggacgacggcttaggttagtaactttacgtgtacgacgaaaggtagacgtacgacgagccgtaggtcggttacgggacccgaccgttaaccgtccgggtccgggggacccgtaaaccgggggtacccttagggtacccgtacccggttccttccccgtaggaaccccgtccccgtaacccgaacccggtaaccggggcccttacgggttccccggtcccccgtttccccggacggtccccgtacccgtcggtaccccgacggaaccggtccgaccctaacccggtaccggacggtacccgaaccgtacccggaccggtccccggtccccgg

SEQ ID NO: 120824 - DNA, 835 bp, Homo sapiens
  misc_feature: GYAE6OF02FRZAW.2.38.D05.1.454.CMB.1.raw
  modified_base (248)..(248): a, c, t, g, unknown or other
  misc_feature (248)..(248): n is a, c, g, or t
tcagacgctcgacacacgaccggtgctcgatttagtatctgatagttgggtttgggggtgggtccaggaggcagaactctgggtgtctcaccatggacctggatccctctacttctccccctcttcactctctgcacaggctctggaggcctcctatgagctgacacagcccaccctcggtgtcagttcgtcccccgaggaccaggaccggccagggtactccaaccttgcgttcgtggagatgaccntttcgaccgtaaaagccaaattagtagtactttattcggttaaccagtacaagtaacgccgtacggaccgacggcccccttggtcgaccgttgggtacgattaacgtaattaaacggaccgtaagttcggaacggaaccggtccccttacggaacggggtacccttaaccccgttggaacggtccgttaacgttttccttacccggttaggaccccgtttacccgaacggtacccgttaacggaaacccgggggtaaacctaaacccggtaacggttaacccgtaccggggttttaccgaaaccccgtaggttaacccgtaacgggtttaacccggggtagtttaaacccccgggaaggcccggtaaaaggtaaaacggtccggtttaagggacccgggttagtaaccggttaactaacggtttaacctttacgtaaccgttaactacgtacgaccaacgtaaaccgcgtacgtaggttaccgggtttgtttcggtggggttacggtcggtaaccgggtacgtaagttccggtacgtaacccggtttcggttacggtacccgtaacggtaccccgagttacccccgg

SEQ ID NO: 120825 - DNA, 818 bp, Homo sapiens
  misc_feature: GYAE6OF02GFZWC.2.38.D05.1.454.CMB.1.raw
  modified_base (153)..(153): a, c, t, g, unknown or other
  misc_feature (153)..(153): n is a, c, g, or t
  modified_base (162)..(162): a, c, t, g, unknown or other
  misc_feature (162)..(162): n is a, c, g, or t
  modified_base (366)..(366): a, c, t, g, unknown or other
  misc_feature (366)..(366): n is a, c, g, or t
tcagacgctcgacacacgaccggtgctcgatttagtatctgatagttgggtttgggggaagaggaagactgacggtcctgccacaggtggtgctgggcacggtggcactcgacacaacatttgcgctcaactgtcttgtccagtgtgacggtncagcgtggnggagtccgggggagcttagttcaggccgtgggggtcctgacgactcgtcctgtacgcacgccttcgtggtacttcctacctttacgaagtaacgcttacgtggacttgacgtacgttacgggtcccggaccaacgtccgtaaccggaagggggtaagggccttagggtcggtcgggtacctacgtaagtacttaacgttaaggngtacggtaggagtacgacgtacgaacgtaccgtacgggacgtacgtacccggtaggaaaccgggtccgtaaacgttccgaacctagttaccccgtacggaaacggaaccgaaccgtaaaaccgacccgtaaaaacgtacccgtaacgtacccgttagtaaccgtttacggtacggttaaaactaaaaccgtagggtaaaaccgttacgttacgtaaccgggaaacggttaacccgggaaccggtaaacggacccggtaacgttcggttaacggtaagtttaaacgtccgttaaggtccggtaagaaacgtaaggtaccgtaagacgagtaacccgtagtacggtccgggtaaactaccccgggtacggttaacggacccggggtaaccgtaaccggtacccggttcgtaacccgtacccgttaacggtcccctacggtaccctaacccccgg

SEQ ID NO: 120826 - DNA, 788 bp, Homo sapiens
  misc_feature: GYAE6OF02FYFX8.2.38.D05.1.454.CMB.1.raw
  modified_base (732)..(732): a, c, t, g, unknown or other
  misc_feature (732)..(732): n is a, c, g, or t
tcagacgctcgacacacgaccggtgctcgatttagtatctgatagttgggtttgggggagcccagccctgggattcccagctgtttctgcttgctgatcaggactgcacacagagaactcaccatggtagtttgggctgagcttgggttttccttgttgtctatttaaaggtcgtacagtgtgaggtgcgagcgtgggtgggacggtccgggggaggtcgtttacgttcgaacggtccgggtcgggggggttaccctggacggaccttcctccgttaggtcgtaccacgtcctcgtcggtacttcctaccgttacgagtacgtacgtaccgtagtagtcgacgtacggtcgggtaccccgtaccgaacggtccggtaccgggaagggggtaaccggggcggttcgggtcggttacgggtcgttaccgtaacggttaagtttaagtacggtagtaagggtcggggacgtacgtactaacggacgtaccgtacggacggtacctcggtacggaaccggggtcctaagttacccacgtactccgtcgacggaaccctacgaaacccggtaaacaaacgtaaccgaccggttacgttcttaacgttcgtaccgtaactaaacttcggaaacttcggaacgttacggacgtacccgggaacggtaacggcggtaaccggttaccgttacggtttacttaacggttcttagggtacgaacggtaaaggtaccggaagntaaccggcgtaggtacggtacccggttacgtaccgggtacccgtacggtaccgggg

SEQ ID NO: 120827 - DNA, 730 bp, Homo sapiens
  misc_feature: GYAE6OF02GH1AM.2.38.D05.1.454.CMB.1.raw
  modified_base (594)..(594): a, c, t, g, unknown or other
  misc_feature (594)..(594): n is a, c, g, or t
  modified_base (679)..(679): a, c, t, g, unknown or other
  misc_feature (679)..(679): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggagtttgggctgagcttgggttttccttgttgtcttaattttaaaaggtgtccagtgtgaggtgcagctggtggaggtccggggagcttagttcagccgtgggggtccctgagactctcctgtgcacgcctcgtggtacttcctaccgttcaggtacgtctacgttggatcgctacgtcgggtcccgaccaacgccgtacggagggggtaacggggtcgtggggtcggttgggtcctacgaacgtttaattaagtaggtgacggttaggggaagtacgacgaacgaacgtccgtaacggcggtaaccgtacggtaacggaaccgggtccgtacttaccgacctacgttcccgaaccgaaggaacccgtaaacccgaaaaccggacccgaaaaagtaaccccgcgttaccgttagtaacgttcgaactaaaccgtaaagacgaaacctagggttaccaggggaaaccncgggacccgggaagggaaccccgtcgggttactaggttaacgtttaacctggtagtaccgaaacgtaaggaacgttaagaaccgnaacggacggtacctaccgggttacgggacccctaccgaggttaacccgggg

SEQ ID NO: 120828 - DNA, 759 bp, Homo sapiens
  misc_feature: GYAE6OF02J07QS.2.38.D05.1.454.CMB.1.raw
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
  modified_base (265)..(265): a, c, t, g, unknown or other
  misc_feature (265)..(265): n is a, c, g, or t
  modified_base (542)..(542): a, c, t, g, unknown or other
  misc_feature (542)..(542): n is a, c, g, or t
tcagacgctcgacacacgaccggtgctcgatttagtatctgatagttggggtttggggggaagaggaagactgacggtcctgccacaggtggtgctgggcacggtgggcactcgacacaacatttgcgctcaactgtcttgtccagtgtgaggtgcagctggtggagtccgggggagtcttagttcagccgtggggggtcctgagactctccgtgtgcagcctcgtggattcaccttnagtntctactgatcgcacgtgggtccncaagctcgagggaggctggtgtcgggtactcgtaacgtataacgtagtggagtcgggtagtacggacgtaacgagtaccgtacgggccggtaacgttccggtagggaaacggggtccgtacgttaccgaacctacgttaccgtaacccgtaaggaaaccgaaccgtaaaccggtacccgaaaggaaccctacgggtacttacgttaacgcctaacgggtaactaaaacggttacgaacgttacgtccgttaggaacgtacggaccgtaacggaccgngggtacgttggtacgtttaacgttaccgtaggtccgtaacgtaaacggagttaacgtaccggaaccgtaaacggacccggttagttacccgggtacggttaacccgcccgggtaacggttaccgggacgggggtaaaccccgtaccggggtaacccggttccggttaaacccgtcccggttcccgtttaaccgtacccggtaaccgttaccccccgg

SEQ ID NO: 120829 - DNA, 761 bp, Homo sapiens
  misc_feature: GYAE6OF02I3YBU.2.38.D05.1.454.CMB.1.raw
tcagacgctcgacacacgaccggtgctcgatttagtatctgatagttgggtttgggggaagaggaagactgacggtcctgccacaggtggtgcgtgggcacggtgggcactcgacacaacatttgcgctcaactgtcttgtccagtgtgaggtgcagcgtgggtacgggacggttccggggggacgtcgtttagttccgagtccggtggggggtccctggacgaccttccgttccgttgtcgcgtcgtccttcgttggtacgtttccctaccctttcgtaagttacgtaccgttaacgtgggacttcgacctacggtcgggtacccgaaccgtaacgtctacccgggaaggggaacgggtcgttgggttacggttggtctaacgtagttaagtttaatggtagtagtcgggtacgtaggacagtaacgctacggacgaccgtcggaggtacggacctagtacccacctagtcctaacgaggtaaacgaaaccgaaccgtaacccaaagaacgaccggtctacgtactacgtcgaaacgtacgtaagtaactagtacgacggacgtacgacccggaaggtacgtaacggtccgtagttagttacttacggtacgtacgtaacggtaagacggtaacgtagacggtacgaccgtagttccggtaccggtccggtaccgtacggtccggtaaccggggcccgttaaaccggggacccggttacgtacccggtacggtaccctccggtacctacccgtaccccgg

SEQ ID NO: 120830 - DNA, 783 bp, Homo sapiens
  misc_feature: GYAE6OF02GED5D.2.38.D05.1.454.CMB.1.raw
  modified_base (124)..(124): a, c, t, g, unknown or other
  misc_feature (124)..(124): n is a, c, g, or t
tcagacgctcgacacacgaccggtgctcgatttagtatctgatagttgggtttgggggtgggtccaggaggcagaactctgggtgtctcaccatggcctggatccctctacttcctcccccctnttcactctctgcacaggctctgaggcctctatgagctgacacagcccaccctcggtgtcagtcgtccccaggacacgaccggaccgaggactccactgcctcgtaggagtatgactattacgacaaagctaatctagtacttagttacggacagacaagtacgcgagacccgcggtcccctgtcgtcgtaggttagaattaagtaacgtaaagacgtaaggtacggacgtaaccggtcccgtaacggtacgggtaacctccggaagggtaccgtcggttaacttaccggttccggtacggttaccccaccgtaggtaacccgtacgggtaaaaccggggaaaccctaaggtacccgggtaccgttacggttaaccgtaacctaggtacgtacggggtaacggtcgaccgaacggggaacctaaagggtacggtaagtacggacggtaccgttagtaacgttacttaccggtactaactaacggtacgtaaccgcgaacgtaacgacgtacgtttaccggggtttaagggttttccggttttacggggtcggggtaacccggggttaccgggaacgggttaacccgtacggttacggtaccccggtaacccggtacggtaccggtaaacccggtccggacccgggttacccgtaccccgg

SEQ ID NO: 120831 - DNA, 734 bp, Homo sapiens
  misc_feature: GYAE6OF02IQET7.2.38.D05.1.454.CMB.1.raw
  modified_base (619)..(619): a, c, t, g, unknown or other
  misc_feature (619)..(619): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggtagtttggctgagtcgttgggttttccttgttagtcttaagttttaaaaggtgtaccgagtgtagaggtgcgagtcgtggtaggaggtcccggggagtcgttagttcgacggtccggtcgggggtcctaggacgtcgttccgtcgtgtggccagcctgtcgtactacgaccttacgagtacgtacgtacgtggtagtcgaccgtacggtcggtcccgaccgagtcccgtaccggagggtaacggtctggtggtcggtctacgtaacgtaattaagtagtagtaggtacggtaagtagacgaacgagtccgtaacggtaccggtaccgtaacggtagacggtaccgtactaccgtaccacgtacccgacgagtaaccgtaacaaaccggacctaaaacgaccgaccgtaccgttagactacgtagtaaacgtaaagtaccgtaacgcgttaacgtacggaacgaccgggtaccgaacgggaccttaacgggngttacggttagttaaccgttgtacggtaacgaagaaggtagtaaacggtaacgtaccggtaaggacctaccgggtacttaacccggggtacccaccgggtacgggttaacccggg

SEQ ID NO: 120832 - DNA, 699 bp, Homo sapiens
  misc_feature: GYAE6OF02IYB2Z.2.38.D05.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
  modified_base (322)..(322): a, c, t, g, unknown or other
  misc_feature (322)..(322): n is a, c, g, or t
tcagacgctcgacacacgaccggtgctcgatttagtatctgatagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccncaagctcgagggaggctggtgtggtctcgacgtattaanagtgagtggagtagcaacaagcgtaacgcggaactccgtagaacgggctaattcacctatcaccagacgacaacgaccaagaacncgctagtacttcgagaactaaagtacgaaacgtagtctagaagacggacccggaaggtaccgacggtacttaggttagttaattaccgtggtacgaacgtaaaggagtaacgtaagacgaagtacgaacggtacgtacgggtaaccgtaccggtaacgtaccggtacggggaccgaaacgggtacccgttcgggtaccctaaccgtcctaccgttaccgaccgtacccgtacccgaaccggtaaccggaccccttacggttacccggttccccgttaccccgtaccggtcccgtccccgtaccggtccccgtacggaccggacccgtacccgtacccgtacggaacgtaccgacgaccgtacgggcccgtacccggg

SEQ ID NO: 120833 - DNA, 807 bp, Homo sapiens
  misc_feature: GYAE6OF02GFAEZ.2.38.D05.1.454.CMB.1.raw
  modified_base (676)..(676): a, c, t, g, unknown or other
  misc_feature (676)..(676): n is a, c, g, or t
tcagacgctcgacacacgaccggtgctcgatttagtatctgatagttgggtttgggggagccccagccctgggattcccagctgtttctgcttgctgatcaggactgcacacagagaactcaccatggtagtttgggctgagtcgttgggtttttccttggttgtacttaagttttaaaaggtcgtactaggtgtgaggtgcgagtcgtggtggaggtccggggagtcttagtcagtccggtcggggtcctggacgtacctctccgtgtgcgacgtccgtgtaggtcttacccgtaccttacgacgtacgtctacgttaggactggtacctacggtccgggtaccgaccgtaacggcccgtaccggggaggggtacgggtcggttagggtcggttcggtctaccgtaaactttaagttacgtaggtagtaggtacgggagttaacgaccgtaaggtacggtaccgtaaccgggtacggtaccgtaacgggacgggttaaccggtcccgtaacttaccctaaaccgtcttaaccgtaaccgaacgaaaccgtaacccgaaccgtaaccgtaaaacggaccttacgtaccgtattaacgttacgaaacgtaaactaaggtaaccgtaacgtaaccggtacgttaggaaaccggtaccggaacgggaccggtaacccgngggttttacggttacgttaaacgtttaccgttacgtacggttaacggaaacaagggtaacttaacgagtaccgtagacggttacgtaccgggttaaccggaccccggttacggtacccggttaacccgggg

SEQ ID NO: 120834 - DNA, 657 bp, Homo sapiens
  misc_feature: GYAE6OF02FXU6T.2.38.D05.1.454.CMB.1.raw
  modified_base (174)..(174): a, c, t, g, unknown or other
  misc_feature (174)..(174): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggngcttagttcagccgtggggggtccctgagactctcctgtgcagcctctggattccaccttcagtacgctactggatgcacgtgggtccgccaagcctaccgaggggaacgggctgggtgtgggtcctcgacgttaattaatgtgagtgggagtagcaacaagcgtacggacggaccttcggtaggaagggcctattccactactcctaccagtacacgaaccgaccgaaacgaaccgacgtctagttactcgtagaccaaaagtcggaaactgtcgtggaagacgaccggaagggacacgggtcttggtataacgtttctgggacgagtaaggagtatacgccgaagacgtaggtccgttcggggaacccgtacccgggaaccgttaccgggtaccggggggaacccccgtaacggggttaacccccgtcggttacccgggtaccccgttccgttcccgtaccggtcccgttaacccccccgg

SEQ ID NO: 120835 - DNA, 834 bp, Homo sapiens
  misc_feature: GYAE6OF02FI5OA.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctggtggagtccgggggagcttagttcagccgtgggggtccctgagactcgtcctgtgcagcctcgtgattcaccttcagtagctactggatgccacgtgggtcccgccaagccgtaccgaaggggtaacggggcttagggtgtcggggtctaccgtaacgttaattaagtacggtgtacgtaggggaagttaggaccaacgtaaacggccgttaacggaccgggaaccttcccgggtaagggaaaccggggtcccgtaacgttttacccgaaccctaacgttacccgtacccgaacggtaaccggaaaccgtaaacccggtacccgtaaaaaggaaacccgtaacccgtcgtttaagtaaccgtttaccgtacggaaaccgtaaaaagtaccggtaaaccgtaacgttaccgtaagggaaccggaaaccggtacccggaaagggtaacccacggggttaccgtaggttttaccggttaaacgtttacggttaccggtacggtaacgaaacggttaggtaacttaaccgggacgaaacgtcgtaacgtaccgtacgggttacccgacccggttaacgtaaccgggtaccgggggaacccctaaacggggtaacccccgttacgggtttaccccgtaaacccgtttccccggtacccgttaccgaccccgtaacccccg

SEQ ID NO: 120836 - DNA, 855 bp, Homo sapiens
  misc_feature: GYAE6OF02F0FIT.2.38.D05.1.454.CMB.1.raw
  modified_base (187)..(187): a, c, t, g, unknown or other
  misc_feature (187)..(187): n is a, c, g, or t
  modified_base (698)..(698): a, c, t, g, unknown or other
  misc_feature (698)..(698): n is a, c, g, or t
tcagacgctcgacacacgaccggtgctcgatttagtatctgatagttgggtttgggggtgggtccaggaggcagaactctgggtgtctcaccatggcctggatccctctacttcctccccctcttcactctctgcacgaggctctgaggtcctcctatgagtctgacacacgccctacccgtcggtntcagtccgtaccccgaggaccaggaccgcgaggactccgacgtgctacgtaggacgatcgactataccgacgtaaagactaattacgtcgttacgttagttaccggtaacgacgacgaacgaaccggccgtaacggacccgtaccggtaccccgttaggtcgtacggttacgggtacgtaacgttaacgtaaacgtaaacgtacggtaaggttaacggaacgggtaacccggtccccgtaagggtaaccgggtacccgttaccggtaacggaccgttaccgttacgtttccgtaccgggtttcgaccccttacggacggtttaccggaaccgggtaaacggtaaaccgtaaccggttacgtaccgttaacggtttaccgaaccgtttacgtaaccgggtaagggttaccggaccggttaccgggaacggaacgtaaacgggtaagtaacgggtacgtaaccgggtacgttaacgttaaccggtttacttaaccggttacgaaaaccggttntaaccggaacgtacggaaaccgttacggaacgtttaggttacgggtttacgggttttacgggttttacggggaccggtttacgggacgggtaaccggtacgtacggtacccgttacgtacggtaccgtaggtcccgaccggttaccgtccgttcccg

SEQ ID NO: 120837 - DNA, 878 bp, Homo sapiens
  misc_feature: GYAE6OF02HLPO4.2.38.D05.1.454.CMB.1.raw
  modified_base (394)..(394): a, c, t, g, unknown or other
  misc_feature (394)..(394): n is a, c, g, or t
  modified_base (601)..(601): a, c, t, g, unknown or other
  misc_feature (601)..(601): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctctgacacaggctctggacggcccttcctatgagcgtacgacaccgtagccctaaccccgtgggtcgtcaacggttccgtacccccgaaggaccacggtacccggccgaagggtactccaccgttcgcctccggtaggagtatcgactacgttacgaacccaaaggtccaaattacgtcgttacgtttaacggtttacggtaaaccgtacggactaaggggaaccccgtaccggacgggtaccccgtaccggtccccgtttaggnggtccgttagggtacctaagtaacttaaagtaaacgacgtaggttacggaacggtccggtaccctaggggtaggtaccctcgtaggtaccgtcgtactttcgtacggcgtacctcgaggtccgtaacgggacacgtacgttacgtaccgtaggtacctaacgcgtttaggacggtcggtaccgtccggaagacgggtaagaacgggntacggggtacgtacctacggttaacttacgtttaccgtacgtaacgtaaccgcggtacgaccgttaagtacccgaaagggtttccggtttaaacggggttttccgtttttaacggggggttttttcgggggtaaccccgggggttttacgggaaccggggaaaccccgggttttaacgaacccgggttccggtttaaaccggggggttccccggtttaaggggtccccgggttaccggaaacccgggttaccccggtaaccggtttacccccccggg

SEQ ID NO: 120838 - DNA, 775 bp, Homo sapiens
  misc_feature: GYAE6OF02JL4MM.2.38.D05.1.454.CMB.1.raw
  modified_base (182)..(182): a, c, t, g, unknown or other
  misc_feature (182)..(182): n is a, c, g, or t
  modified_base (303)..(303): a, c, t, g, unknown or other
  misc_feature (303)..(303): n is a, c, g, or t
  modified_base (709)..(709): a, c, t, g, unknown or other
  misc_feature (709)..(709): n is a, c, g, or t
  modified_base (723)..(723): a, c, t, g, unknown or other
  misc_feature (723)..(723): n is a, c, g, or t
tcagacgctcgacacacgaccggtgctcgatttagtatctgatagttgggtttgggggagccccagccctgggattcccgagcgtgtttctgcttgctgatcaggacctggcacactagagaactcaccatgggagtttgggctgagcgtgggttttccttgttgcttaagttttaaaaggngtccgtagtgtgaggtgcagcgttgggtggacggtccgggggaggtcgttagtcaggtccgtcgggggtccctggacgtacctcgtcctgtgacgtcgcctcgtgtacttacctaccttanagttacgtactacgtggactgaccgtacgtacgggcccacaacggtccgtaccggaaggggacgggtcgttaggtcggtacggttccgtaggaccgtttaattaaacggtaggttacggtacggtgggtaacgtaccgaactacggaaccggtacgtacggccgggtacgttccggtaagggaaccggggtccttacgtacccactaccgttcgaaccgtaggtaaccgaacgtaaccgacccgtaaaggaccctacgtcgttagtaacgtccgttaaggaaccctaaggttaactaacggtacgtttcggaagtaaccggtaccggtaacgggtaaccgtaccccggttaagtccccgggtttagtacgttaacgttaccgtaggtaccggaacggtaaggtaanaacgggttaaccgngaaacccggtcgcgttaccgggttacggacccgttaccggtaacctccgggg

SEQ ID NO: 120839 - DNA, 924 bp, Homo sapiens
  misc_feature: GYAE6OF02H4FS1.2.38.D05.1.454.CMB.1.raw
  modified_base (533)..(533): a, c, t, g, unknown or other
  misc_feature (533)..(533): n is a, c, g, or t
tcagacgctcgacacacgaccggtgctcgatttagtatctgatagttgggtttggggggaagaggaagactgacggtcctgccacaggtggtgcgtgggcacgggtgggcactcgacaacaactatttgcgctcaactgtcttgtccagtgtgaggtgcagtcgtgggtgggacggtccggggggagtctttagttcgaggtcccggtcgggggtccctggacgtaccttcctccggtgtcgacgacggtccgttcgtggtaccttacctaccgttcaaggtacgtaccgtaacgttggtagtcggacgttacggttcgggtaccccgaccgaaacggtcccgtaaccggggaacgggggtaacggggttccggttaggggttcggttaccggggtaccttaccggttaaaacgttaagttttaacgtaacgggttcgggtaggtacggggtaagtaccgaccgtaaacgaacggtaccgtacggtaccgggtaacgttccgggtaacggacgggtacctaccgtaccgactntacacgaacgaacgtaaccgaagacccgaaagaaccgtaaccgcgtttagtaacgtaccgtacggaaactaacgtaacgaaaccgttacggtaacgtacgggtaaaaccgggaccgtaaaccggggaaacggtaaaccggttccggggttaacgttacgttaaactttaagggtttaaccgttaccggtaaaggtacggtaaacgggtaaacgtacggtaaaccgggaacgtaccgtaacggggtaacccgggttaagtaccccggggtaacccgtacggttaaccggtacccgggttaaccgggggtaaacccggtaaccggggtaaccccgttccgggtaccgggttaccctcccccgggtttaaccgtaccggtaccccgtaacccgg

SEQ ID NO: 120840 - DNA, 849 bp, Homo sapiens
  misc_feature: GYAE6OF02GYCW5.2.38.D05.1.454.CMB.1.raw
tcagacgctcgacacacgaccggtgctcgatttagtatctgatagttgggtttgggggtgggtccaggaggcagaactctgggtgtctcaccatggcctggatccctctacttctccccctcttcactctctgcacaggctctggacggcctcctatgagctagacacacgcccacccgtcggtcgtctacgtccgtaccccgaggacacggaccggaccaggactaccaccgtgccttacgtcggaagtagtcggactaagttcggaaccaaagactaattacttcgtacgtttaacgttcggtaacctagacgtaacggtaacgacccgacgggtacccgaccgggtcccccgttggttcggtacggttcgggtacggtaaactttaaactaaacggttaaaaacggaccgtaagggttacgggtaaccggaacccgggttccccggtaacgggtaaccggggtacccgttacccggtaggtaacgttccggttaacggttttccgtccggtttcgggtaccccgtacccggtacggttaacccgtaccgggtaaaccggggtaacctaaaccgggtaccgttacccggtaaacggtttaccgaaccccgtagttacggttaccggtacgggtaccgtaaccggaggtacgaaaggacgtaggtaggaccgttacgtacgtacgtttaactaccgtacgtactaacgtcacggaccaaggtccgaacggtagttaggtttaggtttccggtttacgggttcgggttacgggaacggggtaacgtaacgcgggtaccgttaccggccgttacggtacggtacccggtaccgtaccgggacgttcccgg

SEQ ID NO: 120841 - DNA, 954 bp, Homo sapiens
  misc_feature: GYAE6OF02JM0BR.2.38.D05.1.454.CMB.1.raw
  modified_base (132)..(132): a, c, t, g, unknown or other
  misc_feature (132)..(132): n is a, c, g, or t
  modified_base (271)..(271): a, c, t, g, unknown or other
  misc_feature (271)..(271): n is a, c, g, or t
  modified_base (345)..(345): a, c, t, g, unknown or other
  misc_feature (345)..(345): n is a, c, g, or t
tcagacgctcgacacacgaccggtgctcgatttagtatctgatagttgggtttgggggtgggtccaggaggcagaactctgggtgtctcaccatggcctggatccctctacttctccccctcttcactctcngcacaggctctgacggcctcctatgagctgacacacgcccacccgtcggtgtcagtccgtcccccgaggaccaggtacccggccaaggactccaccctgccttcgtaggagtattgcattcgaaccaaagcaaattagntcttattcggtacagacgagacgcgacggacccaccggtccccgtgtacgtcgttaggtagtaataagttaaanaaacggactaacgggaggaacggtacccggtccctaaccggacggtaccgttaccctaggaacgtaccgttaccgtttcaccgttacgccgttaccgacgtccgtaaccggaacggtaacccgaaacggtaccgtttaaccgaaccggtttaccgtaacccgtaacgttaccggttaaagggtacgggtacccggttaaccgggaacggaaccgtaaaacgggtaagaccggttaagggtaaccgttaacgttacggttaaactttaaccggtttaacgtttacggttaaacccggtaaacgttacgtaaccgaaacggaacccgggtaaaccgtaaaccggtttcccgggtttaaaacggggttttaccgggggtttttttttaacggggggttttcccgggggttttaacccgggggttaaacccggggggttacccccgggggttaaaacggggggttaaacccccgggttacgggggtaacccccggttttttaacccggggtaacccccgggttttaccccggggttaaaacccggtttaacccccccgggggtaaaggtttaacccccccccggggggttacggtttaacccccccccggggg

SEQ ID NO: 120842 - DNA, 716 bp, Homo sapiens
  misc_feature: GYAE6OF02GHGXA.2.38.D05.1.454.CMB.1.raw
  modified_base (85)..(85): a, c, t, g, unknown or other
  misc_feature (85)..(85): n is a, c, g, or t
  modified_base (137)..(137): a, c, t, g, unknown or other
  misc_feature (137)..(137): n is a, c, g, or t
  modified_base (143)..(143): a, c, t, g, unknown or other
  misc_feature (143)..(143): n is a, c, g, or t
  modified_base (405)..(405): a, c, t, g, unknown or other
  misc_feature (405)..(405): n is a, c, g, or t
  modified_base (531)..(531): a, c, t, g, unknown or other
  misc_feature (531)..(531): n is a, c, g, or t
  modified_base (558)..(558): a, c, t, g, unknown or other
  misc_feature (558)..(558): n is a, c, g, or t
  modified_base (585)..(585): a, c, t, g, unknown or other
  misc_feature (585)..(585): n is a, c, g, or t
  modified_base (634)..(634): a, c, t, g, unknown or other
  misc_feature (634)..(634): n is a, c, g, or t
tcagacgctcgacacacgaccggtgctcgatttagtatctgatagttgggtttgggggtgggtccaggaggcagaactctgggtntctcaccatggcctggatccctctacttctccccctcttcactctctagcanaggctntgacgcctctatgagactgaacacacgcccaccgttcggtcgtacaggtaccgtaccccgaggacgacggaccggccgaaggactccaaccgtctcgtacgttaggacgtactacactagttaccgaactaaaacgaccttaaaagtgttaacgttctttaacgttacggaccaggaacgtaacgacgaccggcggacctaccggtccgtggtcgtacgtaggtactaatagttaaagaaacgagtaaggtgaacggttccnccgaacggtacggtaccttacggagaacggctttaactcgttacgtccgtacctcgagtaccgacggaaaccgtaactacgtacgtacgtagtaccgaacgtctggaacgtcgagtacgacggtanaagagttagacgagtacgtagtacttntacgtaagctagcctagacaacgtacngttaacggtacggtttttggtttaacccggtttggtttacgggaacggnggggtaaacccgtacgtaacggtccgttaaccgtaacggtttccgaaccggttccgaacccggtaggacccccggttaaccg

SEQ ID NO: 120843 - DNA, 843 bp, Homo sapiens
  misc_feature: GYAE6OF02H2MX3.2.38.D05.1.454.CMB.1.raw
tcagacgctcgacacacgaccggtgctcgatttagtatctgatagttgggtttgggggaagaggaagactgacggtctgccacaggtggtgcgtgggcacggtgggcaccgtcgacaacaactatttgcgctcaactgtcttgtccagtgtgaggtgcagcgtggtggaggtccgggggagtacgtttagttcgacgtccggttcgggggtccctaggacgtaccgttccgttccgtaggtcgcgacgtcccgtcgttgggtaccttccttaccgtttcgtaacggttaacgtccgttacgttaggtacgtcgtaccgtacgggttaccgggtcccgaccgttaaacggcccgtaccgggaagggggtacgggtcggttgggttacgggtcgggttctacgtaaccgttaaagttttacgtagggttacggtaagggttcgggtaacgttacgaccgtaaacggtacgtaccgtaccgggtacggtacccgttccgggtaagggaaccggggtccttaacgtcccgaaccgtacgttccctaacggaacggtaaccgaaccgtaaacgtaacccgtaaaacgaaccggtcgtaaccttaggttacttacgaacgtaaaccgtaaagaccgtaacgtcggttacgacggaaacggacggaaccggacggtaaccggtagttcgtacgttaacgttacttacggaacgtagaccggttaaagagtaactcgccgaagtccgaacgtttccgacggtaccgtccggtaaacggcgggttaccgggaaccgtaccggtaaccgttccgaccgttaccgtaccgtactacccgacccggttaaccccg

SEQ ID NO: 120844 - DNA, 718 bp, Homo sapiens
  misc_feature: GYAE6OF02GSYTF.2.38.D05.1.454.CMB.1.raw
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcagctgggtggaggtccgggggaggcttagttcagccgtcgggggtccctgagactcctcctgtgcacgtcctcgtggtacttccgacctttcgacgtacgtcttacgtaggtagtgcctacggtcgggtacccgaccgtaagccgtaccggaaggggaacgggtcgtgggtggtgggtctacgtacgttaattaagtacgtagaggtgggtaagtacgacaacgaacgtccgtacggacgtacgtccggtaagggacggtaccgtataccaaccgtctacgtaccaaggaacgaaaccgaaccgaaccaaacgaaccgaaccgtgttaacgtactacgtacaaacgtaaagtaacgaaacgtacgtacgaggtaaggaccgaccggaacgaccgacgtacgtgttacgttacgttacgtagagaacgtagtaacgaagtcgacgacgtaacgcgttacggacgtaccgtaccggttaacggaccggtaccggggaccggtaaccggaccgtaccggttaccccggtacccgtaccggttacccgtaccgtacccgtaacccccg

SEQ ID NO: 120845 - DNA, 668 bp, Homo sapiens
  misc_feature: GYAE6OF02HKYDL.2.38.D05.1.454.CMB.1.raw
  modified_base (155)..(155): a, c, t, g, unknown or other
  misc_feature (155)..(155): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (567)..(567): a, c, t, g, unknown or other
  misc_feature (567)..(567): n is a, c, g, or t
  modified_base (575)..(575): a, c, t, g, unknown or other
  misc_feature (575)..(575): n is a, c, g, or t
  modified_base (580)..(580): a, c, t, g, unknown or other
  misc_feature (580)..(580): n is a, c, g, or t
  modified_base (584)..(584): a, c, t, g, unknown or other
  misc_feature (584)..(584): n is a, c, g, or t
tcagacgctcgacacacgaccggtgctcgatttagtatctgatagttgggtttgggggaagaggaagactgacggtcctgccacaggtggtgctgggcacggtgggcactcgacacaacatttgcgctcaactgtcttgtccagtgtgaggtgcngctggtggagtccgggggagcttagttcagccgtgggggtccctggagactctcctgtgcncgcctntggtacttcaccttcagtacgtctacgtggattcgactacggtcgggtcccaccgtacgtcgtaccggagggggtaaggggccgttgggttggtcggggtctacgtacgttaatttaagtaggttaggagttgggaggtagccgaacgtagtacgtaccggcggtaaccgtcccgggttaggaacgggtctaaccgttaccacctattcctaccgtaacggacgaaccgaacccggaccaaaggaacctacggcttagtctcacggaataaacgtacgtaactggtacgtacgacggacgaccggacgacgacgtgttgtacttattacgtgtacgtacgagtanaagtcganacggnacgngtacggacgtaccgaacgtaccgggacgggtcccaacggggtaccctcgggtaacctccgttacctccgtacgtcccgtacccg

SEQ ID NO: 120846 - DNA, 520 bp, Homo sapiens
  misc_feature: GYAE6OF01DEUGH.41.2.A02.1.454.CMB.1.raw
  modified_base (481)..(481): a, c, t, g, unknown or other
  misc_feature (481)..(481): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggccctggacagggacttgagtggatgggatggatcaaacctagagtggtgacacagcctctgcacagacggttccgagggcaggggtcaccgagtgaggtggtgacgcggccacgagcgacggtcacgagtggaaccttaccagttcagaagtcagacggacacggtccgtttacttcgtgtgcggcgaccccgngtaggggaccgggggcctacggtccggtgtaggtaccgg

SEQ ID NO: 120847 - DNA, 526 bp, Homo sapiens
  misc_feature: GYAE6OF01CA0FG.41.2.A02.1.454.CMB.1.raw
  modified_base (485)..(485): a, c, t, g, unknown or other
  misc_feature (485)..(485): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaaccctaagagtggtgacacagcctctgcacagaggttccgagggcagggtcaccgatgagtggtgacgacggccacgacgcgacggtccaacgagtacggaacttaccgagtctagaagtcgtgaggacacggtccgtttactcgtgtgcggcgaccccgngtacgggaaccgggggcctacgtacggtcgtaggtaccggg

SEQ ID NO: 120848 - DNA, 525 bp, Homo sapiens
  misc_feature: GYAE6OF01CFQN4.41.2.A02.1.454.CMB.1.raw
  modified_base (351)..(351): a, c, t, g, unknown or other
  misc_feature (351)..(351): n is a, c, g, or t
  modified_base (481)..(481): a, c, t, g, unknown or other
  misc_feature (481)..(481): n is a, c, g, or t
tcagtctatactatcacgaccggtgctcgatttagactcatctacagggggagcatcacccagcaacctacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtagcgacaggcccctggacagggacttgagtggatgggatggatcgaacctaagagtggtgacacagcctcngcacgagacggttcgagggcaggggtcaccgatgagtggtgacacggcacgagcacggtcacactagaacttaccagtctagaagtctagaggacgaccggtccgtttactcgtgtcgcgacgaccccgngtcggggaaccggggggtctaccgtacgggtcctaggtaccggg

SEQ ID NO: 120849 - DNA, 539 bp, Homo sapiens
  misc_feature: GYAE6OF01CE1XM.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaacctagagtggtgacacagcctctgcacgagacggttccgagggcgagggtcaacgagtgagtgggtagacgacggccacgagccgacggtccaacgatacggaacttaccgagtctagaacgtcgtagaggaccgacggtaccgtttacgttcgtggtcgacggacgaccccgcgtacgggacgggggacctacggtacggtcgtaggtaccgg

SEQ ID NO: 120850 - DNA, 527 bp, Homo sapiens
  misc_feature: GYAE6OF01CXD6A.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtgggcctcagtgaagctctcctgacaagacttcgtggatacgaggttcaacgtacttctatatacacgtggtgcgacacggcccctggacagggtacttgagtggagtgggatggatacgaaaccgtaagagtggtagacacagcctactgcaacagacggttccgagggcgagggtcaccagtgagtggtgacgcggccacgagcgacggtacacagtacgaacttaccgagtcagaagtctgaggacacggtccgttactcgtgtgcgacgaccccgtgacgggaccgggggactacgtcggtcgtagtaccgg

SEQ ID NO: 120851 - DNA, 521 bp, Homo sapiens
  misc_feature: GYAE6OF01CJZXG.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcgaacctaagagtggtgacacagcctctgcacagtacggttccgagggcagggtcaccagtgagtggtgacacggccacgagcacggtccacagtggaacttaccgagtctgaagtctaggaggacgacggtccgtttacttcgtgtgcggacgccccgcgtcgggaacgggggcctacgtacggtcgtacggtaccggg

SEQ ID NO: 120852 - DNA, 508 bp, Homo sapiens
  misc_feature: GYAE6OF01DS64D.41.2.A02.1.454.CMB.1.raw
  modified_base (348)..(348): a, c, t, g, unknown or other
  misc_feature (348)..(348): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctntgcacagaggttccagggcagggtcaccgatgagtggtgacgacggccacgagcacggtccacatggaacttaccgagtctgagtgtgaggacacggtccgtttacttcgtgtgcgngaccccgngtcgggacgggggcctacgtacggtgtggtaccgg

SEQ ID NO: 120853 - DNA, 502 bp, Homo sapiens
  misc_feature: GYAE6OF01ES9R8.41.2.A02.1.454.CMB.1.raw
  modified_base (410)..(410): a, c, t, g, unknown or other
  misc_feature (410)..(410): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctagagtggtgacacagcctctgcacagaggttccagggcagggtcaccatgagtggtgacacggccacgagcacggtccacanggaacttaccagtctgaagtctgaggacacggccgttacttctgtgcgagacccgcgtcggacggggggcctacgtacggtcgtggtaccgg

SEQ ID NO: 120854 - DNA, 517 bp, Homo sapiens
  misc_feature: GYAE6OF01DYHL0.41.2.A02.1.454.CMB.1.raw
  modified_base (481)..(481): a, c, t, g, unknown or other
  misc_feature (481)..(481): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagacggttccagggcagggtcaccgatgagtggtgacgacggccacgagcacggtccacgataggaacttaccgagtctagaagtctggaggaccacggtccgtttacttcgtgtgcgacgaccccgngtacgggacgggggcctacgtacggtcgtgtaccgg

SEQ ID NO: 120855 - DNA, 509 bp, Homo sapiens
  misc_feature: GYAE6OF01DKRXS.41.2.A02.1.454.CMB.1.raw
  modified_base (464)..(464): a, c, t, g, unknown or other
  misc_feature (464)..(464): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactggtgcgacaggcccctggacagggacttgagtggatgggatggatcaaccctaagacgtggtgacacagcctctgcacagaggttccagggcagggtcaccatgagtggtgacacggccgacgagcacggtccacagtcggaacttaccagtctgaacgtctgaggacacggccgtttatctgtgcggngaccccgctacgggacgggggacctacgtacggtcgtaggtacgg

SEQ ID NO: 120856 - DNA, 519 bp, Homo sapiens
  misc_feature: GYAE6OF01ER4Y6.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaacctaagagtggtgacacagcctctgcacagaggttccagggcagggtcaccgatgagtggtgacacggccacgagcgacggtccacgatcggaacttaccgagtctagaagtctaggaggacaccggtccgtttacgttcgtgtgcgcgaccccgcgcgggtaccgggggcctacggtacggtcgtggtaccggg

SEQ ID NO: 120857 - DNA, 509 bp, Homo sapiens
  misc_feature: GYAE6OF01EMLVJ.41.2.A02.1.454.CMB.1.raw
  modified_base (471)..(471): a, c, t, g, unknown or other
  misc_feature (471)..(471): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccatgagtggtgacgacggccacgagcacggtccacatggaacttacagtctgaagtctgaggacacggtccgttacttcgtgttgcgacgacccgngtcgggaacggggggcctacgtcggtcgtaggtaccgg

SEQ ID NO: 120858 - DNA, 712 bp, Homo sapiens
  misc_feature: GYAE6OF01CSM56.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctgaggtgaggaagccgtggggcctcgagtgaagctctcctgcaagtacttcgtggatacgtaggttacaacgtacttactatactactaacgtgggtgcgtacgacggccccgtaggacagggacttggagtggagtgggagtaggataccgaaaccgtaaggacgtggtacgacacgacgtcctcgtacgcaacgaggtacggttccgagggcgtacgggtaccaccgagttgtaacggtgggtacgaaccgtaccgggaccgaacggacggaccgaacccggttaccgaaccgtaacggttaccgggtaaaccgtttaacccggtaacggttaccgtacggtaaacggttaccgtacggaacgggtaacccgtaaccgggttaccccggttttaacgttccggttacgggtaccggaccggtacccgggaacccccgggtcgggtacggggggtaaacccggggggtacccttaaccgggttaacccgggtcggtaacgggttaaccccgggg

SEQ ID NO: 120859 - DNA, 568 bp, Homo sapiens
  misc_feature: GYAE6OF01DH8JQ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgacttctatatacacgtgggtgcgacacggcccctggacagggacttgaggtggagtgggatggatacaaacccgtaagagtggtgacacacgcctctgcacagaggttccagggcagggtcaccgatgaggtggtgacacggccacgagccgacggtccacagtacggaaccttaccgagttctaggaacgttcgtaggacggaccgtacgggtcccgttttacgttcgtggtacggccggaccggaccccggtcggtacgggggaccgggggtaccctacggttaccggtcgtacggtacccggg

SEQ ID NO: 120860 - DNA, 488 bp, Homo sapiens
  misc_feature: GYAE6OF01CSVJE.41.2.A02.1.454.CMB.1.raw
tcagtctatactatcacgaccggtgctcgatttagactcatctacagggggagtcagtctcagtcaggacacagcatgcacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggaactctttaaattggtatcagcagaggccaggaaagcccctcaactcctgatctatgctgcgtccattttgcaaagtggggtcccatcaaggttcagtggcagtggatcgtgggacagatttcactctcaccatcagcagtctgcaacctgaagatttcgcagcttatattattctacagagtagtacgataatcctccgtactacttaccggtcggacggtacggacttagtggtagatacaagaacgtgtggtcg

SEQ ID NO: 120861 - DNA, 641 bp, Homo sapiens
  misc_feature: GYAE6OF01DAN13.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttatatatacacgtggtgcgacaggcccctggacagggacttggagtggagtgggataggataccaaacccgtaaggacggttgggtagaaccacacgcccttcgtgaccaacgaggtacgggttaccgaaggggccgtaaggggtccaaccgtagttcggaagggttgggtacgaaccgaccgggacccgaacggacgaccgaaccgggtcccaacgtacgtacggtaaccttaccgagttcgtaggaacgttcgtaggaaggacccgtacgggtccgttttaacttcgttacggtacggacggtaccggacccccggtcggtacgggggaaccggggggtaccctaccggttaaccgggtcgtaacgggtacccggg

SEQ ID NO: 120862 - DNA, 590 bp, Homo sapiens
  misc_feature: GYAE6OF01ELUS5.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgacttctatatacactggtgcgacacggcccctggacagggacttgagtggagtgggatggatacaaaccgtaagagtggtagacacagcctctgacacgagacggttccgacgggacgagggtacacgagtgagtggtagaccgacggaccgacgacgacgacggaccacgagtacggaacttaccgagtactagaacgtcgtaggacggacgtaaccgggtacccgtttaacgttcgttcggtagtaccggaccggtacccccggacggtacggggtaacccggggggtacccgttaacggtaccgggttacgtaacggtacccggg

SEQ ID NO: 120863 - DNA, 549 bp, Homo sapiens
  misc_feature: GYAE6OF01BLUWO.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggactcgaacctaagagtggtgacacagcctctgacacgagacggttccgagggcgagggtacaccgagtggaggtggtagacgacggaccgacgagccgacggtccacgagtacggtaacttaccgagtcgtagaacgtcgtagacggaccgtacggtccgtttacgttcgtgtgcggacgaccccgtggtacgggaaccgggggtcctacggtcggtcgtaggtaccggg

SEQ ID NO: 120864 - DNA, 509 bp, Homo sapiens
  misc_feature: GYAE6OF01EQNC3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcacatgagtggtgacgacggccacgagcacggtccacagtggaacttaccgagtctgaagtctagagacacggtccgtttacttcgtgtgcgacgaccccgcgtcgggacgggggctacgtcggtcgtaggtaccgg

SEQ ID NO: 120865 - DNA, 509 bp, Homo sapiens
  misc_feature: GYAE6OF01B576T.41.2.A02.1.454.CMB.1.raw
  modified_base (473)..(473): a, c, t, g, unknown or other
  misc_feature (473)..(473): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaacctaagagtggtgacacagcctctgcacagaggttccgagggcagggtcaccgatgagtggtgacgacggccacgagcgacggtccacatggaacttaccagtctgaagtctagaggacacggccgtttactcgtgtgcgcgaccccgngtcgggaacgggggcctagtacggtcgtagtaccgg

SEQ ID NO: 120866 - DNA, 527 bp, Homo sapiens
  misc_feature: GYAE6OF01EK3D4.41.2.A02.1.454.CMB.1.raw
  modified_base (331)..(331): a, c, t, g, unknown or other
  misc_feature (331)..(331): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaacctaagngtggtgacacagcctctgcacagaggttccgagggcagggtcacgatgagtggtgacgacggccacgagcgacggtccacagtacggaacttaccgagtctagaacgtctacgaggacgacggtccgtttacgttcgtggtgcggacgaccccgcgtacgggaacgggggccctacgtaccggtcgtaggtaccgg

SEQ ID NO: 120867 - DNA, 515 bp, Homo sapiens
  misc_feature: GYAE6OF01EW4BN.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcgaaacctaagagtggtagacacagcctctgcacagagttccagggcgagggtcaccatgagtggtgacacggccacgagcacggtccacataggaactaccagtctgaagtctgagacgacggtccgttacgttcgtgtgcgacgaccccgcgtacgggaaccggggggctacgtacggtcgtaggtacccgg

SEQ ID NO: 120868 - DNA, 504 bp, Homo sapiens
  misc_feature: GYAE6OF01C5R4P.41.2.A02.1.454.CMB.1.raw
  modified_base (460)..(460): a, c, t, g, unknown or other
  misc_feature (460)..(460): n is a, c, g, or t
tcagtctatactatcacgaccggtgctcgatttagactcatctacagggggagcatcacccagcaaccacatctgtcctctagagagtcccctgagagctccgttcctcaccatggactggacctggagtatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccatgagtggtgacacggccacgagcacggtccacatggaacttaccagtctgaagtctgagacacggccgtttactcgtgtgcgngaccccgcgtcggaacggggggctacgtacggtcgtagtaccgg

SEQ ID NO: 120869 - DNA, 518 bp, Homo sapiens
  misc_feature: GYAE6OF01CEHG9.41.2.A02.1.454.CMB.1.raw
  modified_base (349)..(349): a, c, t, g, unknown or other
  misc_feature (349)..(349): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagccctntgcacagaggttccgagggcgagggtcacagtgagtggtgacgacggccacgagcacggtccacatcggaacttacgagtctagaagtcgtagaggacacggtccgtttacttcgtgtgcgcggaccccgcgtcgggaccgggggcctacgtacggtcgtaggtaccgg

SEQ ID NO: 120870 - DNA, 596 bp, Homo sapiens
  misc_feature: GYAE6OF01BGULE.41.2.A02.1.454.CMB.1.raw
  modified_base (342)..(342): a, c, t, g, unknown or other
  misc_feature (342)..(342): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacacggcccctggacagggactgagtggatgggatggatcaacctaagagtggtgacacngcctctgcacagacggttccgagggtcagggtcaccgagtgagtggtgacgaccggccacgagccgacggtccacgacgtcggaacttaccgagtactagtaacgtcgtaggacggtaccgtaccgggttaccgttttaaccgttcgttcggttaggccggtaaccggtacccccgggtaccggtacggggggtaacccggggggggtaccccgttaaccggttaccgggttccggttaacgggtaacccgggg

SEQ ID NO: 120871 - DNA, 634 bp, Homo sapiens
  misc_feature: GYAE6OF01D2DJJ.41.2.A02.1.454.CMB.1.raw
  modified_base (574)..(574): a, c, t, g, unknown or other
  misc_feature (574)..(574): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagccgtggggcctcgagtgaagctctcctgcaagacttctggatacgaggttcaacgtacttctatatacacgtgggtgcgacgacggcccctggaccagggtacttgagtggtagtgggatggactacaaccgtaagagtggtcgaacacgacgtcctcgtgccaacgaggtaggttaccgagggtcgacgggtcaaccgtagtcggacgtggtacgtaaccgaccggtaccgacggacgtccgaaccggttccgaacgtacgtacgggtaaccttaccgaacgttacgtacggtaacgttcgtacggacggtaccgtaccggtacccgtttacgttccgttcggtacgtaccggacgtacccccggnggttaccggggtaaccgggggtacccttaaccggtaaccgggttcgtacgggtacccggg

SEQ ID NO: 120872 - DNA, 514 bp, Homo sapiens
  misc_feature: GYAE6OF01BEZ5C.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacgagcctctgcacagaggttccgagggcgagggtcaccgatgagtggtgacgacggccacgagcacggtccacagtcgaacttaccagtctgaagtcgtgaggacacggtccgttacgttcgtgtgcgacgcccgcgtacgggacgggggcctacgtacggtcgtgtaccggg

SEQ ID NO: 120873 - DNA, 690 bp, Homo sapiens
  misc_feature: GYAE6OF01BLEQF.41.2.A02.1.454.CMB.1.raw
tcagtctatactatcacgaccggtgctcgatttagactcatctacagggggagcatcacccagcaaccacatctgtcctctagagagtcccctgagagcctccgttcctccaccagtggactcggaccgtggaggactccttctttcgttgggtggcagcacgccacgaggacgccccactctcgagggtcgcagtctgagtgctagtcggtggggctggagggtaggaaggaacgtccggtcggggcctacgaggtaggaacgtccttcctccgtcgacgaacgtacctttcgtaggactacgtaggttaccaacgtacttactatactactacgtgggtcgcgacgaccggcccgtaggacgacgggtacttggaggtggagtgggagtggactaccaaaccgtaaggtacggtggtacgaacacgacgtcctgtcgaccagaggtacggttaccggacgggcgtacgggtccaaccgtagtaggtaggtggtacggaaccgaccggaccgacggacgaccgaccggtaccaacgtagtacgtaaccttaccgagtcgtagtacgtcgtacggaacggaccgtacggttaccgtttacgtttcgtcggtacgaccggtacccggaccccgtcgggtacgggggacccgggggtaccttaccgggtaccgggtcgtacggtacccgggg

SEQ ID NO: 120874 - DNA, 514 bp, Homo sapiens
  misc_feature: GYAE6OF01DRB0W.41.2.A02.1.454.CMB.1.raw
  modified_base (480)..(480): a, c, t, g, unknown or other
  misc_feature (480)..(480): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagagttccgagggcagggtcaccatgagtggtgacgacggccacgagcgacggtccacgagtggaaccttaccgagtcctagaagtctaggaggacacggtccgtttacttcgtgtgtgcgacccgntacgggacgggggctacgtcggtgtaggtaccgg

SEQ ID NO: 120875 - DNA, 651 bp, Homo sapiens
  misc_feature: GYAE6OF01DUD1Z.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcgtggggcctcgagtgaagctcgtcctgcaagtacttcgtaggatacgtaggttacaacgtacttctatactacgacgtgggtacgtcgacgacggccccgtaggacgagggtacttggaggtggagtgggaatcggaataccgaaacccgtaagaggtaggtacgaacacgacgtacctcgtacgaccaacgacggtacggttaccggagggtacgtacggggtaccaccgtagtcggaggtcggtagaccgacggaccgacgacgccgtaccggacaacgagtacggtaaccttacgagttaccgtagtaacgtcgtacggaacggaccgtacggttcccgtttaacttcgtacggtcgaccggtacccgtaccccggtacggtaccgggggtaaccgggggtcccttaaccggtaccgggttacgtacgggtacccgggg

SEQ ID NO: 120876 - DNA, 526 bp, Homo sapiens
  misc_feature: GYAE6OF01AY0EB.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagcctggggcctcagtgaagctctcctgcaagacttctggatacaggttcaacgacttctatatacactgggtgcgacaggcccctggacagggacttgagtggatggatggatcaacctagagtggtgacacagcctctgcacgagacggttccgagggcgagggtccaccatgagtggtgacgaccggcacgagcgacggtccacagtggaactccgagtcgtgaacgtctagacggacgtacggtcccgtttactcgtcgtggcgtacgaccccggcgtacgggaccgggggtcctacggtacggtcgtagtacccggg

SEQ ID NO: 120877 - DNA, 510 bp, Homo sapiens
  misc_feature: GYAE6OF01D3Z9K.41.2.A02.1.454.CMB.1.raw
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (471)..(471): a, c, t, g, unknown or other
  misc_feature (471)..(471): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacaggttcaacgacttctatatacactgggtgcgacaggcccctggacagggacttgagtggatgggatggatcaacctaagagtggtgacacagcctntgcacagngtcaggcagggtcaccatgagtggtgacacggccacgagcgacggtccacagtgaacttaccagtctgaagtctagacggactacggccgtttacttcgtgtgcgtcgaccccgngacgggaacgggggtcctacgtacggtcgtaggtaccgg

SEQ ID NO: 120878 - DNA, 711 bp, Homo sapiens
  misc_feature: GYAE6OF01BHB5D.41.2.A02.1.454.CMB.1.raw
  modified_base (278)..(278): a, c, t, g, unknown or other
  misc_feature (278)..(278): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagctggggcctcagtgaagctctcctgcaagacttctggatacaggttcaacgacttctatatacacgtgggtncgacacggccctggacagggacttggagtggatgggactggactacaaacccgtaagaggtggtacgaacgacagccctcgtcgaccagacggtacggttaccgagggccgacggggtacaacccgtagtggaggttaggtacggaaccgaccgggacccgtaaccggacggacccgtaaccgggtacccgaaccgtaacgtaccgggtaaacctttaacccggtaacggttaccgttaacggtaacggttacccgtagggtaacgggtaaacccgtaccggggttaccccggtttttaaccgtttaccgtcgggttaccgggacccgggtaaccgggtaaccccccgggtcgggtaaccggggggtaacccgggggggttaccccttaaaccggggttacccgggttaccgttaaaccgggttaccccgggg

SEQ ID NO: 120879 - DNA, 749 bp, Homo sapiens
  misc_feature: GYAE6OF01B4GXF.41.2.A02.1.454.CMB.1.raw
tcagtctatactatcacgaccggtgctcgatttagactcatctacagggggaggcatctacccagtcaaccacatctgttcctctagagagtcccctggagagctccgttacctcaccctatgggactggaccgtggacggagtccgtcttctttggtggcagcagcccacaggacgccccactcctcaggttcgcgagcgtcggactcgctagtccgtggggcctaggaggttggacggaacggccgtcggggtccctacgaaggttaggaaagtcgtacctacctagtactaaggtactttcgtacggtatacgaggttacaaccgtacgttactatactaccacgtgggtcgcgacgacggtccctagggtacgtacgggtacgttcgggacggttcgggacgtggggactgggtactacgaaccgtaaggaggtggtacgaccgaacgacgtaccctacgtagtaccaacgaaggtaacgttacccggaagggtacgacgggtaccgacgtagtaggtaggtaggttacggtacggtaccggtaccgacggacgacgtaccggtaccaacgtacgtaaccgtaacctacccgtacgttaccgtaggtaccgtacggtacggaacggtaaccggtaccggtaccgtttaaccgttacggtaggtaccgacggtacccggaccccgtagggtacccggggtaaccggggtacccttaaccggttaccgggttcgtacgggtacccgg

SEQ ID NO: 120880 - DNA, 602 bp, Homo sapiens
  misc_feature: GYAE6OF01DSTEI.41.2.A02.1.454.CMB.1.raw
  modified_base (590)..(590): a, c, t, g, unknown or other
  misc_feature (590)..(590): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagctggggcctcagtgaagctctcctgcaagacttcgtaggatacgaggttcaacgtacttctatatacacgtgggtgcgacgacggcccctggacgagggacttggagtggagtgggagtggatcgaaacccgtaagagtaggtgaacacgagtcctctgctaacgaggacgggttccgacggggcgacggggtaccaccgtagtacggaggtcggtacgaccggacggaccgtacggacgacgacccggtaccaacaacgttcggaaaccttaccgagttacgtagtaacgttcgtacggaacggtaccgtacgggttccgtttaacgttcgtcgtagcggaccgtacccggcggtacggggaccgggggtctaacggtcggtntcgggtaccggg

SEQ ID NO: 120881 - DNA, 626 bp, Homo sapiens
  misc_feature: GYAE6OF01BG1M3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtctggggctggaggtgaggaagccgtggggcctcgagtgagctctcctgcaagacttcgtggatacgtaggttcaacgtacttactatatacacgtgggtcgcgacacggccctggacagggacttgagtggagtgggatggactacgaaaccgtaggacggtggtacgaacacgagccctagtcgacgaacgaggtaacggttccgagggtaccgacgggttaccgaccgtagtaggtacgggtaggtacggacgaccggaccgaacgacggaccgacggtaccacgtaacgtaccggtaacttaccgacgttacgtacgtaacgtcgtaggacgtacgtaccggttacctttacgttcgtcggtacggtaccggaccggaccccgtaggtaccggggtaccgggggtacctacggtacggtcgtacggtacccggg

SEQ ID NO: 120882 - DNA, 564 bp, Homo sapiens
  misc_feature: GYAE6OF01C397Y.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacacgtgggtgcgacacggcccctggacagggacttgagtggagtgggatggatacaacctaagagtggtgacacacgcctctgcacgagacggttccgagggcgagggtcacgatggagtggtgacgacggccgacgacgcgacggtaccacgagtacggtaacttaccagtcgtagtaacgtactaggacggaccgtacggtaccgtttacgttcgtcggtgacggaccgaccccggtacgtacggggaaccgggggggtacccttacggtaccggtccgtaggtacccggg

SEQ ID NO: 120883 - DNA, 583 bp, Homo sapiens
  misc_feature: GYAE6OF01ENU3D.41.2.A02.1.454.CMB.1.raw
  modified_base (270)..(270): a, c, t, g, unknown or other
  misc_feature (270)..(270): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagccccactctcaggtgcagctgatgcagtctggggctgaggtgaggagcctggggcctcagtgaagctctcctgcaagacttctggatacaggttcaacgacttctatanaactactggtgcgacacggcccgactgggactagggacttggagtgggatgggatggaactagaacccgtaaggagtaggtcgacgacctagcctctagcaacgtcagggttcccaaggggcaacgggtcaccgaagtggagtacggtacggaccacggccacgacggccaacggtccacgaattacggaacgttacctagtactgaagtacgtacgacggacctacggtccgttacgttcgtcggtaggcccggacggaccccggaccgggtacggtaaccgggggacccgtaccgttacgggtcgtacggg

SEQ ID NO: 120884 - DNA, 931 bp, Homo sapiens
  misc_feature: GYAE6OF01D2KDD.41.2.A02.1.454.CMB.1.raw
tcagtctatactatcacgaccggtgctcgatttagactcatctacagggggagcatcacccagcaaccacatctgtcctctagtagagtcccctgagagctccgttcctcaccatggactggacctggaggatcctcttcttggtggcagtcagccacaggtagcccactctcaggtgcgagctgatgcagtcgtgggctgaggtgaggagccgtgggcctcgagtgaacgctctcctgacaagtacttcgtaggtactacgtaggttacaacgtacttactatactacgtacgtgggtacgacggaccgaccgggccccgtagggaaccggtaaggggtaccgtttagggaacggttaggggtaacgttaggggtaacgttacgggtaaacgttaacccgtaaaaaccccggtttaaagggacgggttttacgggtaccgaaaccgtaaccggtaaccggttaccccgttacgttacggaacccgtaaacgtaacggggtaaccggggtttacccggaacggggtaccggttaaccggggggttacctaaaacccggtacggttaacggggtaacgggttcggggtaaaccgtaacccgggtaacccggggacccgtaaccgggaccggtacccggtaaaccccgggtacccaaacggtaacggttacccggttaaaacccgtttacccggaacggtttaccggttaaacgggtaaacggtttacccggtacgggtaaaccgggtacccggttaacccggggtttacccgttttaaaccgtttcccggggttacggttacgggaaccccgggttaaccgggtaccccccggtagggggtttaacccggggggtaaacccgggggggtttaccccttaaaccggggttttaacccggggttacggtttaaccggggttaaaccccgggggg

SEQ ID NO: 120885 - DNA, 597 bp, Homo sapiens
  misc_feature: GYAE6OF01DR9ZA.41.2.A02.1.454.CMB.1.raw
  modified_base (291)..(291): a, c, t, g, unknown or other
  misc_feature (291)..(291): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcgaggtgcagctgatgcagtcgtgggctgaggtgaggaagcgtggggcctcgagtgagctctcctgacaagacttcgtggatactaggttacaacgtacttctatatacacgtggtgcgacncggccctggacgagggtactgagtggagtgggatggactcgaaacctaaggagtggtacgacacgacgtcctctaggccaagacggtacgttccgagggacgacgggtaccaccgtagtggaggtcggtagaccgacggaccgacgacgaccgacggtaccaacgtagtacggaaccttacgacgttactaggacgtcgtaggaacggtacggtaccggttccgttaacttcggtacgtcggacgtacccggcccgtaggtacggggaccgggggtccttaaccgggtcggtcgtaggtacccggg

SEQ ID NO: 120886 - DNA, 580 bp, Homo sapiens
  misc_feature: GYAE6OF01CDZPL.41.2.A02.1.454.CMB.1.raw
  modified_base (286)..(286): a, c, t, g, unknown or other
  misc_feature (286)..(286): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggcctcgagtgaagctctcctgcaagacttcgtggatacaggttacaacgtacttctatatacacgtgggtncgacgacggcccctggacgagggacttggagtggagtgggatggactacgaaaccgtaggagtggtagacacncgcctcgngacacgaggtacggttccgagggacgacgggtcaccgagtagaggtggtacgacgacggccgacgacggccgacggtaccaacgacgtacggaaccttacgacgttcgtaggtaacgtcgtaggacggaccgtacggtccgtttactcgtcgtcgcggtacgccccggtgtacggggaaccggggtacctaggtaccgtcgtacggtaccggg

SEQ ID NO: 120887 - DNA, 526 bp, Homo sapiens
  misc_feature: GYAE6OF01EFWPU.41.2.A02.1.454.CMB.1.raw
  modified_base (493)..(493): a, c, t, g, unknown or other
  misc_feature (493)..(493): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacggacttctatatacactgggtgcgacacggccctggacagggacttgagtggagtgggatggatcgaaccgtaagagtggtgacacgagcctcgtgcacgagacggttccgagggcgagggtcaccgagtgagtggtgacgacggccgacgagccgacggtccacagtacggaacttaccgagtctagagtcgtagacgacgtacggtccgtttactcgtgtgcgacgacccgngacgggacggggcctaggtcgtcgtggtaccgg

SEQ ID NO: 120888 - DNA, 653 bp, Homo sapiens
  misc_feature: GYAE6OF01BL7RH.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagacttcgtggatacaggttcaacgtacttctatatacacgtgggtgcgacacggccctaggacgagggacttggaggtggagtgggatggataccaaccgtaaggagtggtgacacgagccctgtgccacgaggacggttaccgagggaccgacggggtccaaccgagtaggtaggtcgggtacggaaccggaccgggacccgaacggaacggcccgtaacgggtcccaacgtacgttaaccgggtaacctttaaccggacgttaccgttacggtaacggtccgtagggaacggaccgtaccgggttacccgttttacgttccgtcggtcggacccggaccggaccccggtcggtaccggggggaaccggggggtacccgtaacgggttacccggttggtaacggtacccggg

SEQ ID NO: 120889 - DNA, 583 bp, Homo sapiens
  misc_feature: GYAE6OF01CE26Q.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagccgtggggcctcagtgaagctctcctgcaagacttctggatacgaggttcaacgtacttctatatacactgggtgcgacacggcccctggacagggacttggagtggagtgggatggatcaaccgtaaggagtggtgacacacgcctctgccacgaggtacggttaccgacgggcgacggggtcaccgagtgaggtggtgacgacggccgacggagcgacggtccacgtacgtacggaaccttaccgagttcctagtaacgtcgtaggaacggaccgtacggtcccgtttacgttcgtggtcgaccggaccggcccccgcggtacggggtaaccggggggtccgttaccggttaccgggtcgtacgggtacccggg

SEQ ID NO: 120890 - DNA, 655 bp, Homo sapiens
  misc_feature: GYAE6OF01AFUU4.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctgggcctcagtgaagctctcctgcaagacttctggatacaggttcaacgacttctatatacacgtgggtgcgacacggccccgtaggacgacgggacttggagtggagtgggagtggatacgaacccgtaaggagtggtacgacacgagcctactcgacacgaggtacggttccgagggacgtacgggtacaacccgagttaggacggttacgggtacggaaccggaccgggacccgaacggacggtaccgaccgggtacccaacgtacgtacggtaaccttaccgacgttacgtacgtaacgtcgtacggaacggtaccgtacgggttacccgttttaacgttccggttacggtcggtacccggtaccggacccccggtcggttaccgggggaaccgggggggtaccccttaacgggtacccgggttcgtaacgggtacccgggg

SEQ ID NO: 120891 - DNA, 575 bp, Homo sapiens
  misc_feature: GYAE6OF01DVLEM.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaacctaagagtggtagacacagcctcgtgcacaggtacggttccgagggtcgagggtcaccgatgagtggtagacgacggaccacgacgcgacggtccacgagtacggtaaccttaccgagtctaggtaacgttcgtaggacggaaccgtaccggttacccgtttacgttccgtggttacggccggaccggaaccccggtcggtacggggtaccggggggtacccttacggtacggttcgtacggtacccggg

SEQ ID NO: 120892 - DNA, 620 bp, Homo sapiens
  misc_feature: GYAE6OF01C3DUM.41.2.A02.1.454.CMB.1.raw
  modified_base (245)..(245): a, c, t, g, unknown or other
  misc_feature (245)..(245): n is a, c, g, or t
  modified_base (354)..(354): a, c, t, g, unknown or other
  misc_feature (354)..(354): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttcnggatacaggttcaacgacttactatatacacgtggtgcgacacggcccctggacagggacttgagtggagtggatggatacaaccctaaagcgtggtgacacacgcctntgacacgaggtacggttccgaggggcgaagggtccaaccgtagtggaggttagggtcgaaccgaccgggacccgaacggacgaccgaccgggtacccaacgtacgtaacggaaccctttaaccgaaggttcgtacggtaacgttacgtagggaacggaccgtaccgggttacccgtttacgttccgtcggttacgcggtaccgacccccggtcggtacggggaacccggggggtacctaaccggtacggtccgtaggtaacccggg

SEQ ID NO: 120893 - DNA, 570 bp, Homo sapiens
  misc_feature: GYAE6OF01D7FNS.41.2.A02.1.454.CMB.1.raw
  modified_base (530)..(530): a, c, t, g, unknown or other
  misc_feature (530)..(530): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacaggttcaacgtacttctatatacacgtgggtgcgacgacggcccctggacagggtacttgagtggagtgggatggactaccgaaaccgtaagagttgggtagaacgacgacgcctcgtgacacgaaggtacggttccgagggcacggggtcaccgtagtgaggtggtacgaccgacggccacggagccgacggtcccacgagtacggaaccttaccgagtcgtagaacgtcgtaggaggacgtacggtccgtttacgttcgtgtggacgacgaccccgnggtacggggaccggggtctacggtacggtcgtggtaccgg

SEQ ID NO: 120894 - DNA, 657 bp, Homo sapiens
  misc_feature: GYAE6OF01B0FAR.41.2.A02.1.454.CMB.1.raw
  modified_base (268)..(268): a, c, t, g, unknown or other
  misc_feature (268)..(268): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttacaacgtacttntatatacacgtgggtcgcgacgacggtcccgtaggacgagggtacttggagtggagtgggacgtaggactaccgaaaccgtaaggtaggtggtacgacgacacgtcctcgtcgaccaacgtacggtacggttccggaggggtaccgtacgggtaccaacgtacgtaggtaggttcgggtacgaccggaccggaccgtaacggcggaccgaccggtaccacgtaagtaccggtaaccttaccgtacgttcgtaacgtacgtgtacggacggtaccggtaccggttaccgtttaaccgttcggtcggttacggaccggaccggtaccccggtcgggtacgggggaacccgggggtcccttaacggtaccgggttcgtacgggtacccgggg

SEQ ID NO: 120895 - DNA, 631 bp, Homo sapiens
  misc_feature: GYAE6OF01D1XLR.41.2.A02.1.454.CMB.1.raw
  modified_base (583)..(583): a, c, t, g, unknown or other
  misc_feature (583)..(583): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggagccgtggggcctcagtgaagctctcctgcaagtacttcgtggatacgaggttacaacgtacttctatatacacgtgggtcgcgacacggcccctaggacgagggtacttgagtggagtgggatggactaccgaaaccgtaaggagtagggtacgaactacgagtacccgtcgtacgaccgaacgacgggtacggttacccgaaggggtaccgacggggtaccaccgagtggaggtcggtacgaccgaccgggaccgacggacgccgaaccggtaccaacgtacgtacggtaaccttaccgagttacgtagtaacgtcgtacggacggtacgtaccggttaccgtttacgtcgtcggtcggacggccgaccccggnggtaccggggtaccgggggtactaccggtacggtcgtacggtaccggg

SEQ ID NO: 120896 - DNA, 681 bp, Homo sapiens
  misc_feature: GYAE6OF01DYX3O.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtgggcctcagtgaagctctctgcaagtacttcgtagatacgtaggttacaacgtacttactatatacgacgtgggtcgacgtaccgcggccccgtaggacgtagggtacttggaggtggaggtagggagtacggtactaccgtaaaccgtaaggtacggtaggtacgaacgacgtacgtccctcgtcgaccgtacgacgggtacggttaccggaaggggtaccggtaacggggtaccaaccggtaggtacgggtaaggttcgggtacggaacccggtaccgggaccgaaccggtacggaccgaccgggtacccaacgtaacgtacggtaaccttacgacgtcgtaacggtaatcgtaggacgtaccgtaccgggttaccgttagttcgtcgtacggaccggtaccggtaccccggcgggtacgggggtaacccggggtccgtaacgggttccggtgtacgggtacccggg

SEQ ID NO: 120897 - DNA, 558 bp, Homo sapiens
  misc_feature: GYAE6OF01B9D5K.41.2.A02.1.454.CMB.1.raw
  modified_base (349)..(349): a, c, t, g, unknown or other
  misc_feature (349)..(349): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagcctggggcctcgagtgaagctctcctgcaagacttctggatacgaggttcaacgacttctatatacactgggtgcgacgacggcccctggacagggacttgagtggatgggatggatcaacctagagtggtgacacagcctntgcacgagacggttccgagggcagggtccaccgagtgagtggtcgacgacggccacgacgcgaccggtccacgagtacggtaaccttaccgagttcctaggaacgttcgaggacggaccgtaccgggtccgtttaacgttcgtgtcggcggtaccggaccccgcgtacggggtaaccgggggcctaacggtcggtcgtacggtacccgg

SEQ ID NO: 120898 - DNA, 558 bp, Homo sapiens
  misc_feature: GYAE6OF01DGNCB.41.2.A02.1.454.CMB.1.raw
  modified_base (246)..(246): a, c, t, g, unknown or other
  misc_feature (246)..(246): n is a, c, g, or t
  modified_base (514)..(514): a, c, t, g, unknown or other
  misc_feature (514)..(514): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagccgtggggcctcgagtgaagctctcctgcaagacttcgnggatacaggttcaacgacttactatatacacgtggtgcgacacggcccctggacagggacttggagtggagtgggataggatacaaaccgtaagagtggtagaacacagcctctgacacgagtacggttccgagggcgagggtcaccagtgaggtggtgacgacggacaagacgcgacggccaacagtacgaacttaccgagttctaggtaacgtcgtaggacggaccgtaccggtccgtttacgtcgtgtcgacggaccgacccggnggtacggggacgggggtacctacggtaccggtcgtaggtaccgg

SEQ ID NO: 120899 - DNA, 531 bp, Homo sapiens
  misc_feature: GYAE6OF01BU5LV.41.2.A02.1.454.CMB.1.raw
  modified_base (488)..(488): a, c, t, g, unknown or other
  misc_feature (488)..(488): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacacggcccctggacagggacttgagtggatgggatggatcgaaccctaagagtggtgacacagcctctgcacgagacggttccgagggcagggtcaccgatgagtggtgacgacggccgacgagcgaccgtccacagtcggaacttaccagtcgtagaacgtctagagacgaccggtccgtttacttcgtgtgcggcgaccccgngtacgggaaccgggggccctaacggtcggtcgtacggtaccgg

SEQ ID NO: 120900 - DNA, 692 bp, Homo sapiens
  misc_feature: GYAE6OF01EJJB4.41.2.A02.1.454.CMB.1.raw
  modified_base (430)..(430): a, c, t, g, unknown or other
  misc_feature (430)..(430): n is a, c, g, or t
tcagtctatactatcacgaccggtgctcgatttagactcatctacagggggagggcatacacccgagcaaccacatcgtgtcctcctacgagaggtcccctggagagctccgttcctccacccatggactcggaccctggaggatcctcttcgttcggtgggccagcagcccacaggagcccactctccacggtgcaggcctgatgcagtctgggctgaggtgaggaagccgtggggacctcgacgtgaagtctcgtcgtagtactaacgtacctttcgtaggaactaaccaacggttaccaaacggtaccttacctaacctaacttaccacgttgggtacgtacggacgacgggtccccctaggaccgacggggtaccttcggaggtgggtactgggatggactcctaaccgtagaggtcgtacgaacncgacgtcctgtcgaccactacggtacgtaccgacggtcacgggtcaccagtggaggtgggagacgacggaccacgtagtccgacggtccagtactacggtaactaccgacgttacgtagtaacgtcgtaggtacgggtacgtaccgggttaccggtttaacgtcgttacgggtccggtaccggtaccggtaccccggtacggtaccgggggtaacccggggggtaccttacccggtacccgggttcccgtacgggtacccgg

SEQ ID NO: 120901 - DNA, 544 bp, Homo sapiens
  misc_feature: GYAE6OF01DDG2L.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacagttcaacgacttctatatacacgtggtgcgacaggcccctggacagggacttgagtggagtgggatggatacgaacccgtaagagtggtagacacgacgccctctcgacacgaaggtacgggttccgaagggcgagggtcaccgagtggaggtggtcgaccgacggaccacgagccgacgtccacacgtggaaccttaccgagtctagaacgtctggacggacacggtcctttagttcgtgtgcggacgcccgaggtacgggacgggggacctagtaccggtgtgtaccggg

SEQ ID NO: 120902 - DNA, 698 bp, Homo sapiens
  misc_feature: GYAE6OF01CNCDH.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacgaggttcaacgtacttctatatacactgggtgcgacacggccctggacagggacttggaggtggagtggggatgggactacgaaacccgtaaggagtagggtcgacgacgagccctcgtcgccacgaggacgggtttacccgaggggtaccgacggggtacaaccgtacgttggaggttcgggtacgacgaaccgggccgaacggacggtacccgaaccgggtaccaacgtacgtacgggtaaaccctttaccgaccggttcgtaacggtaacggttaccgtagggaaccgggtaccgtaacccggggttacccggttttactttacggtttcggttacgggaccggtacccgggacccccgggtacgggttaccgggggggaaacccggggggggtaccccttaaccgggttaaccggggttacccgttaacggggtaacccgggg

SEQ ID NO: 120903 - DNA, 603 bp, Homo sapiens
  misc_feature: GYAE6OF01DSUS3.41.2.A02.1.454.CMB.1.raw
tcagtctatactatcacgaccggtgctcgatttagactcatctacagggggagcatcgacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgacttctatatacacgtgggtgcgacaggcccctgggacagggacttgagtggagtgggatggatacaaacccgtaagaggtggtgacacgacgcctctgcacgagaggttcccagggcgagggtcaaccgagtgaggtggtgaccgacggacccacggacgccgaacgggtcccaagacgttaacggaacttaacccgagttcctaggaacgttcgtaggacggtaaccgtaaccggtcccgttttaacttcgttcgtgggacccgacggacccccggtggtacgggggtaaacccggggggtcccttaaccggtaaccgggttccgtaagggtacccggg

SEQ ID NO: 120904 - DNA, 716 bp, Homo sapiens
  misc_feature: GYAE6OF01BUZ6Y.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggacgcccactctcaggtgcagctgatgcagtcgtggggctgaggtgaggagcgtgggcctcgagtgagctctcctgcaagacttcgtaggatacgaggttacaacgtacttctatatacacgtggtgcgacgacggccctaggacagggtacttggaggtggagtgggatggaatacgaaacccgtaaggagtaggtagaaccacgacgcctcgtcgacaacgaggtacggttccgagggacgacgggtaccaccgtaagtacggaggttcgggtacggaacccgaccgggacccgaacggaccggtaccggaaccggttacccgaaccgtacgttaaccggtaaaccgtttaacccgaggttaccgtacgtaacggttaccggtaggtaacgggacccgttaaccgggttacccgtttttaaccgttccggttacggtaccggtacccgggtaacccggtacccccgggtaccgggttaacccggggggaacccgggggggttacccgttaaacccgggttacccgggttaccggttaaccgggttaaccccgggg

SEQ ID NO: 120905 - DNA, 600 bp, Homo sapiens
  misc_feature: GYAE6OF01EH6XQ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatactactgggtgcgacacggccccgtggacgagggacttgagtggagtgggatggatcaaccgtaagaggtggtgaacacagcctctcgacacgaggtacgggttaccgaggggacgagggtccaccgagtggaggtggtacgacgaccggaccaccggacgccggacggtacccaacgacgtacggtaaccttaaccgagttaccgtagaacgttcgtaggacggaaccgtacggtaccgttttacgttcgtcggtacggcggaccggaccccgtcggtacggggtaaccggggggccttaaccggtacgggttcgtacggtacccgggg

SEQ ID NO: 120906 - DNA, 552 bp, Homo sapiens
  misc_feature: GYAE6OF01B5YR3.41.2.A02.1.454.CMB.1.raw
  modified_base (506)..(506): a, c, t, g, unknown or other
  misc_feature (506)..(506): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgacttctatatacactgggtgcgacacggcccctggacagggacttgagtggatgggatggatcgaaccctaagagtggtgacacagcctcgtgcacgagtacggttccagggcagggtcacatgagtggtgacgacgccacgagccgacggtccacgagtacggtaaccttaccgagtacgtggtaagtcgtaggaggaccgacggtccgtttacgttccgtggtcgccggtacggacccccgnggtacgggaccgggggcctaccggtacggttccgtaggtacccggg

SEQ ID NO: 120907 - DNA, 612 bp, Homo sapiens
  misc_feature: GYAE6OF01EX9JJ.41.2.A02.1.454.CMB.1.raw
  modified_base (285)..(285): a, c, t, g, unknown or other
  misc_feature (285)..(285): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctcctgcaagcttctggatacgaggttcaacgacttctatatacacgtgggtncgacacggcccctggacgagggcttggagtggagtgggatggactaccgaaacccgtaagtacggtggtacgacacgacgtcctcgtcgacacgaggtacggttccgacgggacgacgggtaccaccgtagtcggaggtggtacgacggaccggaccgacgacggaccgacggtacccacgtacgtacggtaaccttaccgagtacgtacgtaacgtcgtaggacggacgtaccggttaccgtttacgttcgtggtcgaccggtacggaccccgtacggtacggggacccgggggtacctaccggtacggtacgtcggtaacccggg

SEQ ID NO: 120908 - DNA, 587 bp, Homo sapiens
  misc_feature: GYAE6OF01EXKNI.41.2.A02.1.454.CMB.1.raw
  modified_base (428)..(428): a, c, t, g, unknown or other
  misc_feature (428)..(428): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacgaggttcaacgtacttctatatacactgggtgcgacacggcccctggacagggacttggagtggatgggatggatacgaacctaagagtggtgacacgagcctctgcacgagtacggttccgagggcgagggtcacagtgaggtggtgaccgacggccgacgacgccgacggtcccanacgtaggaaccttaccgagtacctaggtaacgtcgtacggacggacgtaccggtacccgtttacttcgtcggttcggaccggtaaccggacccccgtgggtaccggggtaaccgggggggtaccctaaccggttaccgggttccgtacggtacccgggg

SEQ ID NO: 120909 - DNA, 639 bp, Homo sapiens
  misc_feature: GYAE6OF01BP9F3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagcgtggggcctcgagtgaagctctccgtgcaagacttctggatacaggttcaacgtcttctatatacacgtgggtcgcgacacggcccctaggacagggacttgaggtggagtgggatggatacgaaaccgtagagtggtagacacacgtcctcgtacgcacgaggtacggttccgagggcgacgggtaccaccgtagtggacggtggtacgaccgaccggtaccgaacggtacgaccgacggtaccaacgtacgtacggtaaccttaaccgacgttaccgtaggtaacgttcgtaggaccggtaccgtaccggttcccgttttacgttccgttcgtacggaccggacccggtacccccggtacgggtaccgggggtaaaccccgggggtcccgttaaccggttaccgggttaccggtacgggttaccccgggg

SEQ ID NO: 120910 - DNA, 580 bp, Homo sapiens
  misc_feature: GYAE6OF01CTKIB.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctcctgcaagacttcgtggatacaggttacaacgacttactataatacacgtgggtgcgacgacggcccctggacagggtacttggagtggagtgggatggatacgaaacccgtaagaagtggtagaacacgaacgcctcgtgacacaggacggttcgagggcgagggtcacagtgagtggtgacgacggccacgacgcgacgtccaacacgtacggaaccttaccgaagttcgtagtaagtcgtaggacggacgtaccggtccgttttacgtcgttggtcgacggtaccggaccccggcgtacggggaaccgggggtacctacggtaccggtcgtaaggtacccggg

SEQ ID NO: 120911 - DNA, 539 bp, Homo sapiens
  misc_feature: GYAE6OF01EBW05.41.2.A02.1.454.CMB.1.raw
tcagtctatactatcacgaccggtgctcgatttagactcatctacatggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacgagaggttccagggcagggtcacatgagtggtgacgacggccacgagcaccggtccacgaacgtcggaacttaccgagtctgaagtctggacggacacgggtcccgtttacgttccgttaggtgccggacgaccccggcggtacggggaaccggggggcccttaaccggtaccggtcgtaaccggg

SEQ ID NO: 120912 - DNA, 600 bp, Homo sapiens
  misc_feature: GYAE6OF01DGAP3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcagacttctggatacaggttcaacgacttctatatacacgtggtgcgacacggccctggacagggacttgagtgagtggatggatacaaccgtaagagtggtgacacacgcctcgtgacacgaggtacggttaccgagggcgagggtcaaccgagtaggaggtggtacgacgaccggaccgaacggacggccgtaccggtaccacgtaagtacggtaaccttaacccgagttacgtagaagttccgtaggaacggtaaccgtaccgggtacccgtttacgttcgtacggtcgaccggtaccggtacccccgacggtacgggaacgggacgggggtacccttaaccggtaccggttcgtaaccgggg

SEQ ID NO: 120913 - DNA, 671 bp, Homo sapiens
  misc_feature: GYAE6OF01CY0Q6.41.2.A02.1.454.CMB.1.raw
  modified_base (246)..(246): a, c, t, g, unknown or other
  misc_feature (246)..(246): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttcgnggatacgaggttacaacgtacttctatatacacgtgggtgcgacacggcccctaggacgagggacttggagtggatgggatggataccgaaacccgtaaggaggttggtagaacacacgccctcgtgactaacgaggtacgggttaccgaggggacgtacgggtaccaccgagtggtaggtgggtacgaccgaccggacccgaacggacgaccgtaaccggtacccaacgaacgttacggtaaaccttaaccgacggttaccgtaggtaacggttacgtggaacggtaccgtaaccgggttacccgttttaaccgttcgttacgggtccggaccggtaacccggtacccccgggtacgggtaccgggggtaaccggggggtacccttaacccgggttaccgggtaccgttaacgggtacccgggg

SEQ ID NO: 120914 - DNA, 599 bp, Homo sapiens
  misc_feature: GYAE6OF01BUPAE.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaacctaagagtggtgacacagcctctgcacgagaggttccgagggcagggtcaccgatggagtggtcgacgacggccgacgacgccgacggtcccaacgagtacggtaaccttaccgacgttcgtaggtaacgtcgtacggaacggtaccgtaccggttccgtttaaccgtttcgtacggttcggacccggtaccggaccccccggtacgggttaccggggaaacccgggggggtcccttaacccgggttaccgggttccgtaacgggtacccgggg

SEQ ID NO: 120915 - DNA, 644 bp, Homo sapiens
  misc_feature: GYAE6OF01BX9Q7.41.2.A02.1.454.CMB.1.raw
  modified_base (289)..(289): a, c, t, g, unknown or other
  misc_feature (289)..(289): n is a, c, g, or t
  modified_base (369)..(369): a, c, t, g, unknown or other
  misc_feature (369)..(369): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctcctgacaagacttctggatacgaggttacaacgtacttctatatacacgtgggtncgacacggccctggacagggacttgagtggagtgggatggatacgaaacccgtaaggaggtggtacgaacacgagccctntcgacacgaggtacggttccgagggtcgacggggtaccaaccgtagtaggaggttaggtcgaaccgacgggacccgaacggacgaccgtaaccgggtaccaacgtacgtacggtaaaccttaccgtacgttacgtacgtaacggttcgtaggaacggtaccgtaccgggttaccgttttaccgttcgttcggtacggccggtaaccggtaccccggtggtaccgggggaccgggggtaccttaaccgggtacggttaccgtcgggtaacccgggg

SEQ ID NO: 120916 - DNA, 684 bp, Homo sapiens
  misc_feature: GYAE6OF01BHH0Z.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagccccactctcaggtgcagctgatgcagtcgtggggctggaggtgaggaagccgtggggcctcgagtgagctctcctgcaagacttctggatacaggttcaacgtacttctatatacacgtgggtgtcgacacggcccctggacagggtacttggaggtggagtgggatggactacgaaaccctaggagtggtacgacacgagtccctctggccaacgaggtacggttaccgagggacgtacgggtcaaccgatggtaggtgggttacggacgaccggacccgaacggacgaccggtaccggtaccaacgtacgtaacgggtaaccttaaccgacgttccgtaggtaacgttcggtaggtaacgggtacccgtaaccgggttcccgtttttaaccgtcgttaccgggttacgggtaccggaaccccggtacccccggtacggttaacccgggggggtaacccgggggggtaccctttaaacccgggttaacccggggttccggttaaccgggtaaccccggggg

SEQ ID NO: 120917 - DNA, 592 bp, Homo sapiens
  misc_feature: GYAE6OF01B36D1.41.2.A02.1.454.CMB.1.raw
  modified_base (253)..(253): a, c, t, g, unknown or other
  misc_feature (253)..(253): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctcgtcctgcaagacttctggatacnggttcaacgtacttctatatacacgtgggtgcgacacggcccctggacgagggacttggagtggatgggatggatccaaccgtaagagtggtagacacgagtcctcgtgcacgaggacggttccgagggcagggtacaccgatgagtggtgacgacggccgaacggacgccgaacggtccaacgtacgtacggtaaccgtttacccgagttaccgttaggaaagttcgtaggaacggaccgtaccggtaccgtttaacgttcgtggttcgacggaccggtaccccgcggtacggggaaccggggggtcttaacccggtacggtccgtaagggtaccggg

SEQ ID NO: 120918 - DNA, 699 bp, Homo sapiens
  misc_feature: GYAE6OF01E2AVF.41.2.A02.1.454.CMB.1.raw
  modified_base (288)..(288): a, c, t, g, unknown or other
  misc_feature (288)..(288): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagtcttctggatacgaggttccaacgtacttctatatacacgtggggtncggtacgacggtcccctaggacgagggtacttggagtggagtggatggactacgaaccgtaggagtggtcgacacgtagcctacgtcgcgaacgtacggtacgggttccgagggtacgacgggtacctaccgtagtcggtaaggtcgggtacgaaccggtaccgggacccgaacggtacgaccggtaacccgggtacccaaccggtaacgtaccgggtaaaccttacccgtaggttaccgtaggtaacgttccgtacgggaacgggtaacccgtaccgggttacccggttttaaccgttcggttacgggtacggtacccgggtaacccggtacccccgggtcgggtaaccgggggtaacccggggggtaccgttaacccggttaccgggttaccgtaacgggtacccgggg

SEQ ID NO: 120919 - DNA, 686 bp, Homo sapiens
  misc_feature: GYAE6OF01BHJB9.41.2.A02.1.454.CMB.1.raw
  modified_base (286)..(286): a, c, t, g, unknown or other
  misc_feature (286)..(286): n is a, c, g, or t
  modified_base (349)..(349): a, c, t, g, unknown or other
  misc_feature (349)..(349): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagccgtggggcctcgagtgaagctctcctgcaagacttcgtggatacgaggttacaacgtacttctatatacacgtgggtncgacgcggccctggacagggacttggacggtggagtgggatggactaccgaaacccgtaaggnggtcggtagacacgacgtcctcgtcgacacgaggtacggttccgagggtcgacgggtaccaccgtagtcggtaggtggtacgaccgaccggtacccgaacggaaccgaccgggtacccaacgtaacgtacggtaaaccttaaccgtagtaccgtaacggtaacgtcgtacgggaacggtaccgtaccgggttacccgttttacgttccggttacggttccggacccggaacccgggtacccccgggacgggttaacccgggggggaaacccgggggggttccccttaaccgggttaccccgggttacggttaacccgggtaccgggttacccggggg

SEQ ID NO: 120920 - DNA, 659 bp, Homo sapiens
  misc_feature: GYAE6OF01EWX69.41.2.A02.1.454.CMB.1.raw
  modified_base (245)..(245): a, c, t, g, unknown or other
  misc_feature (245)..(245): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctctgcaagacttcnggatacaggttcaacgacttctatatacacgtgggtgcgacacggcccctgggaccagggacttggagtggagtgggatgggactacgaaacccgtaaggagtggtagacacgagccctctgcacgaggtacggttccgagggccagggtcaaccgtagtaggaggtgggtacgaaccgaccgggacccgaacggtacgcccgtaacgggtacccaacgtacgtacggtaacccttaaccgtacgttacgtacgtaacggttccgtacggaacggtaccgtaccgggttacccgttttaaccgttcgttcgggttacggaccggtaaccccggtacccccgggtaccggtaccggggggtaacccgggggggtacccttaaccggttaccgggttacgtaaccggtacccgggg

SEQ ID NO: 120921 - DNA, 577 bp, Homo sapiens
  misc_feature: GYAE6OF01A3MS9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagccgtggggcctcgagtgagctctcctgcaagacttctggatacaggttcaacgtacttctatatacacgtgggtcgcgacgacggcccctggacgagggtacttggaggtggagtgggatggactacgaaaccgtaagacgtggtcgacacgacgcctctcgacacgaggtacggttccgacgggcgacgggtcacgtagtggaggtcggtacgacgacggccgacggacgccgacggtccacgacgtacggaaccttaccgagtactagacgtcgtacggacggacgtacggtccgtttacgttcgtcgtcggccgacggcccggtaggtacggggaccgggggctacggtaccggtcgtggtaccggg

SEQ ID NO: 120922 - DNA, 512 bp, Homo sapiens
  misc_feature: GYAE6OF01E034L.41.2.A02.1.454.CMB.1.raw
  modified_base (280)..(280): a, c, t, g, unknown or other
  misc_feature (280)..(280): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtncgacaggcccctggacagggacttgagtggatgggatggatcaacctaagagtggtgacacagcctctgcacagaggttccgagggcagggtcaccatgagtggtgacacggccacgagcacggtccacatcggaacttaccagtctgaagtctgaggcacggtccgtttactcgtgtgcggcgaccccgcgtcggggaacggggggcctacgtacgggtcgtaggtaccgg

SEQ ID NO: 120923 - DNA, 568 bp, Homo sapiens
  misc_feature: GYAE6OF01D8W5X.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttcgtggatacgaggttcaacgtacttctatatacacgtgggtgcgacgacggcccctggacgagggtacttgaggtggagtgggatggatcgaaccgtaagagtggtgacacagcctctgcacgaggtacggttaccgagggcgagggtcaccgagtgaggtggtacgacgacggccgacggacgccgacggtccaacgtagtacggtaaccttaccgagtcgtagacgtcgtaggacggacgtaccggtccgtttacgttcgtcggtgcggacgaccccgcggtacggggaccgggggtcctacggtacggtcgtaggtaccggg

SEQ ID NO: 120924 - DNA, 565 bp, Homo sapiens
  misc_feature: GYAE6OF01A7WXZ.41.2.A02.1.454.CMB.1.raw
  modified_base (513)..(513): a, c, t, g, unknown or other
  misc_feature (513)..(513): n is a, c, g, or t
  modified_base (531)..(531): a, c, t, g, unknown or other
  misc_feature (531)..(531): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggagccgtgggcctcgagtgaagctctccgtgacaagtacttcgtggatacgtaggttacaacgtacttctatactacgacgtggtcgcgacacggcccctaggacgaggacttgagtggagtggatggatacgaaccgtaaggacgtggtacgactacgacgtcctacgtgacacgacgtacggttccgagggacgacggtacaccgtagtaggagtcggtacggacgtaccggaccgacgacgaccgacggtaccacgagtacgaaccttacgacgtcacgtagtcgagacggacgcgtaccgttntcgtgtagcgacgcccgnggcgggtacggggctacggtacgtcgtgtaccgg

SEQ ID NO: 120925 - DNA, 672 bp, Homo sapiens
  misc_feature: GYAE6OF01DH5GP.41.2.A02.1.454.CMB.1.raw
  modified_base (247)..(247): a, c, t, g, unknown or other
  misc_feature (247)..(247): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgacaagacttcnggatacgtaggttacaacgacttctatatacacgtggtgcgacgcggccctggacgagggtacttggacggtggagtgggatggactaccgaaaccgtaagaggttgggtagaccacgacgtccctcgtcgaccgacgaaggtacggttacccgaggggtaccgacggggttaccaaccgtagtaggacggttgggtacggaaccgaccgggacccgtaaccggacgaccggtacccggtacccaacgtacgttaacgggaacctttacccggagttctacggaacgttcgtaggacggtaaccgtaccgggttaccgtttacgttcggtacggtcggtacccggaccggtacccccggtcggtaacggggggtaccccgggggtaccttaccgggttacccggtagttaccgggtaacccgggg

SEQ ID NO: 120926 - DNA, 651 bp, Homo sapiens
  misc_feature: GYAE6OF01CTCZA.41.2.A02.1.454.CMB.1.raw
  modified_base (247)..(247): a, c, t, g, unknown or other
  misc_feature (247)..(247): n is a, c, g, or t
  modified_base (356)..(356): a, c, t, g, unknown or other
  misc_feature (356)..(356): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagtccactctcaggtgcagctgatgcagtctgggctgaggtgaggaagccgtggggcctcgagtgaagctctcctgcaagactttcgnggtaatacgtaggttacaacgtacttctataatactacgtgggtgcgacacggcccctggacagggacttggagtggagtgggatggatcgaaaccctaagagtggtanacacagcccgtctcgcgacaggtacggttaccgagggtcgaagggtccaaccgtacgtagtagggttggtacggaaccgaaccgggtacccgacggacgaccgaccggtaccaaccgtagtaccggtaaaccttaccgacgttcgtaggtaacgttacgtaggaacggaccgtaccggtaccgttttaaccgttcgttacggtcggacggtaaccgacccccggtacgggttaccgggggaacccggggggttacccgtaccggttaacgggttcccggttaaggttacccgggg

SEQ ID NO: 120927 - DNA, 609 bp, Homo sapiens
  misc_feature: GYAE6OF01D9P1G.41.2.A02.1.454.CMB.1.raw
  modified_base (284)..(284): a, c, t, g, unknown or other
  misc_feature (284)..(284): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgagctctcctgcaagacttctggatacaggttcaacgacttctatatacactgggtgcgacnggcccctggacagggacttgagtggatgggatagggatacgaacccgtaaagacggttggtagaacgtacgacgcctacgtcgacaacaaggtacgggttaccgaacggggtccgaacgggtcaaccgtagtacggagtggtacgaccgacggacccgacggacgaccgaccggtcccacgacgtacggtaaccttacccgtaacgtccgttagaacgttcgtacgtaggaaccgtacggtcccgttttaccgtcgttgtacggacgaccggaccccgcggtaccgggtaacgggggtacctacgtaacgggtcgtagtaccggg

SEQ ID NO: 120928 - DNA, 683 bp, Homo sapiens
  misc_feature: GYAE6OF01CQZ0C.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttacaacgtacttctatatacacgtggtgcgacacggcccctggacagggacttggagtggagtgggatggactaccaaacccgtaagaggtggtagacacgacgcctcgtgccacgaggtacggttaccggaaggggtccgtaacggggtcaacccgtagttacgggtaaggttacgggtacgaccgtaacccgggacccgaacggacggaccgtaacccgggtacccaaccgtacggttaacggtaaaccctttaacccgaaggtttccgtaaggtaacggttccgtaggaacgggtacccgtaccgggttacccgtttttacgttccgttaggtccggaccggtaccggacccccgggtcgggtaaccgggggtaacccggggggtacccttaacgggtacccgggtccgacgggttacccgggg

SEQ ID NO: 120929 - DNA, 756 bp, Homo sapiens
  misc_feature: GYAE6OF01D0TC2.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgacaagacctttcgtaggatacgtaggttacaaacgtacttctaatatacacgttgggtcgcgacacggcccctaggacagggtacttggaggtggagtgggtataggactaccgaaaccgtaaaggcggtaggtagaacctaacgacgtccctcgtacgaccaacgtaggtaccgggttacccgaggggtaccgtaacggggttaccaacccggtaagttacgggaacggttcggggtaaccgaacccgggtacccgggacccgtaaacgggaccgacccggtaacccgggttacccaaacggtaacgtttaacccggggtaaacctttacccggaacgttaccggttaaggaacgttaccggttacgggaaacgggtacccggttaccgggttacccgtttttaaaccgttccggtttacggtacggaccggtaaccccgggtacccccggtacgggtaccggggggaaccccgggggttaccttaaccgggttaccggtaccggtacggtacccgggg

SEQ ID NO: 120930 - DNA, 516 bp, Homo sapiens
  misc_feature: GYAE6OF01DM8KW.41.2.A02.1.454.CMB.1.raw
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
  modified_base (481)..(481): a, c, t, g, unknown or other
  misc_feature (481)..(481): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttggagtggagtgggatggatcaaaccctaagagtggtgacacagcctctgcacagaggttccgagggcagggtcacagtgagtggtgacgacggccacgngcacggtccanagtacggaaccttacagtctagagtcgtgaggaccacggtccgtttactcgtgtgcgacgaccccgngtacgggacggggcctagtacggtcgtggtaccgg

SEQ ID NO: 120931 - DNA, 682 bp, Homo sapiens
  misc_feature: GYAE6OF01EZ6M5.41.2.A02.1.454.CMB.1.raw
  modified_base (282)..(282): a, c, t, g, unknown or other
  misc_feature (282)..(282): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtgggcctcgagtgagctctcctgcaagacttctggatacaggttacaacgtacttctatatacactgggtncgacgacggccctggacgaggactgagtgagtgggatggatcgaaaccgtagagtggtagacacacgccgtctcgacacaggtacggttccgaagggcgacgggtaccaccgtagtaggtaggtggtacgaccgaccggaccgacgacgaccgaccgggtacccaacgtacgtaacgggtaaccctttaccgaagttacgtacggtaacgttaccggtaggaaccgggtaaccggtaaccggggttaccccgttttaaaccggtttccggttacggttacgggtacccgggtaaaccccgggtacccccgggtaacgggttaaccggggggtaaacccgggggggttaccccggttaaccggttacccggggttacccggttaacgggttaacccggggg

SEQ ID NO: 120932 - DNA, 604 bp, Homo sapiens
  misc_feature: GYAE6OF01BO468.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtggggcctcgagtgaagctctctgcaagacttcgtggatacaggttcaacgtacttctatatacacgtgggtcgcgacacggcccctggacgaggacttggaggtggagtgggatggactaccgtaaacccgtaaggaggtggtacgaacaacgacgtaccctcgtcgacaacgtaggtaccggttaccgaggggacgaacggggtaccacgtagtggaggtggtacgacgaccggccgaacggacgaccgaccggtaccaacgtacgtaacgggtaaccttaccggagttcgagtaagtcgtaggaacggacgtaccggttccgtttacgtcgtgtcgcggtaccgcccgtggtacggggaccggggactacggtacgtgtacggtaccggg

SEQ ID NO: 120933 - DNA, 574 bp, Homo sapiens
  misc_feature: GYAE6OF01DHBV8.41.2.A02.1.454.CMB.1.raw
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgacttctatatacacgtgggtcgcgacaggcccctggacagggacttgaggtgagtgggatggatcaacctagngtgtagacacagcctctgcacngacggtcgagggcgaggtcacagtgagtggtgacgacggaccaacggagccgtaacggtccaacgagtacggtaacttaccgaagtccgtagtaagtcgtaggacggaccgtaccgggtccgttttaacgttcgttagtcggaccggtaccgaccccggtcggtacggggtacccggggggtacccttaacggtaccgggtcgtacgggtacccggg

SEQ ID NO: 120934 - DNA, 577 bp, Homo sapiens
  misc_feature: GYAE6OF01BN70H.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgagctctctgcaagacttctggatacaggttcaacgacttctatatacactgggtgcgtacaggccctggacagggacttgagtggatgggatggatcaaccgtaagagtggtgactacgagcctctgcacgagacggttccagggcagggtcaccgagtgaggtggtagacgacggccaacggacgccgacggtcccaacgagtacggtaaccttaccgacgttacgtagtaacggtcgtaggacggtaccgaccggtcccgtttacgttcgtgtcggaccggaccgacccccggtcgtacgggggtaaccggggggtcccttaaccggtacgggtacgtacggtaacccgggg

SEQ ID NO: 120935 - DNA, 515 bp, Homo sapiens
  misc_feature: GYAE6OF01ETMZB.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagagttccgagggcagggtcaccatgagtggtgacacggccacgagcgacggtccacatcgaacttaccagtctgaagtctagaggacacggtccgtttacttcgtgtggcgtcgaccccgtcgtacgggaacggggggcctacgtacggtcgtggtaccgg

SEQ ID NO: 120936 - DNA, 575 bp, Homo sapiens
  misc_feature: GYAE6OF01BKLNC.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacagttcaacgtacttctatatacactgggtgcgacaggcccctggacagggactggagtggatgggatggatcaaaccgtaagagtaggtgacacacgtacctctgcacgagtacggttccgagggcaggggtcaccgagtgagtggtagacacggccaacggacgccgacggtccacgacgtacggtaaccttaccgagttcgtagaacgtcgtaggacggacaccgggtcccgtttaacgttcgtcggtggacggtaccgacccccggtcggtaccggggaaccggggggtccttaaccggtacgggtcgtacgggtacccggg

SEQ ID NO: 120937 - DNA, 556 bp, Homo sapiens
  misc_feature: GYAE6OF01EE8JP.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggccctggacagggacttgagtggatgggatggatcaacctaagagtggtgacacagcctctgacacagacggttccgagggcacgggtcaccgagtgagtggtagacgacggaccacgacgccgaccggtccaacacgtacggaaccttaccgagttactagtaacgtcgtaggacggacgacggtaccgtttacgttcgtggtgaccggacgacccccgtggtacggggtaaccgggggtcctaacggttacggtcgtacggtaccggg

SEQ ID NO: 120938 - DNA, 561 bp, Homo sapiens
  misc_feature: GYAE6OF01EBDWB.41.2.A02.1.454.CMB.1.raw
  modified_base (347)..(347): a, c, t, g, unknown or other
  misc_feature (347)..(347): n is a, c, g, or t
  modified_base (513)..(513): a, c, t, g, unknown or other
  misc_feature (513)..(513): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacgaggttcaacgacttctatatacacgtggtgcgacacggccctggacaggactgagtggatgggatggatacaacctagagtggtgacacagcctngcacaggacggttaccgagggcgagggtcaccagtgagtggtagaccgacggccacgagaccgacggtccacgacgtacggtaacttaccgagttaccgtagaacgttcgtacggacggaacgtaccggtccgtttaccgttgtcggtggacgaccggtaccccgnggtacgggaccgggggtaccttacggtaccggtcgtacggtacccggg

SEQ ID NO: 120939 - DNA, 675 bp, Homo sapiens
  misc_feature: GYAE6OF01DDK87.41.2.A02.1.454.CMB.1.raw
  modified_base (268)..(268): a, c, t, g, unknown or other
  misc_feature (268)..(268): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttcgtggatactaggttcaacgacttntaatatacacgtggtgcgacacggccccgtggacgagggacttgaggtggagtgggatggataccaaacccgtaaaggtagtggtacgaacacgtaacgccttctcgaccaacgaaggtacgggttccgaaggggccgaaggggttaccaacccgtaagtcggtaaggtgggtacggacgaccgggacccgacggacgaccgtaaccggtaccaaccgtagtaacggtaaaccgtttaacccgaaggttccgtaggtaacgtacgttacggaacgggtaaccgaaccgggttcccgttttaacgttcgttcggtagtaccggaccggtacccccggaccggtacgggggtaacccgggggggtacccttaaccgggttaaccgggtaccgttagggtaaccccgggg

SEQ ID NO: 120940 - DNA, 567 bp, Homo sapiens
  misc_feature: GYAE6OF01AN8J3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgtacttctatatacactgggtgcgacacggcccctggacagggacttgagtggagtgggatggatcgaaaccctagagtggtgacacgacgcctctgcacgaggacggttccgagggcgacgggtcaccgagtgaggtggtagacgacggccacggacgccgacggtccacgtagtacggaaccttaccgagtcgtagacgtcgagacggacacgggttacctttacgttcgtcggttggacggagtaccgtcccggcggtaccgggggaaccggggggtaccctacggtaccgggtcgtaaccggg

SEQ ID NO: 120941 - DNA, 600 bp, Homo sapiens
  misc_feature: GYAE6OF01BQ9XH.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgtacttctatatacactgggtgcgacacggccctggacagggacttgagtggatgggatggatcaaacctagagtggtgacacagcctctgcacgaggacggttccgagggcgagggtcaccgagtgagtggtagacgacggaccgacggacgaccgacggtacccaacgacgtacggtaaccgttaccgacgttacgttaggtaacgttccgtaggaacggaccgtaccgggtacccgtttaccgttcgtcggttacggccggtaccggaccccggtcggtacggggtaaccgggggggtcccttaaccggtaccgggtaccggttacggtacccggg

SEQ ID NO: 120942 - DNA, 722 bp, Homo sapiens
  misc_feature: GYAE6OF01BFZVE.41.2.A02.1.454.CMB.1.raw
  modified_base (216)..(216): a, c, t, g, unknown or other
  misc_feature (216)..(216): n is a, c, g, or t
tcagtctatactatcacgaccggtgctcgatttagactcatctacgtaggggggtagggcactcggacccctacgacaaaccacaatcctacgtcctcgtacgaggacgttcccctgacgtacgtccgttcccgttcctccacctagtcggaccgtcgggaaccgtgggaaggtacttcctcgttcgttgggtcgggcacgcaggccacacggacncccactctcgacggtgcgagctgactcgcagtcgtgggctcgaggtcggaggacgccgtagggcctcgaggtgacgtctactaccgtagcgtaacgtcttcgaggtaactacggaacgttacaacgtacttacgtactactactacgttaggacaccgaacgaccgtacctaggaccgacgggtccttaggacggtgtacgtcgggactacggtacctacgtaaccggtagacggtcgacgacacgtacgtcctcgtcgacgacgtacggtaccggtcggacgggtacgacggggtccaacggtagtacggacgttcgtacgaccgtaccggactcggtacggtccgacggtcacgtacggtacggtaaccttcggacggttacggacgtacgttacgcggtaaccggaccgttacggttacccgttgtccggtacgcggtacccgcccggtccgggtcgggtacgggggtacccggtcccttacggtcccgtcgtcggtaccggg

SEQ ID NO: 120943 - DNA, 602 bp, Homo sapiens
  misc_feature: GYAE6OF01D831W.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagaccttctggatacaggttacaacgacttctatatacactgggtgcgacgacggcccctggacagggacttgagtggagtgggatggatacgaacctaaggaggtggtagaccagacgcctcgtgccaacgaaggcggttaccgagggtccgagggtccaacgtagtacggaggttcggacgaccgacgggccaacggacgccgaccggtacccacgtacgtacggtaacctaccgtagtacgtagtaacgtcgtaggaacggtacgtaccgggttcctttaccgttcgtcggtagccggaccgaccccgggtcggtaaccggggaccggggggtacctacggtaccggtccgtggtacccggg

SEQ ID NO: 120944 - DNA, 580 bp, Homo sapiens
  misc_feature: GYAE6OF01DCLGG.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggaagcctggggcctcgagtgaagctctcctgcaagacttctggatacgaggttcaacgtacttctatatacacgtggtgcgacacggccctggacgaggacttggagtgagtgggatggatacgaaacccgtaagacggtggtacgacacgacgtccctcgtgacaacgacggtacggttccgacgggcgacgggtccacgagtaggtaggtaggtacgacgaccggccaacggacgcgaccggtcacgacgtacggtaaccgttaccgagttcagtacgtcgtagacggtacctacggtccgtttactcggtcgtcgcggaccgacccggtcgtacggggaccggggtactacggtaccggtgtcggtaccggg

SEQ ID NO: 120945 - DNA, 556 bp, Homo sapiens
  misc_feature: GYAE6OF01AY7C9.41.2.A02.1.454.CMB.1.raw
  modified_base (352)..(352): a, c, t, g, unknown or other
  misc_feature (352)..(352): n is a, c, g, or t
  modified_base (511)..(511): a, c, t, g, unknown or other
  misc_feature (511)..(511): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgacttctatatacactgggtgcgacacggcccctggacagggcttgagtggatgggatggatcaaccgtaaggagtggtagacacagcctntcgcacgagacggttccgagggcacgggtcaccgagtgagtggtgacgaccggccacgacgccgacggtccaacagtacggaaccttaccgacgttcctagaacgttcgtaggacggacgaccggtccgtttacgttcgtggtcgcggacggaccccgngtacggggtaccgggggcctacggtaccggtcgtacggtaccggg

SEQ ID NO: 120946 - DNA, 594 bp, Homo sapiens
  misc_feature: GYAE6OF01BQIPT.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacatgagcccactctcaggtgcagctgatgcagtctggggctgaggtgaggaagcctggggcctcagtgaagctctcctgcaagacttctggatacaggttcaaacgtacttctatatacacgtgggtgcgacaggcccctggacagggacttggagtggagtgggatggatcgaaaccctaagagtggtgacacagcctacgtgcacgagaggttccgagggcagggtcacagtgagtggtgacgacggccgacgacgaccacggtcccaagacgtacgggaaccttacccgaagttacgtagaacgttacgtaggtacggtaccgaccgggtcccgttttaacgttccgttaggtacggcccggaccgtacccccgggtacggtaccgggggtaaacccgggggggtacccttaaccggtaccgggttccgtaacggg

SEQ ID NO: 120947 - DNA, 582 bp, Homo sapiens
  misc_feature: GYAE6OF01D6QDT.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggagtgggatggactcgaacctaagagtggtgaacacagcctctgcacgagacggttccagggcgagggtcaccagtgagtggtgacgacggccacgacgcgacggtaccacgagtacgggtaaccttaccgagttactaggaacgttcgtaggaacggaaccgtaccggttacccgtttacgtttccgtcggttggaccggtacggacccccggtcggtacggggaacccgggggggtacccttaaccggttaccggtcgtacggtacccggg

SEQ ID NO: 120948 - DNA, 618 bp, Homo sapiens
  misc_feature: GYAE6OF01D1H4V.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacaggacgcccactctcaggtgcagctgatgcagtcgtgggctgaggtgaggagcgtgggcctcgagtgagctctcctgcaagcttcgtgatacaggttacaacgtacttactatactacacgtgggtagcgacgacggcccctggacgagggtcttgaggtgagtgggatggactacaaaccgtagagtggtacgacacgacgcctctgacacgtagacggttaccgagggcgtacgggtcaaccgtagtagtaacgtgggtacgacgaccggaccacggtacgccgaccggtaccacgaacgtacggtaacccttacgacgttctacggtaagtcgtaggacgtaccgaccggttccgtttaacgtcgtttggaccgtacggaacccgcccccgggtagggtaccggggtaacccggggggtaccttaacgggtaccccggttcgaacgggttacccgggg

SEQ ID NO: 120949 - DNA, 632 bp, Homo sapiens
  misc_feature: GYAE6OF01D1CBO.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagccgtggggcctcgagtgaagctctcctgcaagtacttcgtaggatacgaggttacaacgtacttctatatacacgtgggtgcgacgacggcccctggacgaggacttggagtaggagtgggatgggactaccgaaaccgtaagaggtggtacgaacgacaggtcctcgtacgacaacgacggtacggttaccgagggacgacgggtaccaccgagtggaggtggacgacgaccggaccgacgacgaccgaacggtcaacgacgtacggtaaccttaccgagttaccgtaggtacgtcgtagaacgggtaccgtaccgggttacccgttttaacgtcgttcggtacgaccgggtaccgcccccgggtaggttaccgggggaacccgggggttccctaaccggtaccgggttcgacggttacccgggg

SEQ ID NO: 120950 - DNA, 649 bp, Homo sapiens
  misc_feature: GYAE6OF01BIZY7.41.2.A02.1.454.CMB.1.raw
  modified_base (249)..(249): a, c, t, g, unknown or other
  misc_feature (249)..(249): n is a, c, g, or t
  modified_base (281)..(281): a, c, t, g, unknown or other
  misc_feature (281)..(281): n is a, c, g, or t
  modified_base (358)..(358): a, c, t, g, unknown or other
  misc_feature (358)..(358): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaaggccgtggggcctcgagtgaagctctctgacaagacttcnggatacaggttacaacgtacttctatactacncgtgggtcgacgacacggcccgtggacgagggtacttaggagttggaagtgggatcggaactacgaacccgtaaggngttggtacgaacacgagcctacgtgaccgacgaggtacggttcgaagggacgacgggtacgaccgtagtaggtaggtggtacgacgaccgggacccgacggacgaccggtaccgtacccgactaagtaccggtaaccttaccgtaagtccgtaggaacgttacgtacggaacggaaccgtacgggttacccgtttaccgttcgtaggtacgccggaaccggaccccggtacggtaccggggaaaccggggggttccctaaccgggtacccggtaggtacggtaacccgggg

SEQ ID NO: 120951 - DNA, 865 bp, Homo sapiens
  misc_feature: GYAE6OF01CN26W.41.2.A02.1.454.CMB.1.raw
tcagtctatactatcacgaccggtgctcgatttagactcatctacgagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctaggaggtgaggaacgccgtggggcctcgaggtgaagctctcctgacaaggtactttcgtggtaactacgtacggtttacaacgtactttacgtaataacgtaaccacggttgggttacgaccgaacgtaccggccccgttagggaaccgtaggggtacctttggaacggtgggtaagtaggggaagttacgggtaacttaacccgtaaaacccgttaagggtaacggttcgggtaacggaaccgtaaccgaacggtcccttacggtacggacccgtaaacggtaacgggttaccgggttacccggaacggggtaccggtaaccggggttacccgaacccggtaggttacgggaacgggttacgggtacggaacccggtaaccgggacccgtaaacgggacggtacccggtaacccgggttacccaaaccgttaacggttaaccggtaaaccctttaacccggaacggtttaccgtaacgggttaaacgttccggtaacgggaaccggtaaaccccggttaccggtttacccgtttttaaccgtccggttacgggttaccggaaccgggtaaccccgggtacccccgggtacgggttaaacccggggggtacccggggggttacccttaacgggttacccgggttacggtaaccgggtaaccccgggg

SEQ ID NO: 120952 - DNA, 647 bp, Homo sapiens
  misc_feature: GYAE6OF01B3I6H.41.2.A02.1.454.CMB.1.raw
  modified_base (249)..(249): a, c, t, g, unknown or other
  misc_feature (249)..(249): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagtacttcgnggatacgaggttcaacgtactttcatatacacgtggtgcgacgacggccctggacagggacttggagtggaagtgggactggactacgaaacctaaggaggtaggtgaacacgacgtccgtactgaccgacgaggtacggttaccgagggaccgagggtaccacgtagtgaggttggacgacggaccggccgaacgacgacgaccggtacaacgtagtacggaacttacccgagttaccgtagtaacgtcgtaggaacggtaccgaccggttaccgttttaacgtccgttaggtccggacggttaaccccggacccccgggtagggttaaccggggggtaaaccccggggggttccttaacccgggttaacgggttcccgtacgggttaaccccgggg

SEQ ID NO: 120953 - DNA, 574 bp, Homo sapiens
  misc_feature: GYAE6OF01AP1NQ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacaggaggttccgagggcagggtcaccgatgagtggtgacgacggccacggagaccgaccggtccactacgtacggaaccttaccgacgtacgtaggaacgttcgtacggaacggaccgtaccggtacccgttttaacgttccgtaggttcggaccggtacggacccccggcgtacgggggaaccgggggtcctaacggtaccggttcgtacggtacccgggg

SEQ ID NO: 120954 - DNA, 544 bp, Homo sapiens
  misc_feature: GYAE6OF01E21AR.41.2.A02.1.454.CMB.1.raw
  modified_base (280)..(280): a, c, t, g, unknown or other
  misc_feature (280)..(280): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtncgacaggcccctggacagggacttgagtggatgggatggatcgaaccctagagtggtgacacagcctctgcacaggacggttccgagggcgagggtcgaccagtgagtggtgacgacggccgacgacgccgacggtacccacgactcggaaccttaccgtagtactagaagtcgtagacggtacgacggtccgttacgttcgtgtgcggacgaccccgcggtacgggaaccggggggccgtacgtacgggtcgtaggtaccggg

SEQ ID NO: 120955 - DNA, 627 bp, Homo sapiens
  misc_feature: GYAE6OF01BVP7P.41.2.A02.1.454.CMB.1.raw
  modified_base (359)..(359): a, c, t, g, unknown or other
  misc_feature (359)..(359): n is a, c, g, or t
  modified_base (372)..(372): a, c, t, g, unknown or other
  misc_feature (372)..(372): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtggggcctcgagtgagctctccgtgacaagtacttcgtaggactacgtaggttcaacgtacttctatatacacgtgggtcacgacacggccctggacgagggacttggagtggagtgggataggactacgaaacctaaggagtggtanacgacagtcctcngacacgaggtacggtccgagggacgagggtacaccgagtggtacggtggtagaccgtaccggccgaacggacgaccgaccgtcaactaggtacgtaaccttacgagttacgtagaacgtgtacggaacggtaccgtacgggttaccgttttaacgtccgtaggttacggaccgggtaccggaccccggtcgggttaaccgggggaccggggggtacccttaaccggggtacggttacggtaagggtaccccgggg

SEQ ID NO: 120956 - DNA, 739 bp, Homo sapiens
  misc_feature: GYAE6OF01BM4AQ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctctgcaagacttcgtaggactacgaggttcaacgtacttctatactacacgtgggtcgacgacgacggccctaggacgagggtacttggaggtggagtagggagtaggactaccgaaaccgtaaggaggtaggtacgaacgtacgacgtcctacgtcgacgaacgtaggtacgggttaccgaagggtaccgtaacggggtccaaaccgtaggtacgggtaggttacgggtacggaacccgtaaccgggaccgaaaccggtacggaccggtaacccgggttacccaacggtacgtaaccggtaaccgtttaaccgacggttacgttaacggaacgttaccggtagggtaaccggtaaccgtaaccccgggttttccgttttaaccgttcgggttaccgttaccgggacccggtaacccggtacccccgggttacgggtaaccggggggtaaaccccgggggtacccttaaccgggttaccggtacccggtaacgggttaaccccggggg

SEQ ID NO: 120957 - DNA, 645 bp, Homo sapiens
  misc_feature: GYAE6OF01DM0AI.41.2.A02.1.454.CMB.1.raw
  modified_base (188)..(188): a, c, t, g, unknown or other
  misc_feature (188)..(188): n is a, c, g, or t
  modified_base (363)..(363): a, c, t, g, unknown or other
  misc_feature (363)..(363): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacaggacgcccactctcaggtgcagctgatgcngtcgtggggctggaggtgaggagcgtgggcctgagtgacgctctcctgcaagtacttcgtggatacgaggttcaaacgtcttctatatacacgtggcgtcgacgacggcccctggacgaggtacttgagtggagtgggattggactacctaaaccgtaggtagtaggtcgaaacncgaaccgttcctacggtcacgtaacgtagggtacgggtttacccggacggggtaaccgtagggtaccgaacccgtaaggttacgggaacggttgggtaacgaaccggaacccgggaccgaaaccgggacgaccgtaccggtaccaacggtaacgtacggtaaccttaccgacgttcgtagacgtcgaggacggacgtacggttccgttacttgtcgtgaccggcccgacccggtcggaacggggaccggggtacctaacggtccggtcgtaggttacccggg

SEQ ID NO: 120958 - DNA, 776 bp, Homo sapiens
  misc_feature: GYAE6OF01CN01P.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgacttctatatacacgtggtgcgacgacggcccgtaggacgagggtacttggagtggagtgggatggactaccgtaaacccgtaaggaggtggtagacgacacgcctcgtcgaccaacgaggtacgggttaccgagggaccgtacggggtaccaaccgtagtacggaggttagggtacggaaccggaaccgggacccgtaacgggacggtaccggaacccgggttacccgaaccgtaacggttaaccgggtaaacccgtttaaccccgtaacgggttaccgttaacggtaaacggttaccgttacgggaaaccgggtaacccggtaaacccggggtttaccccggtttttaacccgtttaccggttcgggtttaccgggtacccgggtaaaccccgggtaaccccccccgggtaccggggttaaacccggggggtaaaccccggggggggggttacccccttaacccggggtttaaccccggggtttaccggttaacccggggttaaccccggggg

SEQ ID NO: 120959 - DNA, 615 bp, Homo sapiens
  misc_feature: GYAE6OF01CSOQI.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaacgtactttcgaggtatacgtaggttaccaacgacttactatatacacgtggtgcgacgacggcccctggacgagggacttggagtggatgggataggatacgaaacccgtaagagtggtacacactacgcctcgtagaccacgagtacggttccgagggcgagggtaccaccgagtgaggtaggtacgacgaccggcccgacggacgccgaaccggtaccaacgagtacggtaaccttaccgacgtctaggaacgttcgtaggaacgtaccgtaccggtcccgtttacgttccgttggtccggtacgaccggacccccggtcgggtacggggtaaccggggggtacctaacggttaccggtcgtacggtacccgggg

SEQ ID NO: 120960 - DNA, 655 bp, Homo sapiens
  misc_feature: GYAE6OF01CV8X3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtgcagctgatgcagtcgtgggctggaggtgaggaacgcgtcggggcctgagtgacgctctccgtgacaagtctttcgaggtactacgtaggttacaacgtacttctatatactacgtggtgccgacgacggcccgtaggacgagggtcttgaggtggagtggatggactacgaacgtagacggtgtacgacacgacgtcctcgtcgacacgacggtacggtccggagggaccgtacgggtaccaacgtagtggtaaggtcggtacgaccggccggaccgaacggaccgaccgtacccgggtaccaacgtacggtaaccggtaaccttaccgtagttaccttaggacgtacgtacggaaccggtacggttaccggttcccggtttacgtccggttcgacggtacccggtacggacccccggtagggtaccgggggtaacccggggtcccttaacggtacccgggtgtaccgggtacccggg

SEQ ID NO: 120961 - DNA, 528 bp, Homo sapiens
  misc_feature: GYAE6OF01ANPJ4.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacacggcccctggaccagggacttgagtggagtgggatggatcaacccgtaagagtggtgacacagccctctgcacagtaggttccagggcagggtcaccatgagtggtgacgacggccacgagccgacggtccacgagtgaaccttacgacgttctagagttctagaggaccaccggtccgtttacgtcgtcgtgcgcgaccccgtcgtcggaccgggggtcctacgtacggtcgtagtaccggg

SEQ ID NO: 120962 - DNA, 620 bp, Homo sapiens
  misc_feature: GYAE6OF01BXOPP.41.2.A02.1.454.CMB.1.raw
  modified_base (367)..(367): a, c, t, g, unknown or other
  misc_feature (367)..(367): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacgaggttacaacgacttctatatacacgtgggtgcgacgacggcccctggacgagggacttggagtggagtgggatggactaccgaaccgtaaggagtggtagacacgagccctcngacacgaggtacggttccgagggcgacgggtacaccgtagtaggaggtcgggtacgaccgaccggacccgaacggacggaccgaccgggtaccaacgtacgtacggtaaccttaccgacgttacgtaggaacgttcgacggacggaccgtaccgggttccgtttacgttcggtcgtcggacggtacgtaccgtccccggtacgggtacgggggacccgggggtacccttaaccgggtccgggtcgtaaccggg

SEQ ID NO: 120963 - DNA, 700 bp, Homo sapiens
  misc_feature: GYAE6OF01DFBA5.41.2.A02.1.454.CMB.1.raw
tcagtctatactatcacgaccggtgctcgatttagactcatctacagggggagcatcacccagcaaccacatctgtcctctagagagtcccctgagagctacgttcctcaccatggactggacctggaggatcctcttcttggtggcagcagccacaggagcccactctcaggtgcagctgatgcagtcgtggggctgaggtgaggaacgccgtggggcctcgagtgaagctctcctgacaagtacttcgtaggatacgtaggttacaacgtaccttactaattataaccacggttaggggtgaccggaacgaccgggcccccgtagggaccgtacggggtacttgggaaggtggaagtgggaatggacttaccgaaaccgtaaaggacggttaggtacgacaacgcgtccttcgagaccaaggtacgtacgggttacgaacgggtccgtagggtccaacgtagttaggacggtaggtacgaccgtaccggaccgaacggacgaccggtaaccgtaccgtaaccgagttaaccggtaaccttacccgaagttcgtaggtaacgtacgtacggacggaaccgtaccggttacccgttttaacgtcgttcggtacggaccggtaacccggtccccggtacgggtacgggggtaacccgggggtacccttacgggttaccggtaccggtacggttacccgggg

SEQ ID NO: 120964 - DNA, 641 bp, Homo sapiens
  misc_feature: GYAE6OF01BXFVG.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgagctctcctgcaagcttctggatacgaggttcaacgtacttctatactacacgtgggtgcgacgacggcccctggaccgagggacttggaggtggagtgggtatgggactaccgaaacccgtaaggaggttaggtacgaacgacgaacgtcccttacgtcgaccaacgtaacggtacgggtttacccgaggggtccgtaacggggtaccaacccgtagtagggaggttacgggtcgaacggacccgggaccgacggacgcccgaccggtacccacgtaacgtacggtaaccttaccgagttacgtagtaacgtcgtaggaacgacgtaccggtccgtttacgtcgtcggtacgacggccggaccccgtggtaccggggaacggggtccctacggtccggtcgtaggtacccggg

SEQ ID NO: 120965 - DNA, 764 bp, Homo sapiens
  misc_feature: GYAE6OF01DAVYX.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcagctgatgcagtcgtgggctgaggtgaggacgccgtggggcctgagtgagctctccgtgcaagtcttcaggtaatacgaggttacaacgtacttcatatacctacgtggtcgcgaacgccggtcccgtaggaacgagggtacgttggaggttaggacgtagggatacgggtaactaaccgaaacccgttaaggtacggttagggacgaaccgtaaccgtacgtacccgtttcggtaacgacccgtaaacgaacgggttacgggttacccgggaaggggtaccgaaccgggtccgtaaaccgtaggtcggggtaaggtacgggtaacgaaccccggacgggacccaaaccggacggtacccgtaacccggtaaccgaacgtaacggtaaccggtaaacctttacccggaagtttacccgaaggttaacggttccgtaacgggaaccggtaaccggttaccgggtttacccgttttacgtcgttacgggtacggtacccggacccgggtacccccggttacgggaccggggggtaaaccccgggggttcccttaacgggtaaccgggttccgtaccggtaacccgggg

SEQ ID NO: 120966 - DNA, 535 bp, Homo sapiens
  misc_feature: GYAE6OF01A31KM.41.2.A02.1.454.CMB.1.raw
  modified_base (496)..(496): a, c, t, g, unknown or other
  misc_feature (496)..(496): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactggtgcgacaggcccctggacagggacttgagtggatgggatggatcaaccctaagagtggtgacacagcctctgcacgagacggttccgagggcagggtcaccgagtgaggtggtacgacgacggccacgacggccgacggtccacacgttcggaaccttaccgagtctagtaagtctaggacggacacgggtcctttacttcgtcgtgcgcggaccccgnggtcgggaccgggggtcctacgtacggtcgtaggtccgg

SEQ ID NO: 120967 - DNA, 657 bp, Homo sapiens
  misc_feature: GYAE6OF01CVAHE.41.2.A02.1.454.CMB.1.raw
  modified_base (186)..(186): a, c, t, g, unknown or other
  misc_feature (186)..(186): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcngtcgtgggctggaggtggaggaacgccgtggggcctcgagtgaacgctctcctagcaagtacttcgtggtaactacgtaggttacaacgtactttcctaatactacgtacgtaggtcgcgacgacggtccccgtagggacgagggtactttggagtggagtggagtggataccaaaccgtaggtacgtgtacgaacacgaacgtccctgtacgaccaacggacgggtacggttaccggaacgggcctacggggtaccaaccggtagtcgggtaggtcggtacgaccgaacggccgaacggcgtaccgaccggtaccaagtacggtaacgtaaccgtacgtagtcgagtacgtcgtaggaacggacgtacccggttctttacgtacggttcgtacgggcccggtacggacccccggttgggtaccggggtaacccggggtacttacgggtaccggtcggtaccggtaccggg

SEQ ID NO: 120968 - DNA, 626 bp, Homo sapiens
  misc_feature: GYAE6OF01DJNZ8.41.2.A02.1.454.CMB.1.raw
  modified_base (166)..(166): a, c, t, g, unknown or other
  misc_feature (166)..(166): n is a, c, g, or t
  modified_base (174)..(174): a, c, t, g, unknown or other
  misc_feature (174)..(174): n is a, c, g, or t
  modified_base (191)..(191): a, c, t, g, unknown or other
  misc_feature (191)..(191): n is a, c, g, or t
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
  modified_base (562)..(562): a, c, t, g, unknown or other
  misc_feature (562)..(562): n is a, c, g, or t
tcagtctatactatcacgaccggtgctcgatttagactcatctacagggggagcatcacccagcaaccacatctgtcctctagagagtcccctgagagcctccgttcctcaccatggactggacctgggaggatcctcttcgttggtggcagcagccacgaggacncccactcncaggtgcagctgatgcngtcgtgggcgtggaggtggaggaacgtccggtgggcctagaggtgaacgtctcctcgtacgacaagtactcgtagtagtacgtagttacgaactacttactataagtactagnggtcgacgacgcgcccgtaggacgtacggtagtagngtggagtggagtagacgacgtaaccgtaaggngtaggtcaacgacgacgcctcgacgtacgacggtagtaccgggtacgaagggacgacgggaccaacgtgtacgggtaagtcggaacggaacgtaccgaccgaagcgactaccgtacaaacgtgaaccgtaaccgtacgaggttacaacggtctacggtagaaccggttacgccggtttacgtacttcggnggttacgacccggtcggaccgtagggaccgggtaccggacttacggtagtcgtaacggtccggg

SEQ ID NO: 120969 - DNA, 747 bp, Homo sapiens
  misc_feature: GYAE6OF01CVE5A.41.2.A02.1.454.CMB.1.raw
  modified_base (248)..(248): a, c, t, g, unknown or other
  misc_feature (248)..(248): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgagggtgaggaagccgtggggcctcgagtgaagctctcctgcaagacttcgnggatacgaggttacaacgcttactatatacacgtggtagcgacacggcccctggacgagggacttggagtggagtgggatggactcgaaaccctaaggacgtggtacgaacgacgaacgcccttcgtacggtaccaacgtacgggtacggttacccggaacggggtcgaacggggttaccaacccgtaagtacggtaaggttacgggtacggacccgaccgggacccgaaacggaccggaccgaaccccgggtacccgaaccgtaacggtaaccgggtaaaccctttaacccgtaacggttccgtacggtaacgttacccggtagggaacgggtacccggtaaccgggtacccgttttttaccgttacggtttcgggtacggtacccgggacccgggtaacccccgggtaccgggttaccggggggtaaacccgggggggggtaccccttaaaccgggttaccccggggttaaccggttaaccgggttaaccccggggg

SEQ ID NO: 120970 - DNA, 585 bp, Homo sapiens
  misc_feature: GYAE6OF01BQQBQ.41.2.A02.1.454.CMB.1.raw
  modified_base (284)..(284): a, c, t, g, unknown or other
  misc_feature (284)..(284): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcgagtgaagctctcctgcaagacttcgtggatacaggttcaacgtacttctatatacacgtgggtcncgacacggcccctaggaccgagggacttggacgtggagtgggtatggactacgaaccctaaggagtggtgacacgagcctctcgacacgaggtacggttcgagggcgagggtaccacgtagtaggagtaggtcgacgacggaccgacggtagccgaaccggtccaacgacgtacgaaccttaccgagtcgtagacgtcgtagacgaccgtacggtccgtttacgttcgtcgtaggacggtacccgacccggtggtacggggtaccgggggtaccctacggtacggtcgtaacggtaaccgg

SEQ ID NO: 120971 - DNA, 660 bp, Homo sapiens
  misc_feature: GYAE6OF01B5HXH.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggcctcgagtgaagctctcctgacaagacttcgtaggatacgaggttaccaacgtacttctatatacagtgggtcgcgacacggcccctggacgagggacttggacggttggagtgggatggaataccgaaacccgtaaggtacggtggtacgaacacgacgtcctcgtagcaacgtaggtacggttaccgaggggaccgaggggtaccaccgagtaggagtggtacgacgacgacccgacgacgaccgaccggtaccacgtacgtacggtaaaccttaccgagttaccgaggtaacgtcgtacgggacgtaccgtacccggttaccgtttaaccgttcgttacgggtcgaccggtaacccggtacccccgggtacggtacggggggtaacccggggggttcccgttaaccggttaccgggttaaccggtacgggttaacccgggg

SEQ ID NO: 120972 - DNA, 675 bp, Homo sapiens
  misc_feature: GYAE6OF01DK38Z.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtggaggagccgtgggcctcgagtgaagctctcctgacaagacttcgtaggactaccgtaggttacaacgtacttactatactacacgttgggtgccgacgacggcccctagggacgagggtacttggacggtggacgtgggtatgggactacgaaacccgtaaggagttggtacgacactacgtcctcgtacgaccacgaggtacggttccgacgggtcgacgggtccaccgagtgtaggtggtacgaccgtaccgggaccaacggacggaccgtaaccgggtaccaaccgtaggttaaccggtaaccctttaaccggtacgttccgttagggtaaacgttcggtacggtaacggaccgtaccgggttcccgttttacgttccggttaggtcggaccggtaccggacccccggttcggtacggggggtaacccgggggtaccttaccggtaccggtccgtagggttaccccggg

SEQ ID NO: 120973 - DNA, 673 bp, Homo sapiens
  misc_feature: GYAE6OF01AUEU3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagccgtggggcctcagtgaagctctcctgcaagacttcgtggatacgaggttcaacgtacttcgtatatacacgtgggtcgcgacacggcccctggacacgggacttgacgtggatgggatggactacgaaccgtagagtggtcacgacgacgcctgtcgcgacgtacggtacggtaccgagggcgacgggtacaccgagtacggaggtacgggtacgaccgacggtacccgacggtacgacccggtaacggtcccgaacgtacgttaccggtaaaccgtttaaccgtacggttaccgtacgtaaacggttaccgtagggaacggtaccgtaaccgggttacccgttttaccgttaccgtacggtttaccggaccggttaaccggtacccccggtacggttaccgggggtaaacccggggggtcccttaaaccggttaccgggttacgtaaccggggttaacccgggg

SEQ ID NO: 120974 - DNA, 617 bp, Homo sapiens
  misc_feature: GYAE6OF01DWHTS.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtggggcctcgagtgaacgctctcctgcaagcttcgtggatacaggttacaacgtacttactatatacacgtgggtgaccgacgacggcccctggacagggtactggacgtggagtgggatggactaccgaaaccgtaggagtggtcgaacacgacgtcctcgtgccacgaggtacggttccgaagggtcgaacgggtccaactagtggtacggtgggtacgaccgacgggtccaacggacgcgaaccggtccaacgtagtacgtaaccttaccgagttcgtaggtacttacgaggacggcgtaccggttccgtttaacgttcggtcgtcggaccggaccggtaccccggtaggtacggggggtaacccggggtccttaaggtaccgggttcgtacgggtacccggg

SEQ ID NO: 120975 - DNA, 576 bp, Homo sapiens
  misc_feature: GYAE6OF01BGQV2.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttcgtggatacgaggttcaacgacttctatatacactgggtgcgacacggcccctggacagggcttgagtggagtggatggatcgaacctaagagtggtagacacagcctctgcacgagacggttccgagggcagggtccaccgagtacggagtggcgaccgaccggaccgacggacgccgaaccggtcccaacgagtaccggtaaccttaccgacgttacgtagaacgtcgtagacggtacgtaccgggtcctttaccgtcgtcggtcgcggtacgaccccggacgtacggggaacccgggggtcctaaccggtcggtcgtaaggtacccggg

SEQ ID NO: 120976 - DNA, 627 bp, Homo sapiens
  misc_feature: GYAE6OF01B64R5.41.2.A02.1.454.CMB.1.raw
  modified_base (358)..(358): a, c, t, g, unknown or other
  misc_feature (358)..(358): n is a, c, g, or t
  modified_base (577)..(577): a, c, t, g, unknown or other
  misc_feature (577)..(577): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagacttcgtggatacgtaggttcaacgtacttctatatacacgtgggtcgcgacacggcccctaggacgagggtacttggacggtggagtgggagtggactaccgtaaacccgtaaggngttaggtacgaacacgaggccctgtgaccaacgaggtacggttccgagggcgacggggtacaccgtagtaggtaggtcggtacggaccgtaccgggaccgaacggacggaccgaccggtccaacgtacgtacggtaaccttaaccgagttaccgtagtacgtcgtaggacggtaccgtacggttcccgtttagtcgtgtcgaccggaccgtaccccggnggtacgggggaaccggggtccttaacggtacggtcgtacgggtacccggg

SEQ ID NO: 120977 - DNA, 626 bp, Homo sapiens
  misc_feature: GYAE6OF01ADONR.41.2.A02.1.454.CMB.1.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaacgctctcctgacaagacttcgnggatacgaggttcaacgtacttctatactacacgtgggtnccgacgacggccctaggacagggacttggagtggagtgggatggaactaccaaccgtaggagtggtacgacacgngcctntgacagacggacggttccgagggtcgacgggtcacgtagtgtacggtcggtagaccgtacggccgacgacgtaccgtaccggtccaacgtacgtacggtaaccgttaccgtagttacgtacgtacgttcgacggtaacggtaccgtaccggttacccgtttaccgttcgttcggttacgaccggtacccggaccccggtacggtaccggggtaaccggggggtacccttacggtaccggttccgtaacggtacccggg

SEQ ID NO: 120978 - DNA, 611 bp, Homo sapiens
  misc_feature: GYAE6OF01BT3WE.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacaggttcaacgtacttctatatacactgggtgcgacacggcccctggacagggacttggagtggagtgggatggatcaacccgtaagagtggtgaacacagcctcgtgacacgagtacggttccgagggcagggtccaaccgtagtggaaggtgggtacgaccgacggtcccaacggacgaccgaccggtcccaacgtagtacggtaaaccttacccgagttacgtaggtaacgtcgtaggaacggaccgtacggttaccgtttaacgttccgtcggttcggaccggtacggacccccggtcggtacgggggtaaccggggggtacccttaaccgggtaccggttcgtacggtacccgggg

SEQ ID NO: 120979 - DNA, 572 bp, Homo sapiens
  misc_feature: GYAE6OF01EC4OM.41.2.A02.1.454.CMB.1.raw
  modified_base (526)..(526): a, c, t, g, unknown or other
  misc_feature (526)..(526): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttcgtggatacaggttcaacgtacttctatatacactgggtgcgacacggcccctggacgagggacttgagtggagtgggagtggatacgaaaccgtaaggagtaggtcgacacgagcctctgcacgagaggtccgagggcgagggtcaccgagtgagtggtcgacgacggccacgacgccgacggtccacgagtacggtaaccttaccgacgtacgttagaacgtcgtaggaacggacgaccgggttccgtttacgttccgtgtgccggtacggtacccccgnggtacggggaccgggggtaccctacggtacggtcgtaggtacccgg

SEQ ID NO: 120980 - DNA, 586 bp, Homo sapiens
  misc_feature: GYAE6OF01APM4M.41.2.A02.1.454.CMB.1.raw
tcagtctatactatcacgaccggtgctcgatttagactcatctacagggggagcatcacccagcaaccacatctgtcctctagagagtcccctgagagctccgctcctcaccatggactggacctggaggatcctcttcttggtggcagcagccacaggagcccactctcaggtgcagctgatgcagtctggggctggaggtgaggagccgtggggcctcgagtgaagctctcctgcaagtacttcgtggatacaggttacaacgtacttctatatacacgtgggtgcgacgacggtccctggacagggtacttggagtggagtgggatggactaccgaacccgtaaggaggttggtacgacacacgtccctcgtcgacacgacgtacggttaccgagggccgacgggtcaccgagtcggaggtggacgaccgacggccgacggcgccgacggtccacgtagtacggtaacttaccgagtacgtagtagtctaggacggacgtaccgggtaccgtttacgttcgtggtcggccgaccgacccggcggtacgggggaccgggggtacctaccggtcggtcgtacggg

SEQ ID NO: 120981 - DNA, 657 bp, Homo sapiens
  misc_feature: GYAE6OF01EZ6WM.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggagccgtggggcctcgagtgaagctctcctgcaagtacttctggatactaggttacaacgtacttctatatacgacgtgggtgcgaccgcggtcccccgtaggacgagggtactggagtggagtgggatggactacgaaaccgtaggagtggtagacacacgcctcgtcgaccacgtacggtacgggttccgaacggggtaccgacggggtaccaaccgtagtacggaaggtgggtacgaccgtaccgggaccgaacggacgaccgtaccggtacccaagtacgtaacggtaacccttaccgaacgttacgtacgtacgtccgtaggaaccggaccgtaccggttccgtttaccgttcgttcggtccgacggtacccggacccccggtacgggtaccgggggaacccggggggttacctaaccgggtaccggttacgtaccggtaacccggg

SEQ ID NO: 120982 - DNA, 616 bp, Homo sapiens
  misc_feature: GYAE6OF01B1T3B.41.2.A02.1.454.CMB.1.raw
  modified_base (415)..(415): a, c, t, g, unknown or other
  misc_feature (415)..(415): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcagtgagctctctgcagcttcgtgatacgaggttacaacgtacttctatatactacgtgggtcgcgacgacggccccgtggaccgagggtacgttggaggtggagtgggagtggataccaaccgtaagtagtgggtacgacacacgtcctcgtcgcacgaggtacggttacgacggtcgacgggtcacgagtggnggtggcgacgacgccgacgcgccgaccggccacgtagtacggtaacctaccgagttcgacgtaagttcgaggacgtacccgtaccggttccgttaccgtttcgtcggtcggacccggtaccggtacccccggtacgggttaaccgggggaacccggggggtaccccttaaccggggtcggttaccggtacggtacccgggg

SEQ ID NO: 120983 - DNA, 547 bp, Homo sapiens
  misc_feature: GYAE6OF01EDZU2.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgaagctctcctgcaagacttctggatacaggttcaacgacttctatatacactgggtgcgacacggcccctaggaccagggtacttggagtggagtgggatggatcaaacccgtagagtggtgacacagtcctacgtgctaacgaggtacggttcgagggcgagggtcaccgagtggagtggtagacgaccggaccacgagccgacggtaccacagacggtaactaccgagtcgtagacgtcaggtacgacaccggtcgttactcgtgtgcggaccgacccggtcgacgggtaaccgggggtcctacgtacggttcgtaggtacgg

SEQ ID NO: 120984 - DNA, 662 bp, Homo sapiens
  misc_feature: GYAE6OF01A8L7S.41.2.A02.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (602)..(602): a, c, t, g, unknown or other
  misc_feature (602)..(602): n is a, c, g, or t
tcagtctatactatcacgaccggtgctcgatttagactcatctacagggggagcatcacccagcaaccacatctgtcctctagagagtccctgagagctccgttcctcacatggactggacctggaggatcctcttcttggtggcagcagccacaggacgcccatctcaggtgcagctgatgcagtcgtgggctggagtgaggagcgtgggcctgagtgaagctctccngcaagacttcgnggactacgacggttnaaccgtacttctatactaacacgtgggtagcgtacaggccctaggaccaggggaccttggaacgtggagtcgggtaagtcggacttacgaacccgtttaaaggacggtacggttcggaaacaccgaacgggtaccctttcggtcggaacctaacggtaacgggtaacggggtttaccccgaaggggtaccgtaacgggggttaaccaacccgttaaggtcgggtaaacgtcggggttacaaccgggtaaccggccgtaacggacggtacgaaccggttaccgaactaacgtcggtaactaccggacgtcgtagacgtcgtaggacgtcgacgtccgtttatcgtgngtaccggtacgacccggtagcgggtaacgggggccttaacgtacggtgtaacgtaccggg

SEQ ID NO: 120985 - DNA, 572 bp, Homo sapiens
  misc_feature: GYAE6OF01CB3J5.41.2.A02.1.454.CMB.1.raw
  modified_base (286)..(286): a, c, t, g, unknown or other
  misc_feature (286)..(286): n is a, c, g, or t
  modified_base (337)..(337): a, c, t, g, unknown or other
  misc_feature (337)..(337): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacaggttcaacgacttctatatacactgggtgcgacnggccctggacagggtactgagtggatgggatggatcaacccgtagagtggngacacagcctctgcacgaggtagtccgagggcagggtcaccgagtggagtggtgacgacggccacggacgaccgacggtccaacgagtacgggtaaccttaccgtagtcgtagtaacgtcgtagacggacgacggtaccgtttacttcgttcggttcgccggtacggacccccggtacgtacggggaacccggggggtccgttaaccggtcgggttccgtagggtaaccccgggg

SEQ ID NO: 120986 - DNA, 605 bp, Homo sapiens
  misc_feature: GYAE6OF01CH9M3.41.2.A02.1.454.CMB.1.raw
  modified_base (218)..(218): a, c, t, g, unknown or other
  misc_feature (218)..(218): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (294)..(294): a, c, t, g, unknown or other
  misc_feature (294)..(294): n is a, c, g, or t
  modified_base (422)..(422): a, c, t, g, unknown or other
  misc_feature (422)..(422): n is a, c, g, or t
  modified_base (553)..(553): a, c, t, g, unknown or other
  misc_feature (553)..(553): n is a, c, g, or t
tcagtctatactatcacgaccggtgctcgatttagactcatctacgagggggagcatcacccagcaaccacatctgtcctctagagacgtcccctgagagctccgttcctcaccatggactggacctggagatcctcttcttggtggcagcagccacgaggacgcccactctcgaggtgcagctgatcgcagtcgtggggctggaggtgaggagccgngggcctgagtgagctctcngacaagtaccttnggatacgtaggttacaacgtacttctatagtacgacgtgggtcncgacgacggtccccgaggaccgtagggtacttggagttaggagtagggactggactacaaaccgtaggagtgacacactacgtccctgacgcgaacgaggtacggtccgagggcgaacgggtcaacgngttaggaggtcggacgaccgacgacgtacgacgtacgtacggaccaacgacgtacggtaaccttacgacgtacgtaacgtacgtcaggaacgacgtaccggttccgtttaactcgtgtccgacggtacccncccggtaggtacggggaccggggtaccctaaggttccgagttacggaccggg

SEQ ID NO: 120987 - DNA, 645 bp, Homo sapiens
  misc_feature: GYAE6OF01DJAON.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctggaggtgaggaacgccgtgggcctcgagtgaagctctcctgacaagtacttcgtaggatacgtaggttacaacgtacttactatactacaacgtgggtgcgacgacggccccgtaggacgagggtacttgaggtggagtgggatagggtactaccgtaaacccgtaaggaggtgggtacgaaccacgtaacgtccctagtacgaccaacgtaggtacgggttaccgagggcgaacggtcaaccgagtgaggtgcgacgacggccgacgacgccgacggccaacgtacgtacgtaaccttaccgagtccgtaggtaacgttcgtaggacggtacgtaccgggttccttttacgtccggtgtcggacggtaacccggaccccggtagggtaccggggggtaacccggggggtaccttaccgggtaacggtccggttacggtacccgggg

SEQ ID NO: 120988 - DNA, 680 bp, Homo sapiens
  misc_feature: GYAE6OF01DCE8B.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaacgccgtggggcctcgagtgaagcgtctcctgacagtacttctggactacgtaggttaccaacgtactttctaatatacacgtgggtcgtacgacgacggcccctggacgagggtacttggagtcggagtgggataggactaccgaaacccgttaaggacggttgggtacgaaccgactacggcccttctacggactaacgaacggttacgggttaccgaggggccgtaacggggtaccaacccgtagtggtaacggttacgggtacggaaccggaccgggacccgaacggacggaccgtaacccgggaccaaccgtacgtacggtaaccttaccgagttcgtagtaacgttcgaggacggtacgtaccggtaccgttttacgtccgttggtacggtaccggaccggacccccggtggtacgggggtaacccggggggtacctaccgggttaccggtcgtacggtacccgggg

SEQ ID NO: 120989 - DNA, 687 bp, Homo sapiens
  misc_feature: GYAE6OF01CMVNL.41.2.A02.1.454.CMB.1.raw
  modified_base (367)..(367): a, c, t, g, unknown or other
  misc_feature (367)..(367): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctcctgcaagacttctggatacgaggttacaacgacttctatatactacgtgggtcgcgacgacggccccgtggacgaggggacttggagtggagtgggatggataccaaacccgtaaggacgtgggtagaaccncgaacgcctctgcaacgagtacggttccgagggccgaggggtccaaccgagtacggagttacgggttggaaccggtaccgggacccgtaacggacgacccggaaccgggttcccgaaccgtagtacggtaacccttaaccgaacggttaccgttaggtaaacgttccgtacggaacggggtaccgtaaccgggttacccgttttaccgttacggttcggttacggccgggtaacccggacccccggtacggttacggggggtaaccccgggggggtaccttaacccgggttaccgggttccgtaacgggtaaccccgggg

SEQ ID NO: 120990 - DNA, 721 bp, Homo sapiens
  misc_feature: GYAE6OF01B11CL.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtgcagctgatgcagtcgtgggctgaggtgagaagcgtgggcctgagtgaagctgtcctgcaagtacttcgaggatacgtaggttacaacgtacttcgtataataaccgacgtgggtcgacgtacgacggtcccctggacacgggtacttggacgttaggagttgggattcggaactaccgaaaccgttaaggaggttcgggacgacctaacgacggtccctcgtacgaccgaacgtacgggtacggttcccggacggggtaccgtaacggggtacctaacccgtaagtcggtaaacgggttcgggtacggaacccggacggacccgtaaaccgacggacccgtaaccggtaccgtaaccgtagttaaccggtaaccgttaaccgtaacgttcgtaagtaacgttacgtaggaaccggtacccgtaaccgggttacccgtttaaccgttcgttacgtaccggacggtacccggaccccggtacgggtaccggggtaaacccgggggttcccttaaaccggtacgggttccgtaacgggtacccgggg

SEQ ID NO: 120991 - DNA, 677 bp, Homo sapiens
  misc_feature: GYAE6OF01D7CTZ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctcctgacaagtacttcgtggactacgtaggttacaacgtacttctatatacacgtgggtgcgacgacggccccgtaggacgagggtacttggaggtgagtgggatggacaccgtaaacctaaggtacggtaggtacgaacacgacggcctcgtgaccacggaaggtacgggttaccgaacgggtccgtaagggtaccaaccgtagtcggaaggtggtacgaccgaccggaccgacggacgaccgacggtacccacgtacgtaacggtaaccttaccggacgttacgacggtaacgtcgtacggaacgggtacccgttaacggggttcccttttaacgttccggtacggttcggaccggtaacccggaacccccggttcgggtaaccggggggtaaccgggggtacccgtaaccggttaaccgggtccggttacgggtaaccggg

SEQ ID NO: 120992 - DNA, 643 bp, Homo sapiens
  misc_feature: GYAE6OF01EASU6.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcagctgatgcagtcgtgggctgaggtgaggagccgtggggcctcgagtgaagctctcctgacaagtacttcgtaggatacgaggttaccaacgtacttactatatacacgtgggtcgacgacgacggcccctaggaccgagggtacttggaggtggagtggggatggaactaccgaaaccgtaaggtaggtagggtacgaaccacgacgtccctacgtcgaccgacgtacgggtacggttaccgacggggtacgtacggggtaccaccgtagtacggtaggtcgggtacgaccggtaccggaccacggacgaccgaccggtccacgtagtacgtaaccttaccgagtacgtagtaagtcgtaggacggtaccgtaccggttaccgtttacgttcgtcggtgaccggccggtacccggcggtaccggggtaccgggggtacctaccggtacggtcgtacggtaccgg

SEQ ID NO: 120993 - DNA, 614 bp, Homo sapiens
  misc_feature: GYAE6OF01EFBAY.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggcctcagtgaagctctcctgcaagcttctggatacgagttcaacgtacttctatatacacgtgggtgcgacgacggcccgtggacgagggtacttggaggtggagtgggatgggaactaccgaaacccgtaaaggaggttagggtagaacgacgacgtcctcgtacgacacgaggtacggttccgaggggcgtacgggtaccaccgtagtacggtaggtgggtacgaccgaccggacccgacgacgaccgaccggtaccacgtacgtacggtaaccttaccgagtacgtacgtacgtcgtaggacggaccgtaccggttccgtttacgttcgtcggtcgacggaccgcccggacggtacggggaccggggtacctacggtacggttcgtcggtaccggg

SEQ ID NO: 120994 - DNA, 680 bp, Homo sapiens
  misc_feature: GYAE6OF01CTEHX.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtgggcctgagtgacgctctcctgacaagacttcgtaggactacgtacggttacaacgtacttactaatactacgtacggtgggtcgacggacacggccccgtagggacaggggtacttggacgtggagtgggataggactaccaaaccgtaaggaggttggtacacgacacgtctactgactacgaggtacggttaccggagggacgtacgggtaccaccgtagtcggtaggtcggtacgacggaccggaccgtacgacggaccgaccggtacctaacgaacgttaccggtaaccgtttaccgaacgttcgtaaggtacgtgtacgggaacggtacccgtaccggttaccgttttaccttcggtacggtacgtacccgggtacccggtaccccggtaggggtacccgggggttaacccggggggtaccccttaagggttacccgggtccggttacggtaaccccgggg

SEQ ID NO: 120995 - DNA, 657 bp, Homo sapiens
  misc_feature: GYAE6OF01BQZCG.41.2.A02.1.454.CMB.1.raw
  modified_base (161)..(161): a, c, t, g, unknown or other
  misc_feature (161)..(161): n is a, c, g, or t
  modified_base (289)..(289): a, c, t, g, unknown or other
  misc_feature (289)..(289): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggancccactctcaggtgcagctgatgcagtcgtgggctgaggtgaggagccgtgggcctcgagtgaagctcgtcctgacaagtacttgtaggatacgtaggttccaacgtacttatatatactagtgggtnaccgacgacggtccccgtagggaccgagggtaccttggagtcggagtgggataggactaccgaaaccgtaagaggttaggtacgaaccacgacggtcctacgtacgaccaacgaggtaccggttccggacgggtcggtaacggtaccgaacgtagtacggtacggtacggtacgaccgtacggaccgaacggacgccgtaacccggtaccgtaagtaccgtaacgtaaccgttaaccgtacgtacggtacgtaacgttacggagaaccgggacgtaccggttccgtttacgtcgtacggtgaccggtaccgacccggtcgaaccggggtaccggggtccttaacgggtacggtcgtacgggtaccggg

SEQ ID NO: 120996 - DNA, 634 bp, Homo sapiens
  misc_feature: GYAE6OF01BGHGQ.41.2.A02.1.454.CMB.1.raw
  modified_base (290)..(290): a, c, t, g, unknown or other
  misc_feature (290)..(290): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagcctggggcctcagtgaagctctcctgcaagacttctggatacaggttcaacgtacttactatatacacgtgggtcgcgacncggccctggacgagggacttggagtggagtgggatggactaccgaaacccgtaagagtgggtagacgtacgaggtcctgtcgacaacgagtaacgggtttccgaggggtaccgacgggtacgaaccgtacgtaggtaggtacgggtaggaccgaccgggacccgaacgacggaccggaccggtacccaacgtacggtacggtaaccttacccgaacgttacgtaggtaacgttcgtaggaacggtaccgtaccggtacccgtttacgttcgtggtcgtaccggaccgaccccggcggtacggggaccgggggaccctacggtaccgggttcgtacggtacccgg

SEQ ID NO: 120997 - DNA, 641 bp, Homo sapiens
  misc_feature: GYAE6OF01BEYH5.41.2.A02.1.454.CMB.1.raw
  modified_base (285)..(285): a, c, t, g, unknown or other
  misc_feature (285)..(285): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggcctgagtgagctctcctgcaagtacttctggatacgaggttcaagtacttctatactactactgggtcncggacacggccctaggacgagggcttgacggtggagtgggatggatcgaaccgtagacgtggtacgaacacgacgtcctcgtgaccacggagtacgggttacccgaggggaccgtacgggtaccgaacgtaagtgggtaggtacgggtacggtaaccggacggtaccgaaccgacggccgaacccggtccaacgtacgtcggtaaaccttaccgtacgttactacgagttaccgaggaacggaccgtacggttccgtttaacgttcgtcggtacggtaccggtaccgaccccggtcgggtaacggggtacccgggggtaccgttacccggtacgggttccggacggttacccgggg

SEQ ID NO: 120998 - DNA, 599 bp, Homo sapiens
  misc_feature: GYAE6OF01DKULK.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctccgtgcaagacttcgtggatacgaggttacaacgacttctatatacacgtgggtgcgacacggccctggacagggacttggagtggagtgggatggatacaaacccgtagagtggtagacgacgacgtcctcgtgacacgaggtacggttaccgagggcgagggtcacgtatggaggtggtacgacgaccggccacggacgaccgtacggtccaacgacgtaacggtaacttaccgagttcgtagtaacgttcgtaggaacggtaccgtaccgggtaccgttttacgtcgtcgtcggcggaccggaccccggtcggtaccggggtaaccgggggtaccctaacggtacggtcgtcggtacccggg

SEQ ID NO: 120999 - DNA, 572 bp, Homo sapiens
  misc_feature: GYAE6OF01BKF5E.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctggggcctcagtgagctctcctgcaagacttctggatacgaggttcaacgtacttctatatacacgtgggtgcgacacggcccctggacagggacttgagtggagtgggatggatcaaacctaggagtggtgacacgagcctctgcacgagtacgggttccgagggcgacgggtcaccgtagtggaggtggtcgacgaccggccacggacgccgacggtccacgacgtacggaaccttaccgagtctaggtaagtcgtaggacggaccgtaccggttaccgtttacgttcgtcgtcggcggacggaccccgtaggtaccggggtaaccgggggccctaacggtcgggtccgtaaggtaccggg

SEQ ID NO: 121000 - DNA, 622 bp, Homo sapiens
  misc_feature: GYAE6OF01DQUIF.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgacagtacttcgtaggatacgtaggttacaacgtacttctatatacacgtgggtgcgacgacggccctggacgagggtacttggagtggagtggatggactaccgaaaccgtaaggacgtggtagaacgtacgacgtccttcgtcgacaacgtaggtacgggttacccgaagggaccgaacgggtaccaaccgtagtggtaggtagggtacggaaccgaccgggacccaacggacgccgtaccgggtaccacgacgtaacggtaaccttaccgagttcgtagagtcgtaggacggaccgtacggtcctttacgttcgtcgtgccgaccggaccccggtcggtacggggtacccgggggtacctacggtaccggtcgtacgggtaccgg

SEQ ID NO: 121001 - DNA, 641 bp, Homo sapiens
  misc_feature: GYAE6OF01BJC7L.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagccccactctcaggtgcagctgatgcagtcgtgggctgaggtgaggagcgtggggcctcagtgacgctctctgcaagacttcgtggatacgtaggttacacgtacttctatactactacgtgggtgcgacgacggtccccgtaggacgagggtacttacggaggtggagtgggataggactacgaaacccgtaaggaggttcggtacgaacgacgacgcccttcgtacgcacgaggtacgtccgagggtcgagggtaccaccgagtggaggtggtacgacgaccgggacccgacggacgaccgaccggtaccaacgtacgttaacgggaaccttaccgagttccgtagtaacgtcagggaacggtacgtaccgggttacccgtttacgtcgtcggtacggccggtacccggaccccggtcgggtaaccgggggtacccgggggtacttaacccgggtaccggtcgttacggtaccccgggg

SEQ ID NO: 121002 - DNA, 623 bp, Homo sapiens
  misc_feature: GYAE6OF01ENE28.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgagctctctgcaagacttctggatacaggttacaacgacttctatatacactgggtgcgacacggcccctggacagggtacttgagtggagtgggatggactcaaacccgtagacgtggtgacacacgtcctcgtgacacgagtacggttccgagggcagggtcaccgagtgagtggtcgacgaccggaccgacgacgcgacggtaccacgagtcggtaaccttaccgagttacgtacgtaacgtcgtacggaacggtaccgtaaccgggttcccgttttaaccgtttcgtcggttacggaccggtacccggtacccccggtacgggttaacccgggggtaacccgggggggggtaccccttaaccgggttacccgggtcgttaacgggtaaccccgggg

SEQ ID NO: 121003 - DNA, 647 bp, Homo sapiens
  misc_feature: GYAE6OF01BONTJ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctgaggtgaggagccgtgggcctcgagtgagctctcctgcaagacttcgtaggactacgagttacaacgtacttactaatactacgacgtgggtacgacgaccgacggcccctggacgagggtacttggaggtggagtgggatggactaccgaaacccgtaaggaggtggtacgaacgacacgtcctacgtgacacgaggtacggtcgaggcgacgggtcaccgtagtggagtggtacgaccgacggacacgacgccgacgtccaacgtagtacgtaaccttacgacgtacgtagtaacgtcgtacggaaccggtaccgtaccgggttaccctttacgttcggtcggtacggacccggtacccgggtacccccggtaccggggtacccgggggtaacccggggggttacccttaacccgggttaccggttaccggttaaccggtacccgggg

SEQ ID NO: 121004 - DNA, 738 bp, Homo sapiens
  misc_feature: GYAE6OF01BPJ2I.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcagctgatgcagtcgtggggctggaggtggaggagccgtgggcctgagtgagctctcgtgacagtacttgaggatacgtacgttacaacgtacttactatactacgtacgtggtcgacgaccgaccggcccgtaggacgaggtacgtaggaggtggagtgggtatacggtaactaaccgtaaaccgtaaggtaggtacgggtacgaacgacgtaccgtaccgtacgacggtaccgaaggtacgggtacgggttccggacggggtacgtaaccgggttaccgaacgtaacgtgggtaacggtagggtaaccggaaccgaccggaccggaacggaccggtaccggaaccgtacaaccgaaggtaccgtaaccttaccggtagttaccgtaggtaacgttcggaaggtaaccggtacggtaacccgggttaccttttaacggtccgttacgggtcggaaccccgggtaccccgggtaaccccgggtggggttaacccgggggggtaacccgggggttaccccgttaacgggttaccgggttaccggttaccgggtacccggggg

SEQ ID NO: 121005 - DNA, 640 bp, Homo sapiens
  misc_feature: GYAE6OF01DPXAF.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggacgccccactctcaggtgcagctgatgcagtctggggctggaggtgaggaagccgtggggcctcgagtgaagctctcctgcaagacttctggatacaggttcaacgacttctatatacactgggtgcgacacggcccctggacagggacttgagtggagtgggatggatcaaacccgtaagagtggtagacacgagacctctgcacgaggtaggttcccgagggcgacgggtcaaccgtagtaggaggtgggtacgtacgaccgggccgaacgacgaccgaccgggtccaacgtagtacggtaaaccttacccgtaagttccgtaggtaacgttcgtaggtaacggtaccgtaccgggtacccgttttaacgttccgttcggtacgtaccggtaccggaccccccggtacgggtacggggtaacccgggggggtacccgttaaccggttaccgggttaccggtacgggttaaccccgggg

SEQ ID NO: 121006 - DNA, 229 bp, Homo sapiens
  misc_feature: GYAE6OF01C9R18.41.2.A02.1.454.CMB.1.raw
  modified_base (165)..(165): a, c, t, g, unknown or other
  misc_feature (165)..(165): n is a, c, g, or t
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
tcagtctatactatcacgaccggtgctcgatttagactcatctacaggggagcatcacccagcaaccacatctgtcctctagagacgtcccctgagagctccgttcctcaccatggactggacctggaggactcctcttcgttggtggcagcagccacgaggacncccactcctcgaggtcgcagctgatcgcagtcgtgggctggngtgagagcgtggcnagtnagct

SEQ ID NO: 121007 - DNA, 763 bp, Homo sapiens
  misc_feature: GYAE6OF01EF2CP.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatcctctttcgttggtggcagcagccaacgaggacgcccactctcgaggtgcagctgatgcgtaggtcggtggggcgtgggaggtaggagggacggtccggtcggggtcctacgaggtacgacgtccgttcctccgtgacctaacgttccgttgtaggaattaccggtaggttacaaacgtcttactatactaacgcggtgggtcacgtacgccggtcccgtaaggacggtagggttcttgggaggttacggaggtgggagttcggaacctaaccgaaaccgtaagggtgtcggtaacgaccaacggctacgtcaaggccgaacggtagggtccgttaccggacgggtacgtaccgggtacctacggtaggttaacgggaggttacgggaccgtaaccgggacccgtacggtaaccggaccggttacccggaacccggtaccacgttaacggtaaccggtaaccgttacgaacgtaccggtagtaaccgtggtaaccgggacgtaccgttaccgggtttacccgtttagttccgggtacgtccggaaccggccccggggtaccggtaccggggtaacccgggggtaacccgggtacctaaccggggttaccgttaggtacggggtacccggg

SEQ ID NO: 121008 - DNA, 611 bp, Homo sapiens
  misc_feature: GYAE6OF01B32B4.41.2.A02.1.454.CMB.1.raw
  modified_base (282)..(282): a, c, t, g, unknown or other
  misc_feature (282)..(282): n is a, c, g, or t
  modified_base (342)..(342): a, c, t, g, unknown or other
  misc_feature (342)..(342): n is a, c, g, or t
  modified_base (472)..(472): a, c, t, g, unknown or other
  misc_feature (472)..(472): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggcctcgagtgaagctctcctgcaagacttcgtggatacaggttcaacgacttctatatacacgtggngtcgacacgccccgtggacgagggacttgaggtggagtgggatggatacaaccgtaaggngtggtgaacacgagtcctgcgacacgagtcggttacgagggcgtacgggtacaccgtagtggtaggtggtacgacgaccgggaccgacggacgccgtaaccggactacgacgtaacggtaaccttaccgnggttaccgataacggttcgtaggaacgggaccgtaccggttaccgttttactcgtacggtcgaccggtaaccggccccggtacgggtacgggggtaacccgggggtaccttaacggtacgggtccgtacggtacccggg

SEQ ID NO: 121009 - DNA, 750 bp, Homo sapiens
  misc_feature: GYAE6OF01EXNIK.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtggggcctcgagtgaagctctcctgcaagtacttcgtggatacaggttcaacgtcttctatactacacgtgggtcgcgacgacggccccgtaggacgacgggtacttggaggtggagtgggatgggaactaccgaaaccgtaaggaggttggtaacgaacgacgacgtaccctcgtacggaccaacgaagggtaccgggttacccggaacgggggtaactaccgggggttaccaacccggtaggtacgggtaacgggttcggggtacgaacccgggacccgggaccgaaccgggtacggacccggaaccgggttacccaacggtacgttaaccgggtaaacccgttaccgtaagggttccgtaaggttaacggtaccgttagggaacccggtaacggtacccgggtttacccggttttaacgtttccgtacggggttccggaacccggtacccggtacccccgggtacgggtaacgggggggtaaccccgggggttaccctaaccgggttaccccgggttacgacggggtttaccccggg

SEQ ID NO: 121010 - DNA, 910 bp, Homo sapiens
  misc_feature: GYAE6OF01B80DO.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagcctgggcctcagtgagctctcctgcaagtcttcgtggatacgagttacaacgtacttactatatactacgtcgggtgacgacgaccggcccgtaggacgacggggtacttggaagtgggagttgggataggtactaccgaaaccgtaaggacggttagggtacgaaccgacgtaacggtccccgttacgtcggaccctaaccggtaacgggtaccggggtttacccggacgggggtaacccggtaacgggggttaacccaaccccggtaagttacgggtaacggggttccgggtaacgggtaaccccggaacccggggaccccgtaaaccggggtaacccgggtaaccccggttaacccccgggttaacccccgtaaacgggttaacccgggtttaacccggggttaaaaaccccgttttaaaccccgggaaccgggttttaccggttaaagggttaaccccggtttaaccgggtcggggtaaaccgggttaacccccggttacccggggtttacccccggttttttaaaccggttccggtttcgggttaacccggggtacccgttaaaccccccgggggtaacccccccgggttaggggtaaaccccggggggggttaaacccccgggggggttacccgtttaaacccggggttaaccccggggttttacccgggtaacggggttttaaaccccccgggggg

SEQ ID NO: 121011 - DNA, 609 bp, Homo sapiens
  misc_feature: GYAE6OF01EURAQ.41.2.A02.1.454.CMB.1.raw
  modified_base (287)..(287): a, c, t, g, unknown or other
  misc_feature (287)..(287): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggaagccgtggggcctcgagtgaagctctctgcaagacttcgtggatacaggttacaacgtacttctatactacacgtgggtnacgacgacggccccgtaggacgagggtacttggagtggagtgggatggactacgaaaccgtaaggngtaggtnaacacgagtcctcgtcgacacgagacggttccgagggcgacggtcacgtagtgaggtggtacgacgacggaccgacgacgaccgacggtacccacgacgtacggtaaccttaccgacgttacgtacggtacgtcgtacggacggaccgtacggttacccgtttacgttcgtcggtcggaccggaccggccccggtagggtaccggggaccgggggtacctaaccggtaccgggtccgtcggtacccggg

SEQ ID NO: 121012 - DNA, 960 bp, Homo sapiens
  misc_feature: GYAE6OF01EEUKY.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatccttcttcttggtggcagcagcccacgaggacgcccactctcgaggtgcagctgatgctagtcgtgggctggaggtggaggacgtccgtgggcctagagtagacgtcttcgtccgtgacaagtacttcgtaggactacgtacggttaccaaacgtacttactatacttaccgacgttggggtacgaccggtaccgaccggtacccccgtagggaaccggtagggttaccgtttagggtacgggttagggtaaggttacggggaacgttacggggtaaacctaaccccggttaaaaaccccggttaaagggtaacggttacggggttaacggaaacctaaccggacgttaccccgtaccggttacggaaccccgacgggtaaacgggttaacccgggggtttacccgggaacggggggtacccgtaaacgggggttcccctaaaccggtaggttaacgggacggggtttaccgggtaaccgggaacccgggtaaccgggaccccgaaaccggtacgggtaacccccgggtaacccgggtttaccccaaacgggttaacggtttaaaccccgggttaaaaccccgtttaaccgggaaccgggttttacgtaaccggggttaaacgttaccgggttaacgggaaacccggggttaaacccgtttaccgggggttaccccttttttaaccggtttacggttaccggggttaccgggacccgggtaaccccgggtaccccccgggtacggggggttaaccccggggggtaacccggggggttacccctttaaccgggttaaccgggttccggttaaaccggggtacccgggg

SEQ ID NO: 121013 - DNA, 632 bp, Homo sapiens
  misc_feature: GYAE6OF01CQ8S2.41.2.A02.1.454.CMB.1.raw
  modified_base (340)..(340): a, c, t, g, unknown or other
  misc_feature (340)..(340): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtgcagctgatgcagtcgtgggctggaggtgaggaacgccgtgggcctgagtgacgctctcctgacaagacttcgtggtaatacgtacggttacaacgtacttctatatacacggtggtgcgacgacggtccccgtaggacgagggtacttggagtggagtagggntaggactaccgaaaccgtaaggagtaggtagaacgtacgacgtcctcgtacgtacaacgtaggtacgttaccggagggacgtaacgggtaccaacgagttggtaacggtaggtacggaacgtaccggaccgaacgacgaccgacggtacacgacgtacgtaactaccgagtcgtagtacgtcgtagacggtaccgtaccggtccgtttacgtcgtcggtacgaccggaccgaccccggtcgggtaccggggacccggggttactaccggtacggtccgtacgggtacccggg

SEQ ID NO: 121014 - DNA, 810 bp, Homo sapiens
  misc_feature: GYAE6OF01D0TGP.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggagccgtggggcctcgagtgaagctctcctgcaagtacttcgtaggatacgtaggttaccaacgtacttacgtatactaacacgtgggtagccgacgacggccccgtagggacgagggtacttaggacggtgggagtgggagtaggtactaccgaaacccgttaaggaggttaggtacgaacacgacgtccctcgtacggccaaacgtacgggttaacgggttacccggacggggtaccggtaacggggtacccaacccggtaagttacgggtaagggttcggggttaacggacccggtaaccgggacccgtaaccgggacggacccgggtaacccgggtaaccccgaacgtaacggttaaccgggtaaacccgttacccgtaaggtttaccgtaacggtaaccggttacggtacgggaaccggtaacccggtacccgggtttaccccggtttttaaccgtttccggttacgggtaccggtacccggggtaaccccggtaccccccggggttaacggggtacccgggggggtaaaccccgggggggttaccccttaaaccggggtttaacccgggttaccggttaaccggggttaaccccggggg

SEQ ID NO: 121015 - DNA, 642 bp, Homo sapiens
  misc_feature: GYAE6OF01B13SM.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctggaggtgaaggagccgtggggcctcgagtgagctctcctgacaagtacttcgtagactacgtaggttacaacgtacttactatactacacgtgggtcgacgacgacggcccgtggacgagggtacttggaggtggagtggatggactaccaaaccgtagtacggtggtacgaccacacgtcctgtacggacacggtaggtacgggtccggaagggtcgtacgggtaccacgtagtaggtagggtggtacgaccgtaccggaccggacgacgaccgtaccggtaccaacgtagtacgtaacctaccgtacgtacgtacgtacgtacgtagggtacggaccgtccggttaccgtttacgttacgtcggttaccggacggtacccgaccccgggtacgggtaccggggacgggggtacccgtacggtaccggtcggtacggtaccggg

SEQ ID NO: 121016 - DNA, 629 bp, Homo sapiens
  misc_feature: GYAE6OF01BESSD.41.2.A02.1.454.CMB.1.raw
  modified_base (367)..(367): a, c, t, g, unknown or other
  misc_feature (367)..(367): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctggaggtgaggaagccgtggggcctcagtgaagctctcctgcaagacttctggatacgaggttcaacgacttctatatacacgtgggtgcgacgacggccctggacgagggtacttgaggtggagtgggatggaactacgaaacccgtaagagtggtacgacacgacgcctntcgacacgaggtacggttcccgagggacgacgggtccacgtaagtcggagtagggtacgacgaaccggccgaacggacgcgaaccggtccgaaccgtagtaccggtaaaccttacccgaagttaccgtaaggtaacgtcgtacggaacggtaaccgtaccgggttaccgtttacgttcgtcggtcggaccggaccggaccccggtgggaccggggtaccgggggtacccttaaccggtaccggtcggtaacggtacccgggg

SEQ ID NO: 121017 - DNA, 775 bp, Homo sapiens
  misc_feature: GYAE6OF01D9DD0.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcagtgaagctctcctgcaagacttcgtggatacgaggttcaacgtacttctatatacacgtgggtgacgacgacggcccctaggacgagggtacttgaggtggagtgggagtaggactaccgaaacccgtaaggtcggtaggtacgaaccgaccgacgtcccgttcgtgaccgtaacgtaacggtacgggttacccggaacggggtacgtaacggggtacccaaaccgtagttacgggtagggttacgggtaccggaaccgacccgggacccgaacgggtaacggacccgtaacccggttaccccgaaccgtaacgttaaccgggtaaacccgttaacccgtaacggttaccgttaacgggtaacgttacggtacgggaacgggtaacccggttacccgggtttaccccgtttttaaccgtttccggttacgggttacgggaccggtaaccccgggtaccccccgggtacggggttaaacccgggggggtaaccccgggggggttaacccttaaccgggtttaacccgggttaacgtacgggttaaaccccgggg

SEQ ID NO: 121018 - DNA, 780 bp, Homo sapiens
  misc_feature: GYAE6OF01C5SZH.41.2.A02.1.454.CMB.1.raw
  modified_base (161)..(161): a, c, t, g, unknown or other
  misc_feature (161)..(161): n is a, c, g, or t
  modified_base (231)..(231): a, c, t, g, unknown or other
  misc_feature (231)..(231): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcagccacaggacncccactctcaggtcgcagctgatgcagtcgtgggctggaggtgaggacgccgtggggccctgagtgaacnccgttctccgtgactaagacgtttcgaggtactacgtacggttacaacgtacttctataactacgtagtggctacgacgtaccggtccccgtaggaccgtaggtactggagtggaggtggagtgactaccgaaaccgtagacgttggacgaacgacgtacgtccttacgtacgccgtaaacggtacggtaacggttcccgggaacggtacgtaccggggtaccaaaccgttggtaacggttacgggtacggttacgggaacccgtaccgggaaccgaaccggtacgtacccgggtaacccggtaactaacggtaaccggttaacggttaaaacccgttccggtaacggtttaaccgaacggttaaaccggttacggttaaccggaacgggttaaccccgttaccggttaccccgttttaacgtccggtaaacggtcccggttaacccggaccgggtttaacccccgggtcgggtaaacccgggggtaaccccgggggttaccttaaaccccgggttaccgggtttaaccggtacgggtttaccccgggg

SEQ ID NO: 121019 - DNA, 560 bp, Homo sapiens
  misc_feature: GYAE6OF01B1BMR.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctcgtcctgcaagacttctggatacaggttcaacgtacttctatatacagtggtgcgacacggcccctggacgaggacttgagtggagtgggatggatcgaaaccgtaagacgtggtagacagacgcctctgcacgagtacggtccgagggcgagggtaccaccgagtgagtggtagacgaccggacacggagcgaccggtcacgagtcggaacttaccgagtctagaacgtcgtaggacgacgtacggtaccgtttacgttcgtcgtgaccggtccggacccgcggtacggggaaccgggggtcctacggtacggtcgtaggtacccggg

SEQ ID NO: 121020 - DNA, 665 bp, Homo sapiens
  misc_feature: GYAE6OF01ENX20.41.2.A02.1.454.CMB.1.raw
  modified_base (293)..(293): a, c, t, g, unknown or other
  misc_feature (293)..(293): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggaagccgtgggcctcgagtgaagcttcgtcctgcaacgtacttcgtggactacgaggttcaacgtacttctaatactacacgtgggtnccgacgacggccccgtggacgagggtacttggacggtggagtgggatggataccaaccgtagaggtggtagacacgacgcctntnccgacgagtacggttccgagggcgaagggtcaccgtagtgaaggtggtacgaccgaccggacaacgacgccgacggtccacgtagtacggtaacctttaccgagttaccgtacggtaagttccgtaggacggtaaccggtaaccgggttacccggttttacctttaccggttcggttacgggacccggtaaccggtaacccccccgggtcggtaaaccggggggtaacccggggggggttaccctaacccgggttacccgggtaccgttaacgggttaaccccgggg

SEQ ID NO: 121021 - DNA, 589 bp, Homo sapiens
  misc_feature: GYAE6OF01EZXNJ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagcttcgtggatacaggttcaacgacttctatatacacgtgggtgcgacacggcccctggacgagggacttggagtggagtgggatggatcgaaccgtagagtggtagacacgagcctcgtcgacacgagtacggttccgagggcgagggtcaaccgtagtagaggtggtacgacgacggccgacggacgacgaccggtaccacgagtacggtaaccttaccgagttacgtagtaacgtctacggacggtacgtaccggttaccgtttaccgttcgtgtacgaccggtacgaccccggtcggtacggggtaaccggggggtacctaacggtaccggtcgtacggtaccggg

SEQ ID NO: 121022 - DNA, 666 bp, Homo sapiens
  misc_feature: GYAE6OF01EDHPQ.41.2.A02.1.454.CMB.1.raw
  modified_base (234)..(234): a, c, t, g, unknown or other
  misc_feature (234)..(234): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaacgccgtggggcctcgagtgaagctcncctgacaagtacttcgtggactacgtaggttacaacgtacttactatactacacgtgggtcgacgacgacggtcccctggacgagggtacttggagtggtagtggagtggaactacgaaacccgtaaggacggttaggtacgaacacgacgtccctgtcgacgaacgaggtacggttaccgagggtccgtaaggggtccaacgtagtacggaggttacgggacgaaccgtacggacccgacggacgacccgtaacggtccaacgtagtacggtaactaccgagttacgtagaacgtcgtaggacggtaccgtacggttccgtttaacgtcgtagggtccgtaccggaacccgtaccccgggtagggtaacccggggggtaaccgggggtacccctttaacgggtaccgggttacgtacgggttaaccccggg

SEQ ID NO: 121023 - DNA, 592 bp, Homo sapiens
  misc_feature: GYAE6OF01EL5IK.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagcctggggcctcagtgagctctcctgcaagacttcgtggatacaggttcaacgtcttctatatacacgtgggtgcgacgaggcccctggacgagggacttgagtggagtgggatggatcaaccgtaagagtggtagacacgagcctctgcaacgaggtacggttccgaagggccgaagggttccaaccgtagtggaaggtggtacgacgaccggccgaacggacgaccgaccggtaccacgactacgggtaaccttaccgagtctaggtaacgtcgtaggacggaacgtaccggttccgtttaacgttcgtggtacggccggtacgaccccggtggtacgggggaaccgggggtaccttaacggtccgggttcgtagggtaccggg

SEQ ID NO: 121024 - DNA, 624 bp, Homo sapiens
  misc_feature: GYAE6OF01D4K8B.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgtacttctatatacacgtgggtgcgacgacggcccctggacgagggacttggagtggagtgggagtggactaccgaaacccgtaaggaggtgggtacgaacgacacgtccctctcgccaacgaggtacggttccgaggggcgacggggtacaccgagtggaggtggtacgacgacggccacggagcgacggtcacgagtacggtaaccttaccgagtcgtagtaacgttcgtacggaacggtaccgtaccgggttcccgttttaacgttcgtcggtacgaccggtacccggacccccgggtcggtaccgggggaaccggggggtaccccttaacgggtaccgggttacgtacgggtacccggg

SEQ ID NO: 121025 - DNA, 648 bp, Homo sapiens
  misc_feature: GYAE6OF01DYWUM.41.2.A02.1.454.CMB.1.raw
  modified_base (190)..(190): a, c, t, g, unknown or other
  misc_feature (190)..(190): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcnggggctgaggtgaggagccgtgggcctcgagtgaagctctcctgacaagtacttcgtaggatacgaggttacaacgtacttactagtatacacgtgggtgccgacgacggccctggaccagggacttggagtgggagtgggataggactaccgaaaccgtaaggacggttggtacgaacacgacgcctacgtggacacggagtacgggttaccgacgggcgtaacggggtccacgtacgtagggacggttagggtacgaccgacgggacccgaacggaacgtccggaaccggtacccaacgtaagtaacgggtaaccttaccgtacgtacgttacggaacggttacgtaggtaaccgggaccttaccgggtccgttttacgttcgtggtacgacggaccgtaccccggtcggtacgggggacccgggggtaccttacggtacggtcgtcggtaccggg

SEQ ID NO: 121026 - DNA, 579 bp, Homo sapiens
  misc_feature: GYAE6OF01BSU5S.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacgaggttcaacgtacttctatactacacgtgggtcgcgacgacggccctggacgagggacttggagtggagtgggagtggactactaaaccgtaaggagtggtacgacacgacgcctcgtgacacgaggtacggttccgagggcgtagggtaccacgataggaggtgggtagaccgacggcccgaacgcgaccgacgggtcccacgtagtacggaacttaccgagtcgtagtaacgtcgtaggacggacgaccggttaccgttacttcgtgtcgcgtacgaccccggtgtacggggacggggtcctacggtcggtcgtacggtaccggg

SEQ ID NO: 121027 - DNA, 713 bp, Homo sapiens
  misc_feature: GYAE6OF01CS2QV.41.2.A02.1.454.CMB.1.raw
  modified_base (162)..(162): a, c, t, g, unknown or other
  misc_feature (162)..(162): n is a, c, g, or t
  modified_base (245)..(245): a, c, t, g, unknown or other
  misc_feature (245)..(245): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacncccactctcaggtgcagctgatgcagtcgtgggctggaggtgaggacgcgtggggcctgagtgagctctctgcaagtacttcnggaatacgaggttacaacggtacttactatatacgacgttagggtcgaccgacgaccggtccccgttaggaaccgtacggggtaacctttggaacggttgggaacggttggggagttacggggaactttaccggaaaacccgttaaaggacggttacgggtagaaccgtaacgacgtcctcgtgacacgacggtacggtccgagggcgtacgggtccaccgtagtacgggaggttacgggacgaacgtccggaccgtacggacgcccgacggttaccaacgtagtacggtaacctacgtacgtacgtacggtaacgttccgtaggaacggtaccgtaccggttacccggtttaactttccgggtaggttacgtacccgggaacccggtaccccggtacgggtaccggggggtaacccgggggtaccttaacccgggtttaccgggtcgttaaccgggttaacccgggg

SEQ ID NO: 121028 - DNA, 817 bp, Homo sapiens
  misc_feature: GYAE6OF01D9KJ7.41.2.A02.1.454.CMB.1.raw
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
tcagtctatactatcacgaccggtgctcgatttagactcatctacagggggagcatcacccagcaaccacatctgtcctctagagagtcccctgagagctccgttcctcaccatggactggacctgggagatcctcttcttggtggcagcacgccacgaggacgcccactctcgaggtcgcagctgatgcgagtcggngggctggaggtgaggacgccggtgggcctcgagtagacgtctcctcgngacgaagtcttcgagtaactacgtacgtacaacgttacttactatacgtacgtacggtggtcgaccggacggacccggtcccgtaggaccggtagggtacgttaggaggtggtaggtagggtagtacggtaactaaccggtaaaccgtaaggtacggtacggaacgtaaccacgtaaccgccttacggaccgacgtaacggtacgggttaccgtaaccgggacgggtaccggtaacggtaccgaacgttagggtacggtacgggttaccggaacggacccggtaccgggtaccgaaacggtccgtaacccgggtaaccggtaaccctacggtaaacggttaccggttaaaccccgttacgtaaccggttacggtaacggaaccggttcggaaacccgggtacgggtaacccggtttacccgggtttaccgtttaccgttacgggccgtaaccggggtacccccggttaacccgggacccccggggttacgggggaacccggggggttaacccccgggttacgtaaacccccgggttttggggaaaccccggttcggggttaccccgggggg

SEQ ID NO: 121029 - DNA, 621 bp, Homo sapiens
  misc_feature: GYAE6OF01BB9MX.41.2.A02.1.454.CMB.1.raw
  modified_base (552)..(552): a, c, t, g, unknown or other
  misc_feature (552)..(552): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggcctgagtgaagctctcctgacaagacttctggatacgaggttcaacgtacttactatactacacgtgggtgaccgacgacggccctaggacgagggacttggagtggagtgggatggactaccgaaacccgtaaggacggttggtacgaacacgacggccctcgtgaccacgaaggtacgggttccgaggggcacggggtcaccgagtggagttgggtacgacgaccggaccgtacggacgtaccgaccggttacccacgtacgtacggtaaaccttaccgagtccgttagaacgttcgtaggacgacgtaccggttccgtttacgttcgttcggngccggccggaccccggcggtacgggggtaccgggggtaccctaacggttccggtcgtacggtacccggg

SEQ ID NO: 121030 - DNA, 797 bp, Homo sapiens
  misc_feature: GYAE6OF01DC0Z4.41.2.A02.1.454.CMB.1.raw
  modified_base (249)..(249): a, c, t, g, unknown or other
  misc_feature (249)..(249): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcagccacaggacgcccactctcaggtgcagctgatgcagtcgtggggctgaggtgaggagccgtgggcctgagtgaacgctctccgtgacaagtacttcgnggtaactaacgtaggttaccaacgtacctttactaattactacgtaaccgttggggttacgaccgaaccgacgggtacccccgtagggaaccgtaggggtaaccgtttaggaagggttcggaaggttggggtagtaggggtactaaccgaaacccgttaaggtacggttaggtacgaaccgtacgacggtccctttacgacgtaccgaaacgtacggtaccgggttacccggagggtaccggtaacgggtccaaccgtagttcggtacgggttacgggtaccggaaccggtaccgggtaacccgacgggtaaccgacccggtaacccggttacccgaaccgttaacggttaacccgggttaaaccctttaacccggtaacggttaccgtacggttaacgttacggtacgggaacggtaacccgttaccgggttaaccgttttaccgttacggtcggtacggtacccgggtacccgtacccccgggtagggttccggggtaacccgggggtacccttaaccgggttccggtacgttacgggtacccggg

SEQ ID NO: 121031 - DNA, 676 bp, Homo sapiens
  misc_feature: GYAE6OF01EC8G2.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctcctcctgcaagacttctggatacaggttcaacgtacttctatatacactgggtgcgacacggcccctaggacgagggtacttggacggtggagtgggatggactaccgaaacccgtaaggagtgggtagtaacgacgacgtcccgtgtacgacctaagaacggtacgggttacccgagggaccgtacggggtaccaaccgtagtaggtaaggtgggtaacggaccgaccgggacccgaccggtaggacccgaccgggtacccaacgtagtacggtaaacctttaccgagttcgtaggtaacgtacgtacggaggaacccgtaccgggttacccgtttacgtttacgtcggttaggacccggtaccggtaaccccccggtgggtaaccggggggaacccgggggtacccttaccggtaaccgggttccgtaacgggttacccggg

SEQ ID NO: 121032 - DNA, 690 bp, Homo sapiens
  misc_feature: GYAE6OF01CWH68.41.2.A02.1.454.CMB.1.raw
  modified_base (188)..(188): a, c, t, g, unknown or other
  misc_feature (188)..(188): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtgcagcagccacgaggacgcccactctcgaggtcgcagctgatgcngtcgtgggctgaggtgaggacgcgtgggcctgagtgaacgctctccgtgacgtaacgtacttgaggtaactacgtaggttaccaacgtactttactaagtaactacgtacgtgggtcgacgacgtcggccccgtaggacgaacgggtacttaggaggtggaggtagggtagtacggaacgttaaccgaaaccgtaaggtacggttagggtacgaacgtaacgtaacgtccgtacgtcggaaccgtaacgaacgggtaccggttccggaaagggtcccggtaagggtaaccaccggtagttaggacggttcggacggaacccggccggtaaccgaacggtccgacgtacccggtacagtacgtaacggtacctacgtcgtacgtagtacgttcgagacgtacgtaccgtacgtttacgtcgtggtacgcccggtaccggtacccggtcgggtaacgggggtacccgggttacctacgggtttacggacgttcgggtaaccggg

SEQ ID NO: 121033 - DNA, 696 bp, Homo sapiens
  misc_feature: GYAE6OF01BPBD9.41.2.A02.1.454.CMB.1.raw
  modified_base (289)..(289): a, c, t, g, unknown or other
  misc_feature (289)..(289): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcgttggtggcagcacgccacgagggacgccccactctcgaggtgcagctgatgcaggtcgtggggctggaggtggaggaacgccgtgggcctacgaggtagaagcctctctgacaagtacttgtaggatacgtacggtacaacgtacttntaatactacgacgtgggtcacgacgaccggtcccgtaggacggtacgggtacgtggagtggtagtgggtagtacggactaaccgaaacggtaggtagtaggtacgacacgacgtacctgtagacgtaacggtacggtacggtaccggaacggggacgtacggtacctaacgtggtaggtagggtcggaccgaaccggtccggacgaacggccgtaacggacccggtacaagtacggttaaccggaaaccttcggacgttacgtaggtaacgtcggtaggacccggtaaccggtacccgggttttccctttaagcgggtaacggcggacccgggtaacccggccccgggtagggggtaacccgggggaccgggttaccctaagtaccgggtggtaccggtaccggggg

SEQ ID NO: 121034 - DNA, 608 bp, Homo sapiens
  misc_feature: GYAE6OF01AGQSY.41.2.A02.1.454.CMB.1.raw
  modified_base (247)..(247): a, c, t, g, unknown or other
  misc_feature (247)..(247): n is a, c, g, or t
tcagtctatactatcacgaccggtgctcgatttagactcatctacagggggagcatcacccagcaaccacatctgtcctctagagagtcccctgagagctccgttctcaccatggactggacctggaggatcctcttcttggtggcagcagccacaggagcccactctcaggtgcagctgatgcagtctggggctggaggtgaggaagccgtggggcctcgagtgaagtctctcctgcaagacttcnggatacaggttacaacgtacttctatatacacgtgggtgcgacagggcccctaggacgtagggactttggaggtggagtgggatcgggaactaccgtaaaccgtaggaggttgggtacgactaacgacggccctacgtacggacaccgtaggtacggttcccgagggtcgacgggtaccacgtagtggacgttgggtacgaccgacggtaccgagacgccgtaccggtaccaacgagttacggaaccttacggagtacgtagacggttcgaggacggtacctccgggttaccgtttacgtcgtggtcggccgtacgaccccggtagtacggggaccggggtctacggcggtcgaggtccgg

SEQ ID NO: 121035 - DNA, 660 bp, Homo sapiens
  misc_feature: GYAE6OF01E40YW.41.2.A02.1.454.CMB.1.raw
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtggaggaagccgtggggcctcgagtgaagctctcctgcaagtacttcgtaggatacgaggttaccaaacgtacttactataatacactggggtncgacncggccccgtggacgagggacttgaggtggagtggggagtaggaacgtaccaaaccgtaaggtaacggttgggtagaaccgacaacgaccctcgtacgcaacgaggacgggttccgacggggacgacgggtaccacgagtacggaggtggtacgaaccgccggaaccgacggacgtccgaaccggtaccacgtagacgtaaaccgttacgacggttcgtaaggaacgttacgtacgggacggtaaccggtaccggtttccgtttaaccttcgtggtagaccggaccgggacccccggtcgggtaccggggggaaaccggggggtacccgttaacccggacggttccgtaagggtacccggg

SEQ ID NO: 121036 - DNA, 595 bp, Homo sapiens
  misc_feature: GYAE6OF01BY65P.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcgagtgaagctctcctgcaagacttctggatacaggttcaacgacttctatatacactgggtgcgacaggcccctggacgagggacttgagtggatgggatggatcaacctaagagtggtgacacagcctctgcacgaggtacggttccgagggccgagggtccaccgtagtgagtggtcgtacgacggccgacgacgcgacggtccacgagtacggtaaccttaccgtaggtacgttaggaacgttcgtaggtacggaccgtaccggttcccggtttaccttcgttcggttcggaccggtaccggacccccggtacgggtaccggggtaaccgggggggcccttaaccggtaccggttcgtacggttaacccgggg

SEQ ID NO: 121037 - DNA, 704 bp, Homo sapiens
  misc_feature: GYAE6OF01CT55G.41.2.A02.1.454.CMB.1.raw
  modified_base (186)..(186): a, c, t, g, unknown or other
  misc_feature (186)..(186): n is a, c, g, or t
  modified_base (248)..(248): a, c, t, g, unknown or other
  misc_feature (248)..(248): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcngtcgtgggctgaggtgaggaagccgtggggcctcgagtgaagctctctgacaagtacttcgnggtatacgtaggttaccaaacgtactttactaatactacgacgttgggtcgacgacgtaccgggccccgtaggaacgtacgggtacgttggagtaggaggtcgggagttggacttaccgaaaccgtaaggtacggtggtacgacacacgtcctcgtagaccgacgaacggttcggtaccgagggccggtaagggtaccaccgaaggtcggtaaggtcgggtacgtaccgaccgggtaccgacggacgtcggaaccgttacccaacgtacgttaacggtaacccttaacgacggttcgtagggtaacgtggtacgaacggtaacgttaccccggtttaacgtttaccgttcgttacggacgggtacccggtacccgggacccccgggtagggtaaccggggggtaaaccccgggggtcttaacccgggttaaccgggtcggtaaccggtacccgggg

SEQ ID NO: 121038 - DNA, 828 bp, Homo sapiens
  misc_feature: GYAE6OF01BO9TD.41.2.A02.1.454.CMB.1.raw
  modified_base (222)..(222): a, c, t, g, unknown or other
  misc_feature (222)..(222): n is a, c, g, or t
  modified_base (287)..(287): a, c, t, g, unknown or other
  misc_feature (287)..(287): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggagccgtggggcctcgngtgagctctctgacatacttcgaggatacgaggttacaacgtacttctatactacacgtgggtcncgacgcggtcccgtaggacgagggtacttgaggtggagtgggatcgggtactacccgtaaaaccgtaggtagggtacgggtacgaacctacggtacggtcccttacgtcggaaccctaacggtacgggttaacggggtttacccggaagggggtaccgtaaccgggggtaccaacccgtagttacgggaacggttcggggtacgaaccggaacccgggacccgaaccgggtaccggacccggtaacccgggtacccgtaacgtaaccgggttaacggtaaacccgttaacccggtaacgggtaccggttaaggaaaccggtttccgggtaacgggaaccgggtaaacccgggttacccgggttttacccgtttttaaccggtttacccggttacgggttacccgggacccggggtaacccccgggttaccccccggggtaacggggttaacccggggggggtaaaccccgggggggttacccccgtttaaacccggggttaaccggggttacccgggttaaaccggggttaaccccggggg

SEQ ID NO: 121039 - DNA, 825 bp, Homo sapiens
  misc_feature: GYAE6OF01DKQTC.41.2.A02.1.454.CMB.1.raw
  modified_base (161)..(161): a, c, t, g, unknown or other
  misc_feature (161)..(161): n is a, c, g, or t
tcagtctatactatcacgaccggtgctcgatttagactcatctacagggggagcatcacccagcaaccacatctgtcctctagagagtcccctgagagcctccgttcctcaccatggactggacctggagatcctcttcttggtgcagcagccacaggacncccactctcgaggtcgcagctgatgcaggtcgtcggggctaggagggtaggaagggaacggtccggtcgggggtccctagacggttagaacgtccttccgtccgtagaccgtaacgttaccttcgtaggtaactacgtacggttactaacgtcttacttaatactacgacggtggtcgcgtaccgacgtccccgaggaccgtacggtacgtaggtagggtcggaggtaggtacggtaggtaacgtacccgtaaaaccgtaacgggaggttacggaacgtaacccgaacgtaccgggaccctttcggtacgacctaacgggtaacggtacccgggttacggaaccgggtacgtaaccgggtacgaaccgtaggtacggtaacgggttcgggaaccgaccccggaaccgggtacccgtaaaccggcggtaacccccgtacggtaaccgaaccgttaaggtaaccccgtaacctaccgttacgtacgtaaggtacgttacgtagggaacccgtaaccggttacccggttaccgttttaccgtacggttccgggtaccggtaaccccggtacccggtaaccccgggtacccggggttaaccggggggaaacccccgggtttacccgtaacgggttacccgggttacggttaacccgggtacccggggg

SEQ ID NO: 121040 - DNA, 711 bp, Homo sapiens
  misc_feature: GYAE6OF01C4VHX.41.2.A02.1.454.CMB.1.raw
  modified_base (236)..(236): a, c, t, g, unknown or other
  misc_feature (236)..(236): n is a, c, g, or t
  modified_base (367)..(367): a, c, t, g, unknown or other
  misc_feature (367)..(367): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctccngacaagacttcgtaggtatacgtaggttaccacgtacttctatatactacgtgggtgacgacgaccggccccgtaggaacgacgggtacttgggagtcgggagtgggataggactaccgaaaccgtaaggnggtaggtacgaactacgacggtccctagtacggtacaacgtagggtaaccggggttaccggacgggggaccggtaacgggtccaaacccgtagttacggaagggttacgggtaccggaaccggacccgggacccgaaaccggacggtacccgaaccgggttacccgaacgtacggtaacgtaaacccttaccgtagtcgtacggtaacgttcgaggaaccgggtacccgtaccggttaccgtttaccgttcgtcgtacggtaccggtaacccgggtccccggacggggttacggggaacccgggggttacctaccgggttaccggtaccggtacggtaccgggg

SEQ ID NO: 121041 - DNA, 659 bp, Homo sapiens
  misc_feature: GYAE6OF01ERX1Y.41.2.A02.1.454.CMB.1.raw
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
  modified_base (339)..(340): a, c, t, g, unknown or other
  misc_feature (339)..(340): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctggaggtgaggaagccgtggggcctcgagtgaacgctcctctgacaagtcttcgtaggatacgtaggttacaacgtacttctatatacngtggggtcaccggacncgggcccctagggacgagggtactggagtggagtgggnnggactaccgaacgtaggaggtggtacacacgcgtcctcgtagcgaacgacgggtaccggttccgagggtaccacgggtaccacgtagtggtacggtaggtaccgacggcggaccgaggtacgccgtaccggtaccacggtagtaccggtaaccttaccgaggttactaggtactaccggtaggaaccggtacggtacccgggttttaccgtttaacgttccgggtggttaccggacccggtacccggtcccccgggtaggtaccgggggggtacccggggtaccttaaccgggtcccgggttacgacgggtacccgggg

SEQ ID NO: 121042 - DNA, 640 bp, Homo sapiens
  misc_feature: GYAE6OF01EWLXG.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttcgtggatacaggttcaacgtacttctatatacacgtgggtgcgacgacggcccctggacagggacttggagtggagtgggatggatcaacccgtaagagtggtgacacagtcctcgtcgcacgaggtacggttccgagggcgacggggtccaccgtagtggaggtgggtacgacgtaccgggaccgaacgtacggccgtaaccggtacccacgaacgtacggaacctttacccgaggttaccgtacggtaacgttccgtagggaacggaaccggtacccgggttacccgttttaacgttcgttcggtacggaccggtaccggacccccggtcggtaaccgggggtaacccggggggtcccttaaccggttaccgggttccgtaacgggtaacccgggg

SEQ ID NO: 121043 - DNA, 704 bp, Homo sapiens
  misc_feature: GYAE6OF01EQYNQ.41.2.A02.1.454.CMB.1.raw
  modified_base (618)..(618): a, c, t, g, unknown or other
  misc_feature (618)..(618): n is a, c, g, or t
  modified_base (628)..(628): a, c, t, g, unknown or other
  misc_feature (628)..(628): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtgcagcagccacgaggacgcccactctcgaggtgcagctgatgcgagtcgtgggctggaggtgaggagccgtcggggcctcgagtagaacggtctccgtccgtgacctaacggtacttcgtggaataccgtaggttaccaacgtacttactaattactacgtacggtgggtcaccggacgaccggtcccgtaggaccgtagggtacgttagggagtaggtaggtagggagtaggacttaaccgaaaccgtaaggtacggttagggtacgacgtacgaccgtccgtcgtacggactacggacgggtacggtaccggaagggtccggtaacggtaccaaccggtagtacgggtacggtgggtaaccgaccgaccgggaccgacggtacggaccctaccgggacctaaggacggttaccgtaaaccctggacgttacgaggttaacgtcgaggtaccggaccgttccggtttccgttntcggttcggngaacccggtccggaccccgttaggggaacccgggggggtacggtacccttacgggttcggtccgtaagggtccggg

SEQ ID NO: 121044 - DNA, 707 bp, Homo sapiens
  misc_feature: GYAE6OF01AMINP.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtggaggaggccgtgggcctcgagtgagctctccgtgacaagaccttgtggatacgtacggttacaacggtcttacgtatactacacgtgggtgccgacgacggcccctaggacgagggtacttagggacgtggaggtagggacgtggactaccgaaacccgtaggaggtcggtacgacgacgacgtcctacgtcgacgtacgacggttacgggtaccgtaggggacgtacgggtaccaccggtagtacggaggtacggtacgaaccggaccggtaccgaaccggacgtaccggaaccggtaccaacggtacgtaaccggtaaccttaaccggacgttacgtaacggttaacgtccgtagggaaccgtaccgttaccgggtttacccgtttacgttaccggtacggttaccggaaccggccggtacccccggtacgggtaccgggggttaacccggggggacccttaaccggggttaccgggttccggttaaccgggtaacccgggg

SEQ ID NO: 121045 - DNA, 684 bp, Homo sapiens
  misc_feature: GYAE6OF01E1JSZ.41.2.A02.1.454.CMB.1.raw
  modified_base (188)..(188): a, c, t, g, unknown or other
  misc_feature (188)..(188): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctcgatgcngtcgtggggctgaggtgaggacgccgtggggcctcgagtgagtctctcctgcaagtacttcgtggatacgaggttccaacgtcttactatatacacgtgggtcacgacgacggtccccgtaggacgtagggtacttggacggtggacgtgggatggaactaccgaaacccgtaaggaggtggtacgacaaccgacgtcctcgtagacaacgtaaggtacggttaccgacgggacgtacggggtaccaccgagtacggtacggtcgggtacggaacccgaccgggacccgaacggaccggacccgtaacccgggttacccaacgtaacgtaccgggtaaacccttaccgtagttccgtaagtaacgttcgtacggaacggtaccgtaccggttacccgtttaacttcggtcggttacggacccggacccggtaccccggtacgggtaccggggtaacccgggggtccttaaccggtccggttacgtacggtaccggg

SEQ ID NO: 121046 - DNA, 645 bp, Homo sapiens
  misc_feature: GYAE6OF01BHYLK.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctgaggtgaggaagccgtggggcctcaggtgaagctctctgacaagtacttcgtaggatacgaggttacaacgtacttctatactactacgtgggtcgacgaccgacggccccgtaggacgacgggtactttggaggtggagtgggataggaactacgaaacccgtagaggttggagtacacgacgtccctcgtacgccgaacgtacggtacgggttaccgacggggacgtacggggtaccacgtagtacggaggttagggtacggaccgtaccgggaccgacgtacggacccgtaccgggtccaacgtagtaccggtaaccttaccgagtacgtagtacgtcgagacggacgtaccggttccgtttagtcgtgtcggaccggtaccgaccccgggtggacggggggtaaccggggtcccttaagggccggttaccgtcgggtacccggg

SEQ ID NO: 121047 - DNA, 763 bp, Homo sapiens
  misc_feature: GYAE6OF01BT58B.41.2.A02.1.454.CMB.1.raw
  modified_base (192)..(192): a, c, t, g, unknown or other
  misc_feature (192)..(192): n is a, c, g, or t
  modified_base (295)..(295): a, c, t, g, unknown or other
  misc_feature (295)..(295): n is a, c, g, or t
tcagtctatactatcacgaccggtgctcgatttagactcatctacagggggagcatcacccagcaaccacatctgtcctctagagagtcccctgagagctccgttcctcaccagtggactggacctggaggatcctcttcttggtggcagcagccacaggagcccactctcaggtgcagctgatgcagtcgngggctgaggtggaggaagccgtggggcctcgagtgagctctcctgacaagtcttcgtggatacgaggttacaacgtacttactagtaactacgacgtggggtnaccgacgaccgggtccctagggacgaagggtacttgggagtggaggtagggtagcggtaatacccaaacccgttaaagggacggttcgggaacggtaacctacgacggtcccgttcgtacggaccgtaacggaaggttaaccggggttacccgtaacggggaccggtaacgggttaccgaaacccgtgtacgggtaagttcgggtaacggtaacccgaccggacccgacggaccgggcctaacccggtaccgaaccgtaacgtaccgggtaaaccttacccgtacgttacgttaacggtaaccgttacgtagggaaaccggttccggtaaacccgggttttcccgtttaccgttacgggttccggacgggtaccccggtacccggtaacccggtccccgggtacgggggggtaaccccgggggttacttacccgggtaacgggttcccggttaaggttaccccggggg

SEQ ID NO: 121048 - DNA, 734 bp, Homo sapiens
  misc_feature: GYAE6OF01AYNOZ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtgggcctcgagtgagctctcctgcaagtacttcgtggatacgaggttacaacgtacttctatatacacgtgggtgcgacgacggccccgtaggacgacgggtacttggaggtggagtgggatggatccgaaaccgtaaggtagtggtacgaacaccgacgtcctcgtacgccaacgacggtaacgggttccaagggggccgtaaggggtccaacccgtattacgggagggttacgggtacgaaccggtacccgggaccctaacgggacggtacccggtaacccggtacccgaaaccgtagttaacccgggtaaaaccctttacccggtaacgggtttaccgtaacggtaacgttcgtaacggaaccgggtaccgtaacccggggttttcccttttaaccgtttccggttcgggtacggtacccgggtaacccgggacccccgggttacgggtacccggggggaaacccggggggttcccttaaacccggggtccgggttaaccgttacggggtaaccccgggg

SEQ ID NO: 121049 - DNA, 714 bp, Homo sapiens
  misc_feature: GYAE6OF01BHBJA.41.2.A02.1.454.CMB.1.raw
  modified_base (193)..(193): a, c, t, g, unknown or other
  misc_feature (193)..(193): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggagcccactctcgaggtgcagctgatgcagtcgngggctgaggtgaggagccgtggggcctcaggtgaacgctctcctgcaagtacttcgtggatacgaggttcaacgtacttctatactactacgtgggtcgacgacgacggccctaggacgagggtaccttggagtggagtgggatgggtatacgtaaaccgtaaggcggttaggacgaacctacgacgcccttacgtgacctacggtaagtcgggttacaggggtctaacggggtccaacgtacgtggaggtacgggtacgaccgtaaccgggacctacgggaacgccgtaaccgggtccaacgtacggtaacgtaaccgttaccgagttaccgttaggtaacggttccgtacgggaaaccgggtaacccgtacgggtttacccctttaaacgttccgggtacggttacccggacccgggtaacccgggacccccccggtaggggttaacccgggggggtaaccccgggggttccctaaacccgggtttaccgggtaaccgttaacccgggtaacccggggg

SEQ ID NO: 121050 - DNA, 719 bp, Homo sapiens
  misc_feature: GYAE6OF01AF7KQ.41.2.A02.1.454.CMB.1.raw
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctggaggtgaggacgccgtgggcctcgagtgagcctctcngacaagtcttgnggatacgtaggttacaacgtacttctaatactactacgtgggtcgacgaccgacggtccccgtaggacgagggtacttggacggtggagtgggactggactaccgaaaccgtaggacggtggtacgacacgacgtcctacgtcgacacgacgggtacggttccggagggtacggacgggtaccaccgtagtcgggaggttacggtacggaacccggaccgggaccgtaaccgggacggtacccggtaacccggtacccaacggttacggttaaccggttaaccccgttaaccggtacgttaccgtaaggtacggttcggtaacggaccggtaccggtaccgggtttacccgttttaccggtcggttaacggtccgggacccggtaacccgggaccccggttacggggtaccggggggaacccgggggttacccttaacccgggtaccgggttccggtacgggtacccgggg

SEQ ID NO: 121051 - DNA, 765 bp, Homo sapiens
  misc_feature: GYAE6OF01E3S3O.41.2.A02.1.454.CMB.1.raw
  modified_base (233)..(233): a, c, t, g, unknown or other
  misc_feature (233)..(233): n is a, c, g, or t
  modified_base (288)..(288): a, c, t, g, unknown or other
  misc_feature (288)..(288): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggagccgtggggcctcgagtgaagctcnctgcaagtactctggatacgtaggttcaacgtacttctatatacacgtggggtcncggacacggcccctaggacgagggacttggaggtggagtgggagtggaactaccgaaacccgtaaggtaggttagggtacgaacgtacgtacggacccttacgtacggaccaacgtaacgggtaaccggggtttacccggaacgggggtaccgtaacggggtacccaacccgtaaggtacgggtagggttcgggtacggtaacccggaccgggtaaccccgaaccgggtacggacccgtaacccgggtaccccaacgtaacggttaccgggtaaacccttaacccggtaacggttaccgtaacggtaaggtacccgttagggaaccgggtaacccgttacccgggttacccgttttaaccgtttccgtcgggttacgggacccgtaccgggtaccccccgggtacgggtaccggggggtaaacccggggggtacccgttaacccggtttaccgggttccgtaacgggttacccgggg

SEQ ID NO: 121052 - DNA, 699 bp, Homo sapiens
  misc_feature: GYAE6OF01C1Y33.41.2.A02.1.454.CMB.1.raw
  modified_base (192)..(192): a, c, t, g, unknown or other
  misc_feature (192)..(192): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgngggctggaggtgaggaacgccgtcggggcctagaggtgaacgctcctccgtagacagtacttcgtggtaactacgtaggttaccaacgtaccttactagtaactacgacgttgggtcgaccgacgaaccggccccgtagggaacgacgggtacgttggaaggtggaggtgggactaggactaccgaaacccgttaaggacggttacggtagaccgaacgtccgtaccgtctacggactacggtacggtacggtaccggacgggccgtaaggggtccaacgtggtaggaggtacgggtacgaccggaccgggaccacggtacgaccggtaaccggttacccgaacgtacggtaacgtaaccgttaccgacggttacgtaggtacgtaccgtgggaaccgtaaccggtacccggttaccgttttcgcggttcggtacgaccggtaccccgcccggtagggtacggggaacccgggttacctacggttaccggtcgtacggtacccgggg

SEQ ID NO: 121053 - DNA, 698 bp, Homo sapiens
  misc_feature: GYAE6OF01CY1MJ.41.2.A02.1.454.CMB.1.raw
  modified_base (380)..(380): a, c, t, g, unknown or other
  misc_feature (380)..(380): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacgaggacgcccactcctcgaggtgcagctgatgcagtcgtgggctggaggtgaggacgcgtgggcctgagtgacgctctccagcagtacttgtgatacgagttacaacgtacttcgtatactacgtacgtggtcgtacgaccgacggccccgtaggaccgagggtacgttaggagttggagtgggataggactaccgaaaccgtaaggacggttggacgtaacncgaacgtcttccgagacgaagtacggtaggttacccggacgggtacgacgggtaccacgaggtacggtaggtacgggtacgaccggaccggtccgaacgacggaccggacccgtacgtaccgagtaacggtaaccgttacccgtacggttacgtaacgacgttacgtacgggaaccgtacggttacccggtaccgttttaacgtccggttcgggtaccggtaccggaccccgggtaccccgggtaccggggtaacggggtaacccggggggtacccttaaccgggttacccgggtacggtaaccggttaccccggggg

SEQ ID NO: 121054 - DNA, 645 bp, Homo sapiens
  misc_feature: GYAE6OF01EQAIS.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacaggagccccactctcaggtgcagactgatgcagtcgtggggctgaggtgaggaagccgtggggcctcgagtgaagtctctcctgcaagcttctggatacgtagttacaacgacttctatatacacgtgggtcgcgacgcggcccctggacgagggactgagtggagtgggatggactaccgaaaccgtaagagtggtacgacacgagtcctcgtcgacacgaggtacggttccgagggccgagggtcaccgtagtacggaggtgggtacgaccgacgggacccacgggtacgaccgtaaccggttcccaacgtaacgtacgggttaaccctaaccgtacggttaccgtaggtaacggttcgtaggacgggaacctaccggggttaccttttaaccgttcgtcggtacggaccggtaccggaccccggtacgggtaccgggggaccgggggttaccctaccggttacgggttccgtacgggtacccggg

SEQ ID NO: 121055 - DNA, 616 bp, Homo sapiens
  misc_feature: GYAE6OF01C3H88.41.2.A02.1.454.CMB.1.raw
  modified_base (236)..(236): a, c, t, g, unknown or other
  misc_feature (236)..(236): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggacgccgtggggcctcgagtgagctctcgngcagtacttctggatacgaggttacaacgtacttactatactacacgtggtcgcgtacgcggccccgtggacgaggtacttggagtggagtgggataggactaccgaaccgtaaggtacggtaggtacgacgacgtacgtcctcgtacgcacgtacgtacgggttccgagggtccgtagggtccaccgtagtacggaggtggtacgaccggtaccggaccgaacggacgccgacggtacccagacgtacgaacgttaccgagtactagacgtcgtaggacggtaccgtacggtccgtttacgtccgtggaccgacggtacccggaccccggtggtaccggggacccggggtacctaccggtacggtgtacggtacccggg

SEQ ID NO: 121056 - DNA, 735 bp, Homo sapiens
  misc_feature: GYAE6OF01EJ6RM.41.2.A02.1.454.CMB.1.raw
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctctttcgttggtggcagcagccacgaggacgcccactctcgaggtgcagctgatgcagtcgtggggctggnggtggaggagccgtgggcctnagtgacgctctctgcaacgtcttgtaggaatacgaggttacaacgttactctaatactacgtacggtggtcgacgacgcggacccgtggacgtaggtacgttaggagtaggtacggtagggtagtacggtacgtaaccgtaaaccgtaagggtaggttacggtacgaacgacgacggtaccctcgtacgaccgtaacggaacggtcgggttaccgaacggggtccggtaacggggtccaaaccggtggttacggaagggttcggaagtaccccggaccgggacgaaccgggaccggacccgtaaccgggtacccaacggtaacgttacccggggttaaaccttaaccggtaccggttacggttaacgttaggtacccgagggtaacccgtaacgggtacccggtttcccgtttacgtacggttcggaacggcccgtaacccgggaccccggtggggtaacgggggaccccggggttacctaacgggtcgggtcccgtagggtcccggg

SEQ ID NO: 121057 - DNA, 683 bp, Homo sapiens
  misc_feature: GYAE6OF01CMBQC.41.2.A02.1.454.CMB.1.raw
  modified_base (253)..(253): a, c, t, g, unknown or other
  misc_feature (253)..(253): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcgttggtggcagcagccacgaggacgcccactctcgaggtgcagctgatgcaggtcgtggggctggaggtgaggacgccgtgggcctgagtgagctctctgacaagtacttcgnggatacgtaggttacaacgtacttactatatacgacgtgggtgcgacgaccggccctaggacgagggtcttggaggtggagttgggagtcggactaccaacgttaagacgttggacgacgacacgtcctagtcgactagacgggtacgtccggagggaccgtagggaccaacggtagtacggaggttacggacggaaccggaccggccgaacggtacgaccgtaaccggtcaacgtacggtaaaccgtaaccgtttaccggagtcgtaacgtaacggtcgtaacggtaccgggaacccttccgggttaccgtttacttccgggttacggtccggacccgggtaacccgggtacccccgtaggggtaacccggggggaaccccggggtttcccttaaaccggggtcccggttacggtaaccgggtcccggg

SEQ ID NO: 121058 - DNA, 791 bp, Homo sapiens
  misc_feature: GYAE6OF01D8F4I.41.2.A02.1.454.CMB.1.raw
  modified_base (202)..(202): a, c, t, g, unknown or other
  misc_feature (202)..(202): n is a, c, g, or t
  modified_base (277)..(277): a, c, t, g, unknown or other
  misc_feature (277)..(277): n is a, c, g, or t
tcagtctatactatcacgaccggtgctcgattttagactcatctacagggggagcatcacccagcaaccacatctgtccctctagagagtcccctgacgagctccgttcctcaccatggactggacctggaggatcctcttcttggtggacagcagcccacgaggacgccccactctcgaggtgcacgctgatgctagtcgngggctggaggtaggacggaacgtccggtcgggcctagaggtagacgtcctctccgtagacgtaacgtcgttacgnggaacttacgtacggttacaacgtaccttactaacgtattacgacggtcgggaccgacggaccgaccgggacccgtaggaacgtacggttacgttacggaggtggtaaggtgggtagtacggactaaccggtaaaccgtaagtcggtaggtacgaacgtacggtaccgtcgtaccgtacggaacctaacggtacgggttaaccggttccggaacgggtaccggtaaccgggtaccaaccggtaacgttacgggtacgttcgggtaaccgaacccggtacccgggaccccgtaaccgggtaccgtacccgtaaccggtaccctaagtaacggttaaccgttaaacccgtttacccgaacggttacgtaacggtacgttaccggagggaacccgttaacggtacccgggtttacctttcgttcgtcggtaccggtaccgacccgggtcccggaggggttacccgggtaaccggggtacccttaccgggttacgggtaccgtcggggttacccgggg

SEQ ID NO: 121059 - DNA, 695 bp, Homo sapiens
  misc_feature: GYAE6OF01AQHAX.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgccccactctcaggtgcagctgatgcagtcgtgggctggaggtgaggagccgtgggcctcgagtgacgcctctccgtgactaacgtccttcgtagggaacttaacgtacgggtttaccaaaccgtactttacctaattaacgttaccgtacggtgggtacgccgaccgtaccggtccccgtaggaccgtagggtccgttaggaggtggagtgggagtacggacgtaaccgtaaccgtaaggtacgtaggtacgactacgcgtcctcgtacgactaacgacggtacggttaccgagggtaccgtaccgggtaccaacggtagtaggtacggtacggtacgacccggtaccggaccgaacggacggaccggaccggtacacggtaacgtaaccggtaaccttaccggtacgttacgtagtaaccgttcggaggaccggtacgttcggttacccgttgtcggtcggtccggaccgacccgggtccgtaacgggcggggaccgggtacccttagggtccggtcgaccgggtaccggg

SEQ ID NO: 121060 - DNA, 629 bp, Homo sapiens
  misc_feature: GYAE6OF01DUES2.41.2.A02.1.454.CMB.1.raw
  modified_base (346)..(346): a, c, t, g, unknown or other
  misc_feature (346)..(346): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgtacttctatatacactgggtgcgacaggcccctggacagggacttgaggtggatgggatggatacgaaacccgtaagaggtggtanacgtacagcctctgaccacgacggtacggttcccaggggaccacggggtacacccgtaagtaggacggttcgggtacgaccggtaccggaccgaaccgggtacgaccggtacccggtaccaaccgtagtacggtaaaccttaccgaagttccgtaggtaacgttcgacggaacggtaccgtacgggtacccgtttacgttcgtggtacgacggtaccggacccccggcggtacggggacccggggggtaccttaccggtaccgggttcgtacggtacccgggg

SEQ ID NO: 121061 - DNA, 737 bp, Homo sapiens
  misc_feature: GYAE6OF01AQUNR.41.2.A02.1.454.CMB.1.raw
  modified_base (248)..(248): a, c, t, g, unknown or other
  misc_feature (248)..(248): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcgaggtgcagtctgatgcagtcgtggggcgtggaggtggaggaagccgtcggggcctcgagtgaagtccgtctccgngacaacgtacgttcgtaggtacgttacgtaggttacaacgtactttactattactaacgtacgtggggtacgccgtaccgacggtccccgtaggacgtacgggtacgttggaggtggagtgggagtcggagtaccgtaaaccgtaggagtaggtacgactacgtacgtcctcgtacgacgacgtacggtacggtaccggacgggtacggaacggggtacctaccggtaagtacgggtaggttacgggtaacgaacccgggaaccgggaccctaaccgggaccggtacccgaccggtaccgaacgtaacggtaaccggtaaaccgttaccgtacgttacgtaggtaacgttcgtacgggacggtaccggtaccgggtttacccgttactttacggtccggttacggcccgggtaccgtcccccgggtagggtaacccgggggtacccgggggtacccttaccgggtacgggtacggttaacgggccgggg

SEQ ID NO: 121062 - DNA, 628 bp, Homo sapiens
  misc_feature: GYAE6OF01DHH3W.41.2.A02.1.454.CMB.1.raw
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgctagtcgtgggctggaggtagaggacgccgtcgggcctcgagtgaagtcctctccgtgacaacgtaccttcgaggaactacgtaacggttcaacgtacttcgtatacgtactacggtgggtacgccgtacgaccggtcccgtaggacgtagggtacttaggaggtgagtggatgactacaaccgtagngttagcgacacncgtcctacgagacacgtaggtacgtccggaggcgacgggtacaccgtagtaggtacgtggacgaccggaccgacgcgacgccgaacggtcagtacgaacgtaaccgacgtagtaccgtagtacgtacgtaggaaccgacgttccggttcctttacggttcgacggtccgaccggacccgtcccggtaggggtaaccggggtaaccgggtcccttagggtaccggttacggtcggtacccgggg

SEQ ID NO: 121063 - DNA, 616 bp, Homo sapiens
  misc_feature: GYAE6OF01A4QEP.41.2.A02.1.454.CMB.1.raw
  modified_base (379)..(379): a, c, t, g, unknown or other
  misc_feature (379)..(379): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtggaggaacgccgtggggcctcgagtgaagcctctccgtgcaacgtacttcgtggtatacgaggttacaacgtacttactatatacacgtgggtgcgacacggccccgtggacgagggacttggagtggtagtgggatggtacacgaaccgtagagtacggtagacacgacgtcctncgacacgtagggtacggttaccgagggccgtaagggcctacgagtaggtaggtggtacgaccgcggaccacggagacccgtacggcaacgagtacggtaacctaccgtagtactagtacgtgtacggacgaccggttaccggtacccgtttagtcggttcgtaccggacgcccggaccccggtgggtaccggggggacccgggttaccaacgggttccgtacggtcggtacccgggg

SEQ ID NO: 121064 - DNA, 751 bp, Homo sapiens
  misc_feature: GYAE6OF01CI2B3.41.2.A02.1.454.CMB.1.raw
  modified_base (327)..(327): a, c, t, g, unknown or other
  misc_feature (327)..(327): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtgcagctgatgctagtcgtgggctggaggtggaggacgcgtgggcctcgagtgaagtctctccgtgacaagtacttcgtgatacgaggttacaacgtacttctatatacacgtggtgcgacgacggcccgtaggactacgggtctaggaggnggtagtgggagtcggaactacgaaaccgtaaggaggtacggtacgaacacgacgtcctcgtacggacaacggtacggtaccgggtaccggaagggtaccgtaacgggtacctaaccgtaggtaggtaacgggtacgggtaacggaaccgggtaccgggacccgtaaacgggacggaccccggtaaccgggaccgaaaccgtaacggttaaccggtaaacccgtttaccgaaccgggttactacgggtaacgttacggtacgggaaccggtaaccggttacccgggtttaccggttttaccttccgggttacgtaccggtacccgggtaacccggtaccccgggttaccggggtaaccggggggtaacccgggggttacccccttaacggggttacccgggttacggtaaccgggttacccgggg

SEQ ID NO: 121065 - DNA, 587 bp, Homo sapiens
  misc_feature: GYAE6OF01BHSI3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttctggatacaggttcaacgacttctatatacactgggtgcgacaggcccctggacagggacttggagtggatgggatggatcaacctaagacgtggtgaacacgagcctctgcacgaggtaggttccgagggcacgggtcaccagtggagtggtcgacgacggaccgacgtacggacgaacggtacccaacgagtacggtaaccttaaccgagtcgttagaaacgttcgtacggaacggaccgtaccgggttccgtttaacttcgtcggtacggccggacgacccccggtcggtacggggacggggggtaccctaacggtaccgggttcgtacgggtacccggg

SEQ ID NO: 121066 - DNA, 560 bp, Homo sapiens
  misc_feature: GYAE6OF01A2NOM.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagccccactctcaggtgcagctgatgcagtcgtggggctgaggtgaggagcctggggcctcagtgaagctctcctgcaagacttctggatacaggttccaacgacttctatatacactgggtgcgacaggcccctggacagggacttgagtggagtcgggatggatcaacctaagagtgtgacacagcctcgtgcacgacgtacggttccgagggcagggtccacgatgagtggtacgacgacggccacgacgaccgaccggtccaacgacgtacggaaccttaccgagttcgtagtaacgtcgtaggacgacgtaccggtaccgttacgttcgtcgtggacggtacgaccccgagtaccggggtacgggggtcctacggttacgtcggtacggtaccggg

SEQ ID NO: 121067 - DNA, 831 bp, Homo sapiens
  misc_feature: GYAE6OF01C6V16.41.2.A02.1.454.CMB.1.raw
  modified_base (197)..(197): a, c, t, g, unknown or other
  misc_feature (197)..(197): n is a, c, g, or t
tcagtctatactatcacgaccggtgctcgatttagactcatctacagggggagcatcacccagcaaccacatctgtcctctagagacgtcccctgagagctccgttcctcaccatggactggacctggaggatcctctttcgttgggtggcagcagccacaggacgcccactctcgaggtgcagctgatgcagtcgnggggctggaggtggaggacgccgtcggggcctcgagtagacgtcctctccgtgacaacgtacttcgtaggacttacgtaggttaccaacgttacttactaattactaacgtacggttgggtacggaccggaacgccgggtacccccggtaggggaaaccgtacgggggttacgttagggtaagggttagggacgggttggggtagttacgggaacgttaacccgtaaaaccggttaaagggtacggttcgggtaacggaaccgaacggtaaccgtcccgttacgcggtaaccgtaaccggtaacgggttaccgggttacccggaagggggtacccgggttaacggggtacccgaaaccggtaggttagggtaacgggttacggggtaccggaaccggaccgggacccgaacggaccggtacccggaacccgggtacctaacggtaacggttaacccgggtaaacccttaccgtaggttaccgagggttaacttcggacgggtaacggaccggttacccgggttacctttagttcggtacggtcgggacccggtacccggtaccccgggtagggggtacccgggggtaacccggggttacctaaccggggttaccggtccggttacgggtccggg

SEQ ID NO: 121068 - DNA, 655 bp, Homo sapiens
  misc_feature: GYAE6OF01CLG4M.41.2.A02.1.454.CMB.1.raw
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcagtgaagctctcctgcaagacttctggatacaggttcaacgacttctatatacacgtgggtgcgacgacggcccctaggacgagggtacttggagtggagtgggatggatcaaccgtaagnggtggtnaacacgacgcctctcgacacgaggtacggttaccgaggggtaccacggggtccaaccgagtaggaggttgggtacgacgaccgggacccgaacggacggaccgtaaccggtacccaacgaacgttaccggtaaaccttacccgaacgttcgtacggaacgttcgtacggaacggtaccgtaccgggtacccgttttacgttccgtcggttacggaccggaacccggtacccccggtacgggtaccggggggtaacccgggggggtaccttaacccgggtttaccgggtccggtacggtacccgggg

SEQ ID NO: 121069 - DNA, 636 bp, Homo sapiens
  misc_feature: GYAE6OF01BQ9WF.41.2.A02.1.454.CMB.1.raw
  modified_base (280)..(280): a, c, t, g, unknown or other
  misc_feature (280)..(280): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtgggcctcgagtgaagctctctgcaagtcttcgtggatacgagttcaacgtcttctatatacagtggtncgacgcggccctaggacgaggtacttggagtggagtgggatggactaccgaaaccgtaggagtggtagacctacgacgcctagtcgaccgacgacggtacggttaccgagggtacgtacgggtaccaccgtagtaggaggtacggtacgaccgtaccggaccgacggacgccgaaccggtcccaacgtacgtacgtaaaccgttaccgacgtacgtaggtaacgtcgtaggtaaccggaccggtaaccgggttccgtttacgttccgtcggtacgacccgggtacccggaccccggtacgggtaccggggtaaccgggggtcccttaacgggtaccggttcgtaccgggtaccggg

SEQ ID NO: 121070 - DNA, 752 bp, Homo sapiens
  misc_feature: GYAE6OF01DL8HC.41.2.A02.1.454.CMB.1.raw
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagcccacgaggacgccccactctcgaggtgcagctgatgcgagtcgngggctggaggtgaggagcggtgggcctgagtgagctctcngcaagtactcgtagatacgtacgttacaacgtcttactatatactacggtggtcgcgacgacgcccgtaggacgacggtacgttggagtggaggtggtagtacggactaccgtaaccgtaagaggtggacgacgacgacgtcctacgtcgacgtacgacggtacggtaccggacgggtacgacggttaccgaccgttaggtacgggtaggtacgggtacggaacccgaaccgggtccgaaccgggtacgaccggtaaccggacctacgtaacggttaaccggtaaacccttaccggtaacggttaccgtaaggttaacggttacggacggtaaacccgggtacccgtttaaccggggtttacccttttaacggttcccggttaagggtccccggtaaacccgggttaccccgggacccccggggttaaggggaaccccgggggggttaacccggggtttcccggtaaacccgggttacccggggtttaacgggtcccggggtttaacccggggg

SEQ ID NO: 121071 - DNA, 989 bp, Homo sapiens
  misc_feature: GYAE6OF01D0UNS.41.2.A02.1.454.CMB.1.raw
  modified_base (53)..(53): a, c, t, g, unknown or other
  misc_feature (53)..(53): n is a, c, g, or t
  modified_base (163)..(163): a, c, t, g, unknown or other
  misc_feature (163)..(163): n is a, c, g, or t
  modified_base (179)..(179): a, c, t, g, unknown or other
  misc_feature (179)..(179): n is a, c, g, or t
tcagtctatactatcacgaccggtgctcgatttagactcatctacagggggancatcacccagcaaccacatctgtcctctagagagtcccctgagagctccgttcctcaccatggactggacctggaggatcctcttcttggtggcagcagccacgaggacnccccactctcagggtncgagcgtgtgtcgacgtggttcgggtgggtcgtaggtacgggtaggaacggtaccggtccgggtccgggtcctagaggtacgacgttcctccgtaccgacgaacgtacgttaccgttcgtacggtacgttaccggttaaccggttaccaaccgttactttaactacgtaacgttaccggtaggggtacgggtaccggacccggaaccgggtccccggtaccccgggtagggtaaaccgggttaccggggtttaagttaggggaacgggttaggggtacgggtaggggtaacgtaccggggtaaacttaaaccccgggtaaaacggttaaaggggtccgggttagggaaccaaaccggtaccgtccgttacctcggtaaccgaaaccggttacggtaaccggggttaccgggttacccgggaagggtcccggttaacgacccgttaaaggtcggtttacgggagggtttaaccggaccccgggaacccggaaacccgggacccgaacgggtacctaccccggggttaaccccgaaccctaaagggttaaccgtaaaccccggggttttaaacccttaagggttccgtaaccgggtaacgtttaaacccggggtacggtaaccggtaaccccgggggttaaccgtttttaaccccgtttcccgggttttttaaccgtggtacccgggtaacccggttacccggggaaaccccccggttaccgggggttacgggggggggtaaacccggggtacccggggttaccctttaaacccgggggaccgtttacggggaacccggttcccgggggggg

SEQ ID NO: 121072 - DNA, 672 bp, Homo sapiens
  misc_feature: GYAE6OF01EIDRE.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggaagcctggggcctcagtgaagctctcctgcaagacttctggatacaggttcaacgtacttctatatacactgggtcgacgacacggcccctggacgagggtacttgagtggagtgggatggatacgaaccctagaggtggtacgactacgacgtccgtctcggacacgaggtacgggttcccgaagggtcgacgggtccaaccgtagtagggtaggtggtacggaaccgaccgggacccaaacgggacgaccgtaaccggtacccgaacgaacgtaacggtaaccgttaacccgtaagttaccttacggtaaagttccgtagggaaccggtaaccgtaaccgggttacccgttttaaccgtttccgttggttacggtaccggtaacccggtaccccccgggtacgtaacggggtaaccgggtaccggggggtaacccctttacggtaacccgggttcggtaaaccggg

SEQ ID NO: 121073 - DNA, 644 bp, Homo sapiens
  misc_feature: GYAE6OF01ANKCQ.41.2.A02.1.454.CMB.1.raw
  modified_base (205)..(205): a, c, t, g, unknown or other
  misc_feature (205)..(205): n is a, c, g, or t
  modified_base (389)..(389): a, c, t, g, unknown or other
  misc_feature (389)..(389): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgccccactctcaggtgcagctgatgcagtcgtggggcttaggnggaggacgccgtggggcctcgagtgagctctctgacagtctgtaggactacgtaggttacaacgtcttctatactacgacgtgggtcgaccgacgaccggccccgtaggaccgagggtacttagggaggtagggagttagggagttaggactaaccgaaaccgtaggaggtaggtacacgacgngtccctgtacgacgacgtaggacggttaccgacgggtacgtacggtacacgtaggtaggtaggtcggacggaaccgaccgggtaccgacggtacgacccggtacggtacccgtaagtacggtaacggtaaacccgttacgtacgtacgtacgtacgttcgacggacggtacccgtacggttcctttacgtcgtcgtcggccgtaccgtccggcggtaggggacccgggtctacgtacgtcggtacggtgtacggg

SEQ ID NO: 121074 - DNA, 721 bp, Homo sapiens
  misc_feature: GYAE6OF01E0VFP.41.2.A02.1.454.CMB.1.raw
  modified_base (581)..(581): a, c, t, g, unknown or other
  misc_feature (581)..(581): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcgtagtcgtgggctggaggtggaggaagccgtggggcctcgagtgacgctctcctgacaagtcttcgtgtactacgtaggttaccaacgtactttacgtaatacttaacgtaacggttcgggtgaccgtacgaccgggtccccgtagggaccgtaagggtactttaggaggttgggaaggttacggggataggtaacctaaacccgtaaacccgtaaagggtacggtggtaaccgaaccgaagaccgtacccgttcgacggaccgtaacgtaacgggttacggttacccggaacggggacccggtacggggtacctaacgaggttacgaggggtcgtacggacccgtaccggaccgtaacgacgacccgtaccggaccaataaggccgttaaaccncgtacgtacgtaagacgttccgaggaccggtaaccggtccggttccgtttaacgtcggtcgtacgacccgggacgtacccccggtagggacccgggggtaccggggtaccttaaccggtacgggttcgaccggtaccggg

SEQ ID NO: 121075 - DNA, 650 bp, Homo sapiens
  misc_feature: GYAE6OF01DBU90.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagcgtgggcctgagtgagctctccgtgacaagtacttcgaggatacgtaggttaccaacgtacttctatatacacgtggtcgacgacgaccggccctaggacgagggtactggagtgagtgggatggactaccgaaaccgtagaggtggtagaacatacgcctgtacgacacgtaggtacggttccgagggtacgagggtaccacgtagtaggaggttggacgaccggaccggaccgacggacgaccgacgtaccacgacgtaacgtaaccttacccgagtacgtagtacgtacgtacgggaaccggtaccgtaccggttaccgtttacgttccggtacgggtaccggaccggtacccgggtaccccggtacggggttacccgggggtaacccgggggttaaccccttaccgggtacccgggttcggtaacgggttaccccgggg

SEQ ID NO: 121076 - DNA, 757 bp, Homo sapiens
  misc_feature: GYAE6OF01AX665.41.2.A02.1.454.CMB.1.raw
  modified_base (542)..(542): a, c, t, g, unknown or other
  misc_feature (542)..(542): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcgagctgatgcaggtcgtgggcgtggaggtaggaggaacggccgtggggcctacgagtggaacgccttcgtccgtagactaacgtcttcgtaggactacgtagtacaacgtacttctatacgtactcggtggtcgaccgaaccgccgggtaccccgtaggaaccggtacgggtacgtttagggaagggttacggaaggttacggggaagttcggggaaaccttaacccgaaaccggttaaggtacggttaggtaccgaacgtaccgaccgttccccgtagtacgaccgtaacggtagggtaacccggttccggaggggtacccgtacgggtaccaaaccgttaggtacgggtacggttcgggaanaccccgggtacggaaccgaaggaccgacccggaaccgttaccgactaacggttaccgggtaaaccttcgaaccgttcgaagtcgggttacgacggtacggtaccgttaccgggttacttacccgttggaacgtaccgggacggtcccggaccccgggtagggtacccggggggtaccggtaacttaacccggtcggtaccgtacggggtcccggg

SEQ ID NO: 121077 - DNA, 665 bp, Homo sapiens
  misc_feature: GYAE6OF01C3WJ9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcgaggtgcagctgatgcagtcgtgggctgaggtgaggagccgtgggcctcgagtgaagctctccgtgacaagtacttcgaggactacgtacggttacaacgtacttactatactacgacgtgggtacgcgacgaccggccccgtggacgtagggtacttggaacggtggagtagggataggactacccgaaaccgtaaggtcggtggtacgaccgacgtacggtcctagtcgacgtaacgacgggtcgggttaccgaggggccgtaaggggtccaaccggagttaggacggttagggaccgaccgaaccgggccgaacggacgtccggaaccggtaccaagtacgtaacggtaacccttaacgtggtacctaggaacttacggagaacggtaaccgtccggttaccctttacgtgtcggtacggaccggtaccgacccgggtcgggacgggggtaacccggggtacccttaggtacccgggtgttaccggtacggg

SEQ ID NO: 121078 - DNA, 641 bp, Homo sapiens
  misc_feature: GYAE6OF01BGC97.41.2.A02.1.454.CMB.1.raw
  modified_base (350)..(350): a, c, t, g, unknown or other
  misc_feature (350)..(350): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtggaggagtcgtggggcctcagtgagctctctgacaagacttcgtggactacgaggttacaacgtacttactatatacacgtgggtcgacgacgacggcccgtaggacgaggcttggagtggagtggatggactacgaaccgtaaggngtggtagaacacgacgtcctgtcgacacgtaggtacgggttaccgaggggtacacgggttaccacgtagtcggacggtaggtacgaccgaccgggaccacggagccggacgtacaacgtgtacgaaccttacgagtacgagtacgtcgtaggaacggtaccgtacggttaccgttttacttcggtacgggttccgaccgggtacccgggacccccgggtacgggttaacgggggggaaccccggggttaccgttaaccgggttaacggtaccgggttacggtacccggggg

SEQ ID NO: 121079 - DNA, 638 bp, Homo sapiens
  misc_feature: GYAE6OF01BDNF5.41.2.A02.1.454.CMB.1.raw
  modified_base (193)..(193): a, c, t, g, unknown or other
  misc_feature (193)..(193): n is a, c, g, or t
  modified_base (244)..(244): a, c, t, g, unknown or other
  misc_feature (244)..(244): n is a, c, g, or t
  modified_base (313)..(313): a, c, t, g, unknown or other
  misc_feature (313)..(313): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (520)..(520): a, c, t, g, unknown or other
  misc_feature (520)..(520): n is a, c, g, or t
tcagtctatactatcacgaccggtgctcgatttagactcatctacagggggagcatcacccagcaaccacatctgtcctctagagagtcccctgagagcctccgttcctcaccatggactggacctggaggatcctcttcttggtggcagcagccacaggacgcccactctcaggtgcagctgatgcagtcgnggggctggaggtgaggacgccgtggggcctcgaggtgaagtctccgtccgngtcgaaacgtccgttcgtagactaacgtacggttaccaacgtactttactatacgtacacggtgggtcnccgacgaccggccctaggacgtagggtactgaaggtggagtagggtatcggactacgaaccgtaagngtcgganaccacgcgtccgtgacggactaacgtaggtacggtaccgaggggtaccgcgggtaccaacgtaggtggacggtcggtacgaccgtaccggaccacggacgtaccgtcgtacccacgtagtaccgtaacctacncggtactaggtactcgtaggacgtaccgtaccgggtttaccgttagtcgtcggtccgacggcccggtaccgacgggtcggggtacccgggtactacggtacgtcgtacggtaccgggg

SEQ ID NO: 121080 - DNA, 659 bp, Homo sapiens
  misc_feature: GYAE6OF01A4B46.41.2.A02.1.454.CMB.1.raw
  modified_base (312)..(312): a, c, t, g, unknown or other
  misc_feature (312)..(312): n is a, c, g, or t
  modified_base (552)..(552): a, c, t, g, unknown or other
  misc_feature (552)..(552): n is a, c, g, or t
tcagtctatactatcacgaccggtgctcgatttagactcatctacagggggagcatcacccagcaaccacatctgtcctctagagagtcccctgagagctcctttcctcaccatggactggacctggaggatcctcttcttggtggcagcagccacaggacgcccactctcgaggtgcagctgatgcagtcgtgggctggaggtgaggacgccgtgggcctgagtgaagctctcctgacaagtacttcgtaggatacgtacggtactaacgtacttactatatacgacgtgggtcgacgacgcggtccccgnggacgagggtacgtggtaggtaggtagtagggtagtcggaacttaccgaaaccgtaaggtaggtacggacgtaaccgtacgtaccgtccgtcgacgacgaacggtacggtaccggtaccgggaggtaccggtacgtacccacggtagtaggtacggtcggaaccgtacccgggaccggacccgaacgtacggacccgacggtaaccacgtacgtaaccggtaactcgtacgtgtacgtancgagaccggtaccgttaccgttacgttacgtcggtcgacgaccggcccggtaccgggtaccggaccggggggtaccggtacctaccgggtacgtcgtacggtccggg

SEQ ID NO: 121081 - DNA, 624 bp, Homo sapiens
  misc_feature: GYAE6OF01ESK44.41.2.A02.1.454.CMB.1.raw
  modified_base (270)..(270): a, c, t, g, unknown or other
  misc_feature (270)..(270): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctgaggtgaggagccgtggggcctcgagtgagcgtctctgcaagacttcgtggatacgaggttacaacgtacttntatatactgtgggtgcgacgacggccctaggacgagggacttggagtggagtgggatggaactcgaaacccgtaaggaggtggtagacgacgacgacctcgacgcgacgtaggtacggttaccgagggccgtacgggtaccacgagtagtaggtggtacgaccgaccggaccgtaacgacgaccgacggtacccacgtagtacggtaacctaccgagttacgagtaacgtcgacgacggaccgtacgggttcccgtttaacgttcgtgttaccggacccggacccggaccccggtacgggacggggtaacccggggtacccgttaacggtcccgggtacgtacggtacccgggg

SEQ ID NO: 121082 - DNA, 641 bp, Homo sapiens
  misc_feature: GYAE6OF01CPNZ8.41.2.A02.1.454.CMB.1.raw
  modified_base (194)..(194): a, c, t, g, unknown or other
  misc_feature (194)..(194): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcagccacgaggacgccccactctcgaggtgcagctgatgcagtcgngggctgaggtgaggaacgccgtgggcctcgagtgacgctctccgtgacaagtacttcgtagtactaacgtaggttaccaaacgtacttactaagtactaaccgtaggtcgggtcgcgaaccgaccggtcccccgttagggacgtaacggggtacttgggtaaggtggaggtacgggaatacgggaactaaccgaaaccgtaagggagttcggactacgacgaccgtcctcgtagaccgaagacggtacggtccgagggcgtacgggtacacgtagcggtaggtacgtacgaccgaccggccgaacgacgccgaacggccaagagtacgtaactacgagttcgaagtagtcgagaccggacgtaccggttcttagtcgtggtcgacggaccgaccccgggtgggtaccggggacccgggttacctagggttaccgtggccggtacggg

SEQ ID NO: 121083 - DNA, 734 bp, Homo sapiens
  misc_feature: GYAE6OF01D9CCE.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggagccgtggggcctcagtgaacgctctcctgacaagacttcgtggatactaggttaccaacgtacttctaatatacacgtgggtcgcgacgacggccctaggacgagggacttggaggtggagtgggagtggactacaacccgtaagtaggtaggtacgaacacgagccctacgtcgacctaacgtacgggtaacgggtttaccggaacggggtaccgtaacggggttaccaaacccggtagttacgggaaggttcggggtaccggtaaccgaaccgggtacccgaaacggaccgggtacccggtaacccgggtaccaccgtaacggtaaccggttaaccgttaaccgtacggttaaccgttacggtaacgttacggtaacgggtacggaacccgtaccgggtttacccgttttaccgttcggtcggttcggaacccggtcccggtacccccgggtacggggtacccggggggtaacccggggggtaccgttaaccgggttacccggttggtaacgggttaccccggggg

SEQ ID NO: 121084 - DNA, 724 bp, Homo sapiens
  misc_feature: GYAE6OF01CIC0S.41.2.A02.1.454.CMB.1.raw
  modified_base (145)..(145): a, c, t, g, unknown or other
  misc_feature (145)..(145): n is a, c, g, or t
  modified_base (242)..(242): a, c, t, g, unknown or other
  misc_feature (242)..(242): n is a, c, g, or t
tcagtctatactatcacgaccggtgctcgatttagactcatctacagggggagcatcacccagcaaccacatctgtcctctagagacgtcccctgagagctccgttacctcaccatggactggacctggagatcctcttcttggngcagcacgccagaggacgcccactctcgaggtgcagctagactgcgagtcggtagggctaggaggtacggaggacgtcggtgggcctagagtagacnctctctagacagtacttcgagtactacgtagtacacgttactactatactacgtaggtcggacgaccgacgaccgcccggtaggaccggtaggtactgggagtacggaggtggagtacggaactaccgtaaacgtaggtaggtggacacgtacgtacgtcctacgacgacgtaacggtaggtaccggttacggacgggtacgtaccggtacaaccgtaggtacggtaggtacggacgaccgggaaccggcccggaacggtaccgtaccggaacccggtaacctaacgggttacgtaacccggttaacgttaccgtaaggtacccgtacggtaacgttaccgggaccggtaaccggtaccggttacccgttttaccggtcggttaccgtcgggtaccgggaccggtacccggcccgggttaaccggggtaacggggcccggggttacccttaaccggggtaccgtcgggtacgggtacccggg

SEQ ID NO: 121085 - DNA, 593 bp, Homo sapiens
  misc_feature: GYAE6OF01BZCXV.41.2.A02.1.454.CMB.1.raw
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagctgggcctgagtgagctctctgcaagtcttctggactacaggttcaacgtacttctatatacactgggtgcgacgcggccctggacagggcttggagcggatggganggactcgaaccgagcgtggcgacacagccgtcngaccacgagtacggttccgacgggacgagggtccaacgagtaggaggtggtacgaccgacggccgacggacgaccgaccggtccaacgtacgtacggaaacctttaccgacgttacgtacggaacgttccgtacgggtaacggaccgtaccgggttacccgtttacgttcgtacggtcggccggtacccggaccccggtcggtacggggaaccgggggtctaacggtccggtacgtacggtaccggg

SEQ ID NO: 121086 - DNA, 747 bp, Homo sapiens
  misc_feature: GYAE6OF01A56S6.41.2.A02.1.454.CMB.1.raw
  modified_base (156)..(156): a, c, t, g, unknown or other
  misc_feature (156)..(156): n is a, c, g, or t
  modified_base (191)..(191): a, c, t, g, unknown or other
  misc_feature (191)..(191): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccanaggagcccactctcaggtgcagctgatgcagtcgngggctggaggtgaggacgcgtggggcctcgagtgacgtctctctgacaagtacgttcgaggactacgtacggttacaacgtaccttacgtaattacgtaccgaacggttgggtcggaccgaaccgaccggtacccccggtagggaaccgtacgggtacgtttgggagggtagggtacgtaggggtaacgtaggtacgtaacccgtaaacccgtaagggtacggttacgggtacgaaaccgtacgtaaccgtcccgttacgtacggaccgtaacggtacgggtacgggttaccggacggggtaccgtaacggggtaccctaacgtaggtacgggttaggtacggtaaccgtacggaacccggtacccgaacgaccgggtaccgtaacccgggtaccaaccgtacgttacccggtaaaccgttacccgtaggttaccgtacggtaacgtcgggtacggaaccggtaccgtccggttaccttacggttcgtcgtacggcccggaccgccccggtaaggcggggtacccgggtactaccgtacggtacgtcggtaccggg

SEQ ID NO: 121087 - DNA, 614 bp, Homo sapiens
  misc_feature: GYAE6OF01AUYYU.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggagccgtggggcctcagtgaagctctcctgcaagacttcgtggatacgaggttacaacgtacttctatatacacgtgggtgcgacgcggccctggacgagggtactggagtggagtgggatcggataccaaaccgtaagagtggtgacacgacgtcctagcgacacgaggtacggttaccgagggcgtacgggtccacgagtagaggttcggtacgaaccgtaccggacccgaacggacggacccgtaccggtaccaacgtacgtacggtaaccttacgagttactacggaagttcgtagacggtacgaccggttccgttacgttcgtcggttcgaccggtacccggaccccggtgggtacggggtaacccgggggtacctacggttaccggtcgtaacgggtaccggg

SEQ ID NO: 121088 - DNA, 740 bp, Homo sapiens
  misc_feature: GYAE6OF01APBP3.41.2.A02.1.454.CMB.1.raw
  modified_base (659)..(659): a, c, t, g, unknown or other
  misc_feature (659)..(659): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggacgccgtggggcctcgagtgaagctctcctgcaagtcttcaggatacgaggttacaacgtcttactatatactcggtgggtcgacgtacgaccgggtccccgtagggacgacgggtacgttaggtaggtaggagtgggaactcgggtaaactaccgaaaccggtaaggacggtggtaacgaaccacgtacggtacctcgtacgacgaacggtagggtaaccggtccgacggggtaccgtacgggtacccaacgtagttacgggagtcgggtaacgacgaccggtaccgaacggacgacccgaccggtaccaacgtaacgtaccggtaaacttcccggtaagtaccgtacggtaaacgttaccgtaggaccggtaaccggttaccggggttaaccccgtttttagttacccggttagggtacccgggtacccgggtacccgtaccccccggggngggttaaaccccgggggggtacccgggggttaacccttaaccggggttaccgggttaccggtaacccgggttaccccgggg

SEQ ID NO: 121089 - DNA, 650 bp, Homo sapiens
  misc_feature: GYAE6OF01BUSMO.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagccgtggggcctcgagtgaagctctcctgcaagtcttctggatacgaggttcaacgtacttctatatacacgtgggtgcgacacggcccctggacgagggaccttggaggttggagttgggattgggaactaccgaaacccgtaaggaggttgggtagaaccacgagtccctcgtggacacgtaggtacgggttccgagggccgacgggtcaccgagtggagtgggtacgacgaccggacccacggacgacgaccggtaccaacgacgtacggaaccttaccgagttaccgtaggtaacgtcgtaggacgggtaaccgtaccgggttacccgttttacgtttaccgtcggttccggaccggtacccggacccccgtacgggtacggggggtaacccggggggtccctaaccgggttaaccgggttccggtaacggggtacccggg

SEQ ID NO: 121090 - DNA, 722 bp, Homo sapiens
  misc_feature: GYAE6OF01CA7LX.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtctggggctgaggtgaggaagccgtggggcctcgagtgaacgctcctcctgacaagtaccttcgtaggaactacgtacggttaccaaacggtactttacgttaataactactaacggtgggtcgaccgaccgaccggcccccgtagggaaccgtagggtacctttaggaggttgggtacgttagggattagggtactaccgaaacccgtaaggtacggtaggtacgaacgacgacggtcccttacgtagacctaacgtacgggtacgggtttacccgaaggggaccgtacgggtaccaacgtagtaggtggtacggtacgaccgacggacccgaacggacgtaccgtaccggtaccaacgtacggtacgtaaccttaccgaggttaccttagaacgttcggacgaacggtacccgttaccgggttacccgtttacgttcgtggttacgaccggtacccggccccggtagggttaccgggggtaacccgggggtacccttaaccgggtacgggttacgtaacccgggtaccgggg

SEQ ID NO: 121091 - DNA, 591 bp, Homo sapiens
  misc_feature: GYAE6OF01BES24.41.2.A02.1.454.CMB.1.raw
  modified_base (191)..(191): a, c, t, g, unknown or other
  misc_feature (191)..(191): n is a, c, g, or t
  modified_base (544)..(544): a, c, t, g, unknown or other
  misc_feature (544)..(544): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgnggggctgaggtgaggaagccgtgggcctcgagtgaagctctcctgcaagacttctggatacgaggttcaacgtacttactatactacacgtgggtgcgacaggcccctggacgagggactggagtggagtgggatggatacgaaccgtaagagtggtgaacacgacgcctgtcgacacgaggtacgggtaccgagggacgtacgggtacaacgtacgtaggtacggtggtacgaacgacggacccgaggacgccgaccggtaccacgtacgtacgtaacttaccgagtcgtagtacgtcgaggacggacgtaccggtccgtttacgttcgtggtcggtcggaccgaccccggnggtaccggggtacgggggtacctacggtacggtcgtagggtacccgg

SEQ ID NO: 121092 - DNA, 670 bp, Homo sapiens
  misc_feature: GYAE6OF01BHI8Z.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagccgtggggcctcgagtgaagctctcctgacaagtacttcgtggatacgaggttcaacgtacttctatatacagtgggtgcgacgacggccctggacgagggtactggagtggagtgggatggactaccgaaaccgtaaggagtaggtacgaacacgacgtccctcgtacgacacgacggtacggttaccggagggtacgacgggtaccaacgtagtaggtacggtacgggtacgaccgaccgggacccgaacggacgaccgtacccggtacccgtaacgaacgttaaccgggaacctttaacccgagttaccgtaaggtacgttcgacggtaacggaaccggtaccggttacccgttttaccgttcggtcggtacgggacccggaccgggtaccccggtcgggtaaccgggggtaccgggggtcccttaaccgggtaccgggttccgtacgggttaacccgggg

SEQ ID NO: 121093 - DNA, 670 bp, Homo sapiens
  misc_feature: GYAE6OF01DZK9N.41.2.A02.1.454.CMB.1.raw
  modified_base (606)..(606): a, c, t, g, unknown or other
  misc_feature (606)..(606): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggacgcccactctcgaggtgcagctgatgcagtcgtgggctgaggtgaggagcgtgggcctcgagtgaagctctcctgcaagacttcgtaggatacgaggttacaacgtactttctaatataccgtactggggcgcgacgacggccccgtaggaccgaggtacgttggaggtggagtgggatacggataccgaaaccgtaggaggtgtgacgacgcgtcctcgtacgaccgactaggtacggttccgacggggactacgggtacaaccgtagtacggaggtcgggtacggaccgaccgggaccaaccgggacgcccgtaaccggtaccaacgaacgttacggtaaacccttaccgacggttacgtagtaacggtctacgggtacgaaccgtaccgggttacccgtttaccgtttcgtccggtaggacccggtaccgggtacccccggngggttaccgggggtaacccgggggtcccgtaaccggttaccggttccgaacggttacccggggg

SEQ ID NO: 121094 - DNA, 768 bp, Homo sapiens
  misc_feature: GYAE6OF01CKNYV.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggagccgtgggcctcgagtgaagctctccgtagcaacgtacttcgtaggtataacgtaggttaccaacgtacttactatactactacgtggtcgacgacgacggcccgtaggacgaggtacgttggaggtggagtgggagtggactaccgaaccgtaaggacgtggtacgaacgacgacgccgtacgtcgacacggaggtacgggttcccgaaggggcgtaacggggtaccaacggtaggtacggtaacgggtacgggtacggaacccgaaccgggacccgaacgggaacgtacccggtaacccggtacccgaaacgttacgggttaaaccggtaaacccgtttaacccgtaacgggttaccgttaagggtaaaccggtttcggtaacgggaaccggttaaccccgtaccggggtttaccccgttttaacgttcccggttaaggtcccgggaacccgggtaaccccgggtaaccccccgggtcggggttaaccgggggggaaccccggggggttacccttaaacccgggttacccggggttaccgttaccgggtaacccggggg

SEQ ID NO: 121095 - DNA, 609 bp, Homo sapiens
  misc_feature: GYAE6OF01CWS55.41.2.A02.1.454.CMB.1.raw
  modified_base (191)..(191): a, c, t, g, unknown or other
  misc_feature (191)..(191): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcgaggtgcagctgatgcagtcnggggctgaggtgaggaagccgtggggcctcagtgaagctctcctgcaagacttcgtggaatacgaggttacaacgtacttctatatacacgtggtgcgacgcggcccctggacagggtacttggagtggagtgggatggataccgaaacccgtaaggtaggtcggtagacacgacgccttacgtcgacacgaggtacggttacgagggcgacgggtacaacgtagtaggtaggtcggtacggaccgaccggaccgaacggtacgccggtaaccggcctaacgtagtaacggtaaccttaccgtagtcgtagtacgtcgaggacgaccgccggttccgtttctcgttggtacgacggtacccgcccggtacggtacgggggtacccggggtacttaggttacgtcggtcggtaaccggg

SEQ ID NO: 121096 - DNA, 736 bp, Homo sapiens
  misc_feature: GYAE6OF01DNM55.41.2.A02.1.454.CMB.1.raw
  modified_base (203)..(203): a, c, t, g, unknown or other
  misc_feature (203)..(203): n is a, c, g, or t
tcagtctatactatcacgaccggtgctcgatttagactcatctacagggggagcatcacccagcaaccacatctgtcctctagagacgtcccctgagagcctccgttcctcaccatggactggacctggaggatcctcttcgttggtgcagcagccaacgaggacgcccactctcgaggtgcagctgatgcgtagtcgtgggntggaggtggaggagtcgtcgggcctagagtaggacgtccttccgtccgtagacgtaacgtaccgtttcgtaggtaacttaacgtacgttaaccgaacgtactttactaattaactacgacgttagggtcgacgtaccgaccggtcccgtaggacgtacggtagtaggaggtaggtaggtggtagtacggtaacctaaccgtaaaccgtaggtacggttacggtaaacgaccgtaacgtacgtcccgtacgtacggaaccgtaacggaacggtaccgggtaccgggaacgggaccgggttaacggtacccgaacggttaggtacggtacgggttcgggaaccgaaccggtacccggaaccgaacggacccggtaaccgtaccggtaacgaacgtacggtaacggttaaacctacggtacgttacgaggttaactcgtagggaaccgtcgttaccgttcccgttagccggttcgacgacgggtacccgcccgggaggtaaccgggggacggtactacggtcgtcggagtcccggg

SEQ ID NO: 121097 - DNA, 681 bp, Homo sapiens
  misc_feature: GYAE6OF01ASCFS.41.2.A02.1.454.CMB.1.raw
  modified_base (292)..(292): a, c, t, g, unknown or other
  misc_feature (292)..(292): n is a, c, g, or t
tcagtctatactatcacgaccggtgctcgatttagactcatctacagggggagcatcacccagcaaccacatctgtcctctagagagtccctgagagctccgttcctcaccatggactggacctggaggatcctcttcttggtggcagcacgccacaggacgcccactctcgaggtgcagctgatgcagtcgtgggctggaggtgaggagccgtggggcctcagtgagtctctcctgacaagtcttcgtggactacgaggttacaacgtacttactatatacacgtgggtanacgacgacggccctagggacctagggtacttggaggtaggagtggggatggtaactaccgaaaccgttaaggacggtggacgtaacacgacgtcctgtcgacacgtagggtacggttccgaggggtacgacgggtaccaacgtagtagaggtcggtacgacgaccggacgacggacgaccgtacggaccacgtacgtacggaaccttacgtacgtcgtacggtacgttacgtaggaccggtaacgtaccgggttacccgttttaccgttaccggttagggtaccggaccggtaccccggtaccccgggtcggggttaaaccgggggggtaaccccggggggttacctttaaaccgggtcccgggttaaccggtaacgggtaccccgggg

SEQ ID NO: 121098 - DNA, 653 bp, Homo sapiens
  misc_feature: GYAE6OF01CS1U5.41.2.A02.1.454.CMB.1.raw
  modified_base (255)..(255): a, c, t, g, unknown or other
  misc_feature (255)..(255): n is a, c, g, or t
tcagtctatactatcacgaccggtgctcgatttagactcatctacaggggggagcgatcacccagcaaccacatctgtcctctagagagtcccctgagagctccgttcctcacctatggactggacctggaggatcctcttcttggtggcagcagccacaggagcccactcctcaggtgcagctcgatgcagtcgtggggctgaggtgaggagtccgtggggcctcgagtgaaggctctcctgctaagtcttcgnggataacgaggttaccaacggtacttctattactacgacgttcgggtagcgacgtacggcccctagggacacgggacttggacggtggaggtgggactaggactaccgtaaacccgttaaggtacggttgggaacgtaaccgacgtacggcccgttatcggaccaacggacggtaccgttcggacgggcacgggtaccaaccgagtcgaggtcggtgaccgacggtccgacggtacgcgtaccgtaccacgtagtacggtaaccgttacgagttacgtaggtacgttcgtacggacggttacccgacgggttaccgtttactcggtcgtcggaccggtacccggtcccgagggtacggggacccggggtactaccggtaccggtcgtacggtcccggg

SEQ ID NO: 121099 - DNA, 580 bp, Homo sapiens
  misc_feature: GYAE6OF01BO7A6.41.2.A02.1.454.CMB.1.raw
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
  modified_base (365)..(365): a, c, t, g, unknown or other
  misc_feature (365)..(365): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtgcagctgatgcagtcgtggggctggaggtgaggagccgtggggcctcagtgagtctctcctgacaagacttcgaggatacgtaggttaccaaacgtcttactatatacacgtgggtcncgacncggcccnggacagggtctaggagtggagtggatggactacgaaccgtagngtgacacacacgcctncgacacgaggtacgtcgaggtcgagggtccacgtagtggagtcgggtacgaccgacggacccaggacgcctaaccggccacgtacgtacggtaacctaccgaacgttccgtaggtacgtcgtaggacggtaccgacggttcctttacgttgcggtaccgcggaccgaccccggtggtacggggaccggggtacctacggcgttcgtcggtccggg

SEQ ID NO: 121100 - DNA, 703 bp, Homo sapiens
  misc_feature: GYAE6OF01EYGOF.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggagcccactctcaggtgcagctgatgcagtcgtgggctggaggtgaggagccgtggggcctcgagtgaagctctcctgacaagtcttcgtggatacgtaggttacaacgtacttactaataactacgacgtggggtcgaccggaccgaccggccccgtaggacgagggtacttggagtggtagtgggatggaactaccgaaaccgtaaggtacggtggtacgaacgacgacgtcccgtgtacgacaacggtaggtacgggttaccggaacggggaccgtacggggtaccaaccgtagtacggagggttcggtacggaaccggtaccgggacccgaacggacggacccgtaaccggtacccaacgtacgtacggtaacccttaccgtacgttacgtacggtaacgtacgtacggaacggtaccggtacccggtttaccgtttaccgttcggtcggtacggacccggtaccggtaccccgggacgggtaccgggggtaacccggggggtaccttaaccgggttaccgggtcgtacgggtacccggg

SEQ ID NO: 121101 - DNA, 555 bp, Homo sapiens
  misc_feature: GYAE6OF01D97LB.41.2.A02.1.454.CMB.1.raw
  modified_base (271)..(271): a, c, t, g, unknown or other
  misc_feature (271)..(271): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (501)..(501): a, c, t, g, unknown or other
  misc_feature (501)..(501): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaaggagccgtgggcctcgagtgaagtctctcctgacaagcttcgtggatacgaggttacaacgtcttntatatacactgggtcgcgacgacggcccctggacgagggtacttggacgtggacgtgggatggatccaaccgtagagtggtcgacngacgcctgngcacgaggtacgtcgagggcgagggtcacgagtagaggtggtacgacgtaccggaccacggacgccgacggtaccagacgtacggaaccttaccgagtactaggactcgagacgacgtcgtccgttagtcgtgtncggaccgcccgcggtacgggaccggggtacctaggtccggtgtacggtaccggg

SEQ ID NO: 121102 - DNA, 769 bp, Homo sapiens
  misc_feature: GYAE6OF01BCIPZ.41.2.A02.1.454.CMB.1.raw
  modified_base (196)..(196): a, c, t, g, unknown or other
  misc_feature (196)..(196): n is a, c, g, or t
  modified_base (289)..(289): a, c, t, g, unknown or other
  misc_feature (289)..(289): n is a, c, g, or t
  modified_base (366)..(366): a, c, t, g, unknown or other
  misc_feature (366)..(366): n is a, c, g, or t
  modified_base (384)..(384): a, c, t, g, unknown or other
  misc_feature (384)..(384): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcgaggtgcagctgatgcagtcgtgggntggaggtgaggacgccgtgggcctcgagtgacgctctctgacaagacttcgtggatacgaggttacaacgtacttactatatacgacgtgggngacgaccgacggcccgtaggacgaggtacttggagtggtagtaggagtgtacgactaaccgtagagtaggagacganacgcctctgacactaggngtccgagggcgacggtccacgtataggagtcggtacggacgtaccggacgtaccggacgacccgtaccggggtaccctaacgtaacggtaccggtttaaaaccgtttacccggtaacggtttaccgttaacggttaacggtcgggttaaccgggacggttaaccccgggttaacccccggggttttacccgttttaaacccgggttttccggtttaggggttacccgggtaaacccgggtaacccccggggtaaccccccggggtttaccggggggaaaccccgggggggtttaaaccccgggggggggtaacccccgttttaaacccccgggggtttaacccgggttaacccgggggttaaaccggggtttaaacccccggggg

SEQ ID NO: 121103 - DNA, 687 bp, Homo sapiens
  misc_feature: GYAE6OF01BYT93.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggacgccgtggggcctcgagtgagctctcctgacaagcttcgtaggaatacgtaggttaccaacgtacttacgtatactacacggtgggtgccgacgcggccctaggacgagggtacttggaggtggagtgggatggactaccgaaaccgtaggacggtggtacgacgacgacgtcctcgtacgacctaacggtacgggtaccgggttacggacggggtaaccgtacgggggtaccaacggtaggtagggtacgggtacgggtacggaacccggacccgggtacccgaacggacccggaccggtaacccggtccaacgtaacggtacgtaaaccgttaccgagttccgtaggtacgttcgaggacggtaccgtacggtttcccgtttacgttcggtcggtaccggaccggtacccggcccgggtacgggtaccggggggacccggggttacctaacgggtaccggtcggtacgggtacccggg

SEQ ID NO: 121104 - DNA, 744 bp, Homo sapiens
  misc_feature: GYAE6OF01BFA34.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacgaggacgccccactctcgaggtgcagctgatgcgagtcgtgggctggaggtggagagccgtgggcctcgagtgagctctcgtgacaagtcttcgtaggatacgtaggttacgaacgtaccttacgtaataactaccgacggttcgggtaccgacggtaaccgaccgggtccccgttagggaaccgtacggggttaccgttagggtaacggtgggaaggttaggggacgtacgggtaacgttaacccgaaaaccggttaagggtacggttacgggtaacggtaaccctaacggaccggtacccgtcggtacgacccgtaaacggacgggttaccgggtaccggtacgggaaccggtacgggtacctaaccgtaggtacgggtaacgggttcggaccggaccggaccgggaccgtaaccggacgtaccggtaccggtaaccgaacgtacggtaacggtaacctaccgacgttacgacggttacgtcgtacggaacggtaccgtaccggttcgttaccgttgccgtacgaccggacctcccgggacgggtacgggtaccggggtcctaacggtcggtacgtcggtaccgg

SEQ ID NO: 121105 - DNA, 689 bp, Homo sapiens
  misc_feature: GYAE6OF01C2GGI.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctcctgcaagacttcgtggatacgaggttacaacgtacttctatatacacgtgggtcgcgacacggcccctaggacgagggacttggagtggagtgggatggataccaaaccgtaaggaggtggtagaacacgacggccctcgtcgactagacggtacggttccggagggtcgacggggtacaacgtagtggacggtgggtacgaccgacggaccacggtacgaccgaccggtcaacgtaacgtacggtaaccttaccgacgttacgtaacggtaacgtaccgtagggaacgggacccgttaacccgggttacccggttttaaccgttccgttcgggtacggtacccggaaccccgggtacccccccgggtagggttaacccggggggggtaaaccccgggggggttacccttaaacccgggtaccgggtttaccgttaaccgggtaaccccggggg

SEQ ID NO: 121106 - DNA, 596 bp, Homo sapiens
  misc_feature: GYAE6OF01DBKCV.41.2.A02.1.454.CMB.1.raw
  modified_base (303)..(303): a, c, t, g, unknown or other
  misc_feature (303)..(303): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (380)..(381): a, c, t, g, unknown or other
  misc_feature (380)..(381): n is a, c, g, or t
  modified_base (584)..(584): a, c, t, g, unknown or other
  misc_feature (584)..(584): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtggaggaacgccgtggggcctgaggtgaagctctccgtgacaagtacgttcgtggaataaccgtaggttacaaacgtacttctaatactacgcgttgggcncgacgacggccccgtaggacgagggacttgaggtggagtgggatggactaccgaacgtaggngttgnacancgcctnncgagagtcggtcagggcaggtacacgtagtcggagtggtacgacgaccggaccacgacgacgtacggtacccaagtacgtacggtaacctaccgtgttacgacgagttcgaggacggtaccgtccggtacgttttctcggtcggacggaccgaccggtccccggtaggtaggggggtaaccccggggtcttacgtaccgggtntcgggtaccggg

SEQ ID NO: 121107 - DNA, 725 bp, Homo sapiens
  misc_feature: GYAE6OF01DWWKB.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcagctgatgcagtcgtggggctgaggtgaggaagccgtgggcctcgagtgaagctctcctgacaagtacttcgtaggtactacgtacggttaccaaacgtacctttactaattactaaccgtacgtggggtcgaccggaaccgaccgggcccccgttgggaacgaggggtaactttggaacggttggagtagggataggactaccgaaaccgtaaggaggtcggtagaaccgtacgacgtcctcgtcgacgaacgtagggtacggttaccgaagggtccgtaacgggtaccaaccgtagtacgggaaggttgggtacggaccgacgggaccctaacggacgacccgaccggtacccaacgtacgttaaccgggtaacctttaacccgaggttacttacggtaacgttcggtacggaacggtacccgtaccgggttaccgtttacgttcggtacggtacggaccggtacccggtacccccgggtagggtaccgggggtaacccgggggttacctaaccggttaaccgggttcgtaccgggtaacccggg

SEQ ID NO: 121108 - DNA, 669 bp, Homo sapiens
  misc_feature: GYAE6OF01D0AVM.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagtaccttcgtggaattacgtaggttacaacgtacttctatactactacgtgggtgccgacgacggcccctggacgagggtacttgaggtggtagtgggtatggactaccgaaacccgtaaggagttgggacacgaacgtacgtcccttcgtacgaccgaacgaacgggtacggttaccggacggggtaccgaacgggggtaccaaccgtagtacgggtaaggtgggtacggaccgaccggtccgaaccggacggaccgaccggtacccaacgtacggtaacggtaacccttacgaacggttcgtagtacgtacgtacggacggtacggtaccggttaccgtttacgtcgttacggtaggtaccggaccggtaccccggtgggtaaccggggtaccgggggtacctacgggtacggtcgtcgggtaccggg

SEQ ID NO: 121109 - DNA, 645 bp, Homo sapiens
  misc_feature: GYAE6OF01BKSWH.41.2.A02.1.454.CMB.1.raw
  modified_base (236)..(236): a, c, t, g, unknown or other
  misc_feature (236)..(236): n is a, c, g, or t
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (582)..(582): a, c, t, g, unknown or other
  misc_feature (582)..(582): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagccccactctcaggtgcagctgatgcagtcgtggggctggaggtggaggaagccgtggggcctcgagtagagctcncctgacaagcttcgtgactacgaggtacagtacttacgtatatacacgtgggtnacgacgacggtcccgtagacgtagggtacttagnggtaggtagtgggaagtggtaactaccgtaaacccgtagggtacgtaggtcgaaccagtcgaccgttcgcggaccaggtacggtacgggtaccggacgggtacggtacggggtacaacccgtagtacgggtacggttagggaaccggacgaccgggtaccgacggaccggctaacccgggtcaaccgtacgtaaccgtaacttacgagttacggtatacgtcgtacgggacggtaccgtacggtaccttttacgtcgngttacgcccggtacgacccgcgggtacggggacgggttcctaaggtccgtaggacgttccggg

SEQ ID NO: 121110 - DNA, 805 bp, Homo sapiens
  misc_feature: GYAE6OF01A3JWX.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacaggacgcccactctcaggtgcagctgatgcagtcgtgggctgaggtggaggagccgtgggcctcgagtgacgctcctcgtagacaagtcttcgtaggaactacgtacggttactaacgtactttacgtaattactacctaggttcgggtacgaccgaccgaccggtccccgtagggaacggtacgggtacgttagggaggtagggtagtgggtaagtcggaaccttaaccgaaacccgtagtacggttaggacgtaacgacgacgtacctacgtacgaacgacgacggtaccgggttacgagggtaccggtaggacccacgtaggtagtagggttacgacggaacccgaccgggaccgaacgggacgtaccggtaccccggtaccgtaaacgtaacgggtaaccggttaaacccttaccggtaaggttaccgtaacgggttaaccggttaacgtaacggggaccccgggtaaacccgtttaccggggttttcccccgttttaacggttaccggtcgggtaccccgggaacccggggttacccccggacccccggggttaaacgggggtacccgggggggtaaacccccggggttccctttaaacccggggttacccgggtaacgggtttaacccgggtaccccggggg

SEQ ID NO: 121111 - DNA, 618 bp, Homo sapiens
  misc_feature: GYAE6OF01A7CBW.41.2.A02.1.454.CMB.1.raw
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagccccactctcaggtgcagctgatgcagtcgtggggctggaggtgaggaagccgtggggcctcgagtgagctctcctgacaagtacttcgtggatacgtaggttacaacgtacttctatactacagtgggcncgacncggccctggacgagggtactggagtggagtgggatggactaccaaccgtaggagtggacgacacgacgtcctgtcgacacgaggtaacgtcgagggtcgtagggtccacgagtcggaggtcggtacgaccgacggtaccgacggacgccgtacggtaccaagtacgtacgtaacctaccgagtacgtaggtactcggaggacggtaccgtaccggtttccgtttacgttccggtacggtcgacccgggtacccggaccccgggtcgggtaccggggggtaacccgggtccttaaccgggttcggtacgtcgggtacccggg

SEQ ID NO: 121112 - DNA, 674 bp, Homo sapiens
  misc_feature: GYAE6OF01CHGEC.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcgaggtgcagctgatgcgtagtcgtggggctggaggtggaggacgccgtggggcctcgagtgacgtctctcctgacaagtacttcgtagactacgtaggtacaacgtcttactatacacgtcggtgggtcgaccgaccgaccggccccgtaggacgtagggtacttggaggtggaggtgggagtacggaactaaccgaaaccgtaggaggttacgggtacgaaccacgtaccgtcccgttacgtcgaaccgtacggtacgggtaccggtaccgggacggggtaccgtacgggtaccaccgtaggtacggtaggtcggtacggaccggtaccggaccgtaacggaccgaccggtacccgtacgacgtaacggtaccggtaaccttaccgtagtacgtagtaccgtcgacggaccgtacggtaccgttcgtttactgtcggcgaaccggtccgacccgggtaggtaccggggtacgggtacctacggtcggtacgcggtaccggg

SEQ ID NO: 121113 - DNA, 803 bp, Homo sapiens
  misc_feature: GYAE6OF01CJ584.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggactggaggtggaggaacgtccggtggggcctcgaggtgaagtcctcgtccgtgaccaacggtcttcgtaggtaactacgtacggttacaaaccgtacttacgtacttagtaacctacggtggggttacgacggaccggtaccggccccggtagggaaccggtaacgggtacgttagggaggtcgggagttaggggatacgggtactaacccaaacccggttaaggtacgggttaggtaacgtacgaaccgacgtacccgtacgtacgccgaacgtaacgggtacgggttaaccgggacgggtaccggtacgggtaccgtaaccggtaagtgggtacggtacgggtaccggaacccgggaccgggaaccgaaccgggtacgacccggtaacccggacccgtaaccgtaaggttaacccggtaaccgttaaccggtacgtttaccgtaaggtaaacgttccggtacggaacggtaaccgtcccggtttaccgttacgtttcccgtacgggtacccgaccggtaacccgggtaccccggtcggggttaaccgggggtaaccccgggggttactaacccggggtttaccgtaccgggtacggtacccgggg

SEQ ID NO: 121114 - DNA, 627 bp, Homo sapiens
  misc_feature: GYAE6OF01DVHVV.41.2.A02.1.454.CMB.1.raw
  modified_base (268)..(268): a, c, t, g, unknown or other
  misc_feature (268)..(268): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcagccacaggagcccatctcaggtgcagctgatgcagtcgtgggctgaggtgaggaagccgtgggcctcgagtgaagctctcctgcaagtacttctggactacaggttacaacgtacttntatactacgacgtgggtcgcgacgcggccccgtggacgagggtacttggaggtgagttgggatggactacgaaacctaagagtggtagacacgacgccctgtcgcacgaggtacggttaccgagggcgacgggtccaaccgtagtggaacggttggtacgaccgacgggcccaacggacgccgtaacggtccaacgtacgtacggtaaccgttaaccgagttccgtaggtaacgtcgtaggaaccggaccgttaccggtacccgttttacgttccgtacggtacgaccggttaccggacccccggtgggtacccggggtaccgggggtacctacggttaccggtctaagggtacccggg

SEQ ID NO: 121115 - DNA, 610 bp, Homo sapiens
  misc_feature: GYAE6OF01CB2F5.41.2.A02.1.454.CMB.1.raw
  modified_base (279)..(279): a, c, t, g, unknown or other
  misc_feature (279)..(279): n is a, c, g, or t
  modified_base (370)..(370): a, c, t, g, unknown or other
  misc_feature (370)..(370): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtgcagctgatgcagtcgtgggctggaggtgaggagccgtgggcctgagtgaacgctcgtcctgacaacgtacttcgtggactacgtaggttacaacgtaccttntaatactactacggtgggtcgacgaccgacggccccgtaggacgacgggtacttggaggtggagtgggagtagactaccgaaaccgtaggngtggtacgaactacgacgccttgcgacacgacggtacggtaccggagggaccgtacgggtccaacgtgtaggtaggtggacgacgaccggaccgtacgacgaccgaccgtaccacgaacgtacgtaactaccgagttcgtagtacgtcgtaggacgtacgtaccggtctttacgtcgtcgtcgacggccgacccggtcggacggggaccggggtacctacggtacggtcgcggtaccggg

SEQ ID NO: 121116 - DNA, 657 bp, Homo sapiens
  misc_feature: GYAE6OF01CS8B4.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaacgccgtggggcctcgaggtgaacgctctccgtgacaagtcttcgtggatacgaggttaccaacgtcttactatactacgtacgtgggtcgcgacgacggcccctagggacgagggtacttgaggtggagtgggatggactaccgtaaccgtaagtacggtggtacgaccacgacgtcctcgacgccgtaacgacggtacgggttaccgaggggaccgtacggggaccaccgtagttggacgggttaggtacgaccgaccggacctaacgtacgaccggtacccggtaccaacgtacgtaccggttaacttaccgtagttacgaggtaacgtcgtaggaaccggtacgtaccgggttaccgtttacgtcggttcggtcggaccggtacccgaccccgggtgggtacggggaacccggggtacttaccggtaccgggtgtacggtaccggg

SEQ ID NO: 121117 - DNA, 728 bp, Homo sapiens
  misc_feature: GYAE6OF01CDWUJ.41.2.A02.1.454.CMB.1.raw
tcagtctatactatcacgaccggtgctcgatttagactcatctacagggggagcatcacccagcaaccacatctgtcctctagagagtcccctgagagctcccgttcctcaccatggactggacctggagatcctcttcgttggtggcagcagccacgaggacgcccactctcaggtgcagctgatgcagtcgtggggctggaggtgaggacgccgtgggcctgagtgacgctctccgtgacaagtacttcgtggatacgtacggttacgaacgtaccttactaattaactaacgtaccggttgggtgccgacggaccggcccccgtagggaaccgacgggtacctttagggaggttgggtagtaggggtagtagggtacgtacccgtaaaacccgtaaggtacggtgggtacgaaccgacgtacggcccgttcgtacgaccaacgtacgggttacggttaccgaaggggaccgtagggtaccaaccgtagtcggtaaggtagggtacaccgaccggccgacgacgccggtacgaccaacgtacgtacggtaaccttacgagttaccgtagtacgtacgtggtaaccggaccggtaccggttaccgtttaccgttaccggtcggttacgacccgggacccggtacccccgggtacggggttaacccggggggacccggggttaccccggttaacggtaacccgggttacggtaccgggtaacccgggg

SEQ ID NO: 121118 - DNA, 707 bp, Homo sapiens
  misc_feature: GYAE6OF01A790O.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggaagccgtggggcctcagtgaagctctcctgcaagacttctggatactaggttacaacgtacttctatatacacgtgggtcgcgacgacggcccctaggacgagggacttggaggtggagtgggatgggataccgaaaccgtaagagtggtcgaacacgagtcctcgtgaccaacgaggtacggttaccgagggacgtacggggtaccaaccgagttacggagggtacggttcggaaccgaccgggtaaccgaccgggaaggtaccgaacccgggtacccaacgacgtaacggtaaccttaccgaacgttaccgttagggaaacgttcgtacgggtaacgggacccgttaaccgggttacccgttttaaccgtttccggtacgggttaccggtaccgggtaacccgggtaaccccccgggtcgggttaaccgggggtaaacccggggggggtaccccttaacgggttaacccgggttaccgggtaacggttaaccccggggg

SEQ ID NO: 121119 - DNA, 829 bp, Homo sapiens
  misc_feature: GYAE6OF01BHLPD.41.2.A02.1.454.CMB.1.raw
  modified_base (164)..(164): a, c, t, g, unknown or other
  misc_feature (164)..(164): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccagagggacnccccactctcgagggtcgacgagcttaggatcgcgacgttcggtgggggtactagggaagggtaggaacgggaacggtcccggtacggggcccttaggaggtaggaaccgtccttccgtaccgtagaactaacggtacctttacggtaggaacgttaacgtaacggttaaccgaacgttacttacgttaaacttaacgtaaccgttacggttcggggacaccggtaccggaaccgggtcccgtaaggacggtaacgggtacctttagggagggttaggaaggtggggtaacgtacggggtaaccttaaccgaaaaccggtaaggtacggttacgtacggaaccacgtaaccgtccgttacgacgacgtaacggtacggttacgggtaccgagggtaccggacgtaccaacgtacgtagggacggtaggtaccgaccggtaaccggaccgaacggtaccgaccggtaccggtaaccgtaacgtacggttaacccgtaaccgttaacgaccggttaagacgttaacggacgtaaccgggtaacggtaccccgttaggtttaccccgtttaagtcgtacggtaccggaaccggtacccgggtacccggtggggaaaccgggggtacccggtacttaaccgggtaccggtaagtcccggggtaaccggg

SEQ ID NO: 121120 - DNA, 707 bp, Homo sapiens
  misc_feature: GYAE6OF01BOMSA.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctggaggtgaggaagccgtgggcctcgagtgaagtctctctagcagacttcgtgatacgaggttacaacgtacttactatactacacgttgggacgcggacgacggcccgtggacgacgggcttggacggtggtagtgggacgtacggtacgtaccgtaaaccgtaaggtacggtggtacgaccaaccgtcgtaccctcgtacgacctaacgacgggtacggttccgaacggggcgtacggggtaccaacgtagtacggtaggtcgggtacgtaccgaccggccgtaaacggccgacggaacccggtacaacgtaacgtacggtaacccttacggtacgttcgttaacggaacgttcggaacggtaacgggaccgttacccggttaccgttttacctacggttacggtaccgggtacccgtaccgggtacccccggtacgggttaacccgggggggtaaccgggggtacccgttaacccggttaccgggttccgtaccggggtaacccgggg

SEQ ID NO: 121121 - DNA, 696 bp, Homo sapiens
  misc_feature: GYAE6OF01A9OSF.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctggaggtgaggagccgtgggcctgagtgagctctcctgcaagtcttcgtggaactacgaggttaccaacgtactttactatatacgaacgttggggtcgcggtaccgaacggtccccgtagggaaccgtaggggtacttaggaacggtgggtagtagggggatacggggtataccccgaaaacccgttaaggacggttaggacgaaccgaccgagtacccgtacgtgaccaacgaggttaccggttaccggaaggggtacgaacggggtccaaccggtaaggtagtaacgggttacgggtacgaaccggcgggacccgaacggaccgaccgaaccggttaccaaccgtagtaaccggtaaccttaaccgacgtcgtaaggacgttacgcggaacggacgtaccggttccgtttaacgttcgtcggttacgccgacccggtacccggacggtcggggtaaccggggtaccttaaccggtacggttcgtaacgggtacccgg

SEQ ID NO: 121122 - DNA, 747 bp, Homo sapiens
  misc_feature: GYAE6OF01DLBRI.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttctggtgcagcagccacgaggacgcccactctcgaggtgcagctgatcgcaggtcgtggggctggagggtgaggaacgtccgtcgggcctcgaggtagacgtctacctcgtagactaagtaccttcggtaggtaacttacgtacggttacgacgtacttactaactactacgtacgtgggtacgacgtaccggacggtccccgtaggacgtagggtacgtaggtaggtaggaggtagggacgtacggactaccgtaaccgtaaggtcggtaggtacgaccgtacgacgtcctcgtacgaacgtacgaacgtaccggggtacggtacggaccgtaacgggtccaacgaggttaccgggagttcggggacccaaaccggggtccgaaccccggaaggtacccgtaccggacggttaccaacgtacgtaaaccggtacctaactacggttcaaagggtccgttacgacgggtaacgtaaccccgggtcggttttacccctaggtttcccgagggtcccgtaccgggacccggtacccgggtaagggtaacccggggggggtaccccgggtttaaccaccggggtttacccggttggtaccggggtacccgggg

SEQ ID NO: 121123 - DNA, 712 bp, Homo sapiens
  misc_feature: GYAE6OF01EA528.41.2.A02.1.454.CMB.1.raw
  modified_base (234)..(234): a, c, t, g, unknown or other
  misc_feature (234)..(234): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggagccgtgggcctcgagtgagctcctccngacaagtacgttcgaggtactacgaggttacaacgtacttactaatactaacgacggtgggtacgaccggacgaccggtcccgtaggaacggagggtacttaggaggtaggagtgggtatcggaactaccgtaaaccgtagaggtaggacgaacgacacgtcctacgtcgacgtacgacggtacgttaccggacggggtaccgaggggttaccaacgttggtacgggaggtttacgggaccgtaaccgggacccggtaccgacggaccggtaccgtacccgggttaaccaacgttacggtaaccgtaaccgttaccgacgttacgaacgtacgttaccggaggacggttaacccggtaccggtttacccgtttgttacgtcgggttaccgggacccggtaacccgtacccccggggtgggtaaacccggggggtaccgggtacccttaaccgggtacggttcgtaaccggggtacggg

SEQ ID NO: 121124 - DNA, 700 bp, Homo sapiens
  misc_feature: GYAE6OF01EWMWR.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtggggcctcgagtgaagctctctgcaagacttcgtggatacgaggttacaacgtacttactatatacactggggtatacggacgacggtcccctaggacgacgggtacttggacgtggtagtgggatgggaactaccgaaacccgtaaaggtacggttagggtagtaaccgacgtacgtaccctacgtacgaccgaacgaacgggttaacgggttacccggaggggtaccggtacgggtaccgaacccgtagtacgggacggttagggtacggaaccgtaccgggtacccgaacggacggaccgtaccggtacccacgtaacgtacggtaaacttacccgagttaccgtaggtaacgtcgtacggaacggtacgtaccgggttaccgtttaacgttcggtcggtacggccggtaacccggccccggtacggtaccggggtaaccggggggtccctaaccgggttaccggttaccggtacggtacccggg

SEQ ID NO: 121125 - DNA, 555 bp, Homo sapiens
  misc_feature: GYAE6OF01EJ2J3.41.2.A02.1.454.CMB.1.raw
  modified_base (350)..(350): a, c, t, g, unknown or other
  misc_feature (350)..(350): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggagtgggatggatcgaacctaagagtggtagacagagcctntgcacagacggttccgagggcagggtcaaccgagtcggagtggtagacgacggccacgagcacggccacagtacggaaccttacgagtcgtacgtacgtctaggaggacgtacggtccgtttaactcgtggttggcggtaccggaccccggtcggtaccggggtaaccgggggtaccctacggtacggttcgtacggtacccggg

SEQ ID NO: 121126 - DNA, 656 bp, Homo sapiens
  misc_feature: GYAE6OF01DHYD0.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcgagtgaagctctcctgcaagacttcgtaggatacgaggttcaacgtacttactatatacacgtggtgcgacgacggccctggacagggtacttggagtggagtgggatggactacgaaaccgtaagaggtaggtgaacacgacgcctctacgccacgaggtacgggttccgacgggcgtaacgggtccaaccgtagtggtaaggtgggtacggaccgtaacggccgtacggacgacccgtacggtaccgaacgtacgtaacggtaaccgttaaccgaggttcgtaggtaacgttcgtacggacgggtaaccgtaccgggtacccgttttacgtcgttcggttacggacccggtaccggaacccccgggtacggtacgggggtaacccgggggggtacccgttaccggtaacgggttccggtacgggtaacccgggg

SEQ ID NO: 121127 - DNA, 800 bp, Homo sapiens
  misc_feature: GYAE6OF01C5IMS.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatccctcttcttgggtggcagcacgccacgaggacgcccactctcaggtgcagctgatgcagtcgtgggctggaggtggaggacgccgtggggcctgagtgacgctctcgtagactaagtacttcgaggtaactacggtaggttaccaacgttacttactaattactacgtacggtcgggtcgaccggtacggtacccgggccccgtagggaaccggacggggtacgtttaggagggttagggtagggttcggggagttacggaacgttaaccccgaaaccgtaaggtaacgggttcgggtacgtaaccgaccgtaacgggtcccttacggtcggtaaccgaacggtacgggttaccggggttaccggacgggtacggtaaccgggtacgaaccgtagtacgggtagggtacggacggtacccgaccggaccggaacggaccggtaccgtacccggaacctacgtaacggttaacccgggtaacctttacccggtagttacggtacggttaaacggtcgtaaggtaacccgggtacccggttaccggtttaccgttcgttaccggtacggtcgaaccccgggtaccggacccccgggttaggggtaaccccggggggtaccgggggtacccttaccgggttaaccgggtccgtaacggggtacccgggg

SEQ ID NO: 121128 - DNA, 749 bp, Homo sapiens
  misc_feature: GYAE6OF01EIZMF.41.2.A02.1.454.CMB.1.raw
  modified_base (705)..(705): a, c, t, g, unknown or other
  misc_feature (705)..(705): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgccccactctcgaggtcgcgagctgatcgcgtaggtcggtggggtctggagggtggaacggtaacggtccggtacggggcctacgtacggtaggaaccgtcctccgtccgtacgacgtaaacgtaccgtttacgtacggtaagttacgtacggttaacctaaccgttacttaacctataacgttaccgtaacggttcggggtacgaccggtaaccggaccggtccccggtagggaaccggtacgggtacgttaggtaggtggaaggtagggtagtacggtaacgtaccgaaaccggtaaggtacggtacggtaacgtaaccgacgtaccgtccgtacgtacgacgtaacgtacgggtacgggtaccggacggggtacgtacggggtactaaccgtggtacgggtaggtacggtaccggaaccgtaccggaccgtacggactaccgtacgtacagtacgtaacgtacctacgtagtactagtacgtacgaggtacgtcgtaacggttccttacgttcggacgtacgaccggtcccgtaccgggngggtaccgggtacgggtcctaaggtaccggtcgtagggtccggg

SEQ ID NO: 121129 - DNA, 700 bp, Homo sapiens
  misc_feature: GYAE6OF01DUY88.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtgcagctgatgcagtcgtggggctggaggtggaacggacgccgtcggggcctcgagtagaagctcctccgtagacaacgtacttcgtaggactacgtaggttaccaacgtacttctaatacttacgacgtgggtcgaccgacgaccggccccgtaggacgtacgggtacttaggaggtggagtgggataggactaccgaaaccgtaaggtacggtacggtacgaaccacgtacgtccttcgcgtaaccaacgtacggtacgggttaccggagggtaccgtaacgggtcctaaaccggaggttacggaggttcgggaccgaaccgggacccggaaccgaccggaacgtccgtacccggtaccaacgttacggaaacggttacccttaacgacgttccgaggttacgtggacggacggtaaccgtaccggttccgtttactcggtcggtacggccggaaccggtccccggagggttaacccggggggtaccgggtaccttacgggtaccggtcgtagggtacccggg

SEQ ID NO: 121130 - DNA, 711 bp, Homo sapiens
  misc_feature: GYAE6OF01CHBUX.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatccctctttctttgggtggcagcagcccacgaggacgccccactctcagggtgcagctgatgcagtcgtggggctggagggtgaaggaacgccgtggggcctgagtgagcctctccgtgacgtaagtacttgtagaatacgtaggtacaaacgtcttatatattacgacgtggtacgacgacgcgcccgtaggaacgacgggtacttggaggtggagtgggagtaggtactaacccgtaaaccgtagggacgttagggtacgaacgacaccgtccgtacgtacggaacctacggacggttaccgggtacccgagggtaccggtacgggtaccaccggtagtaggaggttacggtaccgtaaccggaccggcccgaaccggacgaccgtaacccggacctaagtaccggtaacgttaacccgtacgtaccgttaggtactaggttaccgtaggtaaccgaccggttaccggtttactttaccgttagtccggtaccgggacgtaccccgggaccccgttggggaaccggggttaacccggggtccttaacccgggtacggttcggaccggttacccgggg

SEQ ID NO: 121131 - DNA, 785 bp, Homo sapiens
  misc_feature: GYAE6OF01CJXKW.41.2.A02.1.454.CMB.1.raw
tcagtctatactatcacgaccggtgctcgatttagactcatctacagggggagcatcacccagcaaccacatctgtcctctagagacgtcccctgagagcctccgttcctcaccatggactggacctggaggatcctcttcttggtggcagcagccacaggacgcccactctcaggtgcagctgatgcagtcgtgggctggaggtgaggacgccgtgggcctgagtgaagctctccgtgacgaagtacttcgtggatacgtaggttacaacgtacttactatatactacgtggtcgcgaccgacggcccgtaggaccgagggtacgtgaggtggtagtgggagtacgggtaactaccgaaaccgtaaggtacggtaggtacgaaccgacgacgtcccgtacgttaggacccaacgtacgggtaaccgggttacccggaacggggaccggtaaccggggttacccaacccgtaaggttacgggacgggtttacggggtaccggaacccgggtaaccggacccggaacggaaccgggaccccgtaacgggtacccaaacgtaacgtaaccggtaaaccgtttaaccgaacggtttaccgtaacggtaacggttacgtacggtaacgggtaacccgtaacccggggtttacccgttttaaccgttcggttacgggtaccggaccgggtaaccccggtaccccccgggtagggtaccgggggggtaaccccggggggttaccccttaaaccggggttaccggttacccgggtaacgggttaccccgggg

SEQ ID NO: 121132 - DNA, 656 bp, Homo sapiens
  misc_feature: GYAE6OF01EUEWD.41.2.A02.1.454.CMB.1.raw
  modified_base (574)..(574): a, c, t, g, unknown or other
  misc_feature (574)..(574): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagcgtggggcctcgagtagagtctcctcctgactaagtacttgtcgataccgtaggttacaacgtacttactactaatacaggttgggcgacgacgacggtccccgtggacgaggtacgttgaggtaggtacgtaggtacgtggtaactaccgtaaaccgtaaggtacggtggtacgaacgtacgtacgtacccgtcgtcgacctacggtaacggtaccgggttaccggacggggttaccggtacggtaccaccgtaggtacggagggtcggtacgaccgaccggacgacgacgacgaccgtacctaagacgtacggaacctcgacgtagacggtaagtacgtacgacgtaccgtacggttaccgtttntcggtcgtgaccggtaccggtaccgggtacggtaaccgggggtaccggggtaccgttaacggttccgggtgtacggtccggg

SEQ ID NO: 121133 - DNA, 696 bp, Homo sapiens
  misc_feature: GYAE6OF01CRCJ9.41.2.A02.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttctggtggcagcagccacaggagcccactctcaggtgcagctgatgcagtcgngggctgaggtgagagcctggggcctnagtgagctcgtcctgacaagtacttcgtggaatacgtaggttacaacgtacttctaatatacacgtggtgacgacgacggccccgtaggacgagggtacttaggagtggagtagggagtgacgtacaaaccgtaggacggtggtacgaactacacgtcctacgtcgacacgtaaggcggttaccgagggcgtaacgggtccaaccgtagtggaacggtaggtcgaaccgaccgggacccgaacgtacgaccgaaccggtccccaaagtacggtaacgtaaaccgttaccggaacgttcgtacggtaacgttccggtacggaacggtaacccgtacgggttacccgttttacgttaccgtacggttacgggtacccgtaaccccgggaccccgggttaccgggttaaccgggggggtaaccccgggggggtaaccccttaaccgggttacccgggttccgtaacggggttaaccccggggg

SEQ ID NO: 121134 - DNA, 662 bp, Homo sapiens
  misc_feature: GYAE6OF01C2FJ3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcagctgatgcagtcgtgggctgaggtgaggagccgtggggcctcgagtgaagctctcctgactaagacttcgtggactacgtagttaccaacgtacttactatactacgagtgggtagccgacgacggcccctgggacgtagggtacttaggagtggagtggatcggtactaccgaaaccgtaaggtaggttggtacgaacacgtacgccgttcgtacgaccgaagtacggttacggttccggaaggggtcgaacgggttaccaccgtagtacgtaggtcggacggtacgacggtaccgaacgacgccgtaccggtaccaacgtagttaaccggtaaccttacgtacgtacgtacggtaacgtcgtacggacggtacccgtacggttcccgttttaatcggtacggtcgaccggtacccgcccgggtacggtaccgggggtaaccgggggtacccttacggtaaccggtcgtaacggtacccggg

SEQ ID NO: 121135 - DNA, 648 bp, Homo sapiens
  misc_feature: GYAE6OF01BVGRA.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacgaggacgcccactctcgaggtgcagctgatgcagtcgtggggctggaggtgaggacgccgtgggcctcgaggtgaacgtctctaccgtgaccgtaagtacttcgtaggtactacgtacggttacaaacgtacttacgtattactacgtacggtgggtacgaccgacgaccggtccccgtaggaccgtacgggtacgttggaggtggagtagggatacggtactaccgaaacgtaggacggtaggtacgacacgacgtccgtacgtacgaccaacgtacgggtaccgttacggacgggaccgtacgggtaccaaccgtagtacggaggttcggacgaccggtacggaccgacggtacgaccgacgtaccgacgtacgtacggtaacctacgcgttacgagtacgtcgagacgacgtaccgtcgttacgtgcgtacgaccgtcgacccggtaggaccggggtaccggtactacggacgtcggtcgtacccggg

SEQ ID NO: 121136 - DNA, 652 bp, Homo sapiens
  misc_feature: GYAE6OF01EAT9R.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctgggctgaggtgaggagcctggggcctcgagtgaagctctcctgcagacttctaggactacgaggttcaacgacttctatatactacgtgggtgccgtacgacgggtcccctggacgagggtacgttgaggtggagtggagtggataccgtaaacccgtaaggacgtgggtagaccgtacgacgtcctctacggacacgagtacgggttccgacggggtaccacgggtccaactacggtgacggtagggtacgaccgtaccgggaccgaacggcgtaccggacccggttacccaacgtacgtaaccgggtaaccttaccgtacggttaccgtacggtaacgttcgtaggaacggtacgaccggttccgtttaaccttcgcggttaggaccggtaccggcccccggtacgggtaccggggtaaccgggggtacccttaacggtacccggtggtcggtacccggg

SEQ ID NO: 121137 - DNA, 772 bp, Homo sapiens
  misc_feature: GYAE6OF01BKMZZ.41.2.A02.1.454.CMB.1.raw
  modified_base (267)..(267): a, c, t, g, unknown or other
  misc_feature (267)..(267): n is a, c, g, or t
  modified_base (327)..(327): a, c, t, g, unknown or other
  misc_feature (327)..(327): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacaggacgccccactctcagggtgcagtctgatgcagtcgtggggctggaggtagaggaaggtcgttggggcctcgaggtaggaacgctctccgtagacaacgtactttcgnggaacttaccgtaggttacaaaccggtactttactaattaactaacgacggttcgggganacccgagacccggccccgtaggaccgtagggtaccgtttaggaaggtagggagttagggaacgttacgggaactaacccgtaaaacccgtaaaggacggttacgggtacaaccggacaccggtaccctacgtacggaccaacggtaacgttacgggtccgacggggacgtaacgggaccaccggtaaggtacggtacgggttacgggttacgaacccgtaccgggaccggtaaccggacgtaccccgtaaccgggtacccaacgtaacggttaccgtaaacccgtttaacgacgttaccgaagttaacggttcaacgggtaccgaccggttaccggttaccgtttacgttccgtacggaggtacccggtacccgggtaccccggtaggggtaccgggggaacccggggttacctaccggttccggttacggcggttaacccgggg

SEQ ID NO: 121138 - DNA, 692 bp, Homo sapiens
  misc_feature: GYAE6OF01B753I.41.2.A02.1.454.CMB.1.raw
  modified_base (245)..(245): a, c, t, g, unknown or other
  misc_feature (245)..(245): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacgaggacgcccactctcagggtgcaggctgatgcgagtcgtggggctggagggtgaggaacgccggtggggcctgagtgaagctctccngacaagtacttcgaggatacgacggttacaacgtacttctaatataacgtacggtggtacgcgaccgaccggtccccggaggtacgagggtacttaggaggtaggaaggttgggagtaggtaactaaccgtaaaccgtaagggtaggtacggtacggaacacggaacgtccgtcgtaggaccgtaacgtagggtaccgggttacgacggggtacgagggtaccacgtagtaggtacggtagggacgaccgggaacccggacaacgggacggaccgtaccggaccaacgtaacgttaccgggtaaaccttaccgagttacgaagtacggtacgtacggacggaccggttaccggttaccgtttacgtgtcggtcggaccggcccgtacccgggagggtaccgggggtacccggggtacctaccgggttacggtacgcgggtaccgggg

SEQ ID NO: 121139 - DNA, 827 bp, Homo sapiens
  misc_feature: GYAE6OF01BVTDF.41.2.A02.1.454.CMB.1.raw
  modified_base (726)..(726): a, c, t, g, unknown or other
  misc_feature (726)..(726): n is a, c, g, or t
tcagtctatactatcacgaccggtgctcgatttagactcatctacagggggagcatcacccagcaaccacatctgtcctctagagagtcccctgagagctccgttcctcaccagtggactggacctgggagatcctcttcttgggtgcagcagccaacgaggacgcccatctcgaggtgcagctgatcgctaggtcggtggggctaggtagggtaggaagggtaacgccggttacggggcctacgtaggtaggaacgtcctactccggtacgtactaaacggtaccgtttacgacggtaacttaaccggtacgggttaaccaaccggttaactttaccgtaattaccgtaactacgggttcgggtcgaccgtaaccggacccggtcccgtaggaccggtacggtacgttggacggtaggaggtagggtactacggactaaccgtaaaccgtaaggacggttagaccggtaacacggtaccgtccttacgacgtaccgtaagtacgggttaccgggtaccggtagggaaccggtaacgggtccgaacggttagacgggtaagggttccgggaacgaaccccgtacgggaacccgtaccggtaacgcccggtaacggtaacccaccgtttaaaggttcccggaacctttaaccgggtaccgttaaccgaaggttaaccggttacggacgggaaccggttaaccgtaccccgggtttacgttttaccgngtttaccgggcggtaacccggaccccggtaaccgggtcgggaacccgggggtacccgggtcccgttaaacgggttcggtcccgggtaagtaccccgggggg

SEQ ID NO: 121140 - DNA, 614 bp, Homo sapiens
  misc_feature: GYAE6OF01C5TME.41.2.A02.1.454.CMB.1.raw
  modified_base (163)..(163): a, c, t, g, unknown or other
  misc_feature (163)..(163): n is a, c, g, or t
  modified_base (195)..(195): a, c, t, g, unknown or other
  misc_feature (195)..(195): n is a, c, g, or t
  modified_base (237)..(237): a, c, t, g, unknown or other
  misc_feature (237)..(237): n is a, c, g, or t
  modified_base (301)..(301): a, c, t, g, unknown or other
  misc_feature (301)..(301): n is a, c, g, or t
tcagtctatactatcacgaccggtgctcgatttagactcatctacgagggggagcatcacccagcaaccacatctgtcctctagagacgtcccctgagagctccgttcctcaccatggactggacctggagatcctcttcttggtgcagcagccacgaggacncccactctcgaggtgcagctgatgcgagtcgngggctaggaggtgaggacgcgtgggcctgagtgagctctccngacaagtacttcgtggactacgacggttcaacgtacttctaagtactactacgtggtagcgacncggacccgtggacgaggtacttggagtggagtggatacggactaccaaaccgtaagcgttagacacgagtaccgctcgtggaccagtacggtaacgtccgagggaccgtagggtaccaacgtagttcggaggttggtacgaaccgacggaccagaccgtctaccggcaacgtagtaacgtaactacgtagttacaggtacgtacgaggtacgaccgttacggtcctttagtcgtggaccgacgtaccgggacccgttgggaaccgggggttaaccgggtactaaccggtttaccggtcgtacggttacccggg

SEQ ID NO: 121141 - DNA, 765 bp, Homo sapiens
  misc_feature: GYAE6OF01ECIQL.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggagatcctcttcgttggtggcagcagccacgaggacgcccactctcgaggtgcagctgatgcgaggtcgtgggctggaggtggaggacgccggtgggcctcgagtgacgtctcctctgacgtaagtaccttcgtaggactacgtacggttaccaacgttacttactatactacgtacggttcgggtcgaccgacggtaccggcccgtagggaaccgtacgggtacgttagggaggtaggtacggtgggtagtcggtaactaccgaaacggtaaggtggtaggtacgaaccgacgtcgtacccgtcgtcgacgtaacggtagggtaccggtccggtaacgggacggtaacgggtcccaacggtaggtacgggtaggttacggtacgaaccgtaccgggacccgacggtaccgacccggtaccgtaacccgagtaacgtcggttaaaccctaccggtaacggttaccgaagggttaaccgtacggtaacgggtaaccgtacccgggttacccggtttaccgtttacgttaccggtacggtaccggacccggtaccccgggtacccccgggtaggggttaaccccggggggtaccggggtaccccttaacggggttccggttaccggtacgggtacccgggg

SEQ ID NO: 121142 - DNA, 637 bp, Homo sapiens
  misc_feature: GYAE6OF01ASR8O.41.2.A02.1.454.CMB.1.raw
  modified_base (366)..(366): a, c, t, g, unknown or other
  misc_feature (366)..(366): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagccccactctcaggtgcagctgatgcagtcgtggggctggaggtgaggaagccgtggggcctcgagtgagctctcctgcaagacttcgtggatacgaggttcaacgtacttctatatacactgggtgcgacacggcccctagggacagggacttggaggtggagtgggagtggaactaccaacccgtaaaggaggttggtcgaacncgacgccctgtcgacgacgaggtacggttccgagggcgtaacgggtcaacgacgtggtacggtggtacgacgtaccgggacctaacggacgccgaaccggtaccaacgtagtacggtaaccttaaccgacgttacgtacgtaacgtcgtacgggaacggtaaccgaccgggttacccgttaacgttcgttcggtaggcccggaccgtaccccggtcggtacggggtacccgggggtacccttaacgggtacccggttcgtacggtaccggg

SEQ ID NO: 121143 - DNA, 662 bp, Homo sapiens
  misc_feature: GYAE6OF01B6UK3.41.2.A02.1.454.CMB.1.raw
  modified_base (146)..(146): a, c, t, g, unknown or other
  misc_feature (146)..(146): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (379)..(379): a, c, t, g, unknown or other
  misc_feature (379)..(379): n is a, c, g, or t
  modified_base (402)..(402): a, c, t, g, unknown or other
  misc_feature (402)..(402): n is a, c, g, or t
  modified_base (450)..(450): a, c, t, g, unknown or other
  misc_feature (450)..(450): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttttggnggcagcagccacaggacgccccactctcgaggtgcagctgatgcagtcgngggctgnggtgaggacgtccgtgggcctgagtagaacnctcncgtgacaagtctcgtagactacgaggtactaacgtactagtaatacaccgtacggtgggtcaccgaaccgccggtccccgtaggaccgtagggttactgggaagtcggtaatcgggattacggaacttaccgaacgtaggngttggacaccgagcgtacccgtntacggcctaaagtacggtacggtacgtacgggacgtcggacctaacgngtaggacggtaggtaccgacgtacccggacgacgtacgaccggtacgtaccacggtaacgtactaacccgttacgacgtttacgaggttacttacgacggtacgaccgtccggttacctttacgtcgacggtaccgacgtaaaccggtcccggtaacgggtaacggggtacccgggtaacttaccgggtaacggttcgaacgggttacccgg

SEQ ID NO: 121144 - DNA, 608 bp, Homo sapiens
  misc_feature: GYAE6OF01CWHIN.41.2.A02.1.454.CMB.1.raw
  modified_base (165)..(165): a, c, t, g, unknown or other
  misc_feature (165)..(165): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (552)..(557): a, c, t, g, unknown or other
  misc_feature (552)..(557): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (576)..(576): a, c, t, g, unknown or other
  misc_feature (576)..(576): n is a, c, g, or t
  modified_base (584)..(584): a, c, t, g, unknown or other
  misc_feature (584)..(584): n is a, c, g, or t
  modified_base (587)..(587): a, c, t, g, unknown or other
  misc_feature (587)..(587): n is a, c, g, or t
  modified_base (590)..(590): a, c, t, g, unknown or other
  misc_feature (590)..(590): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
tcagtctatactatcacgaccggtgctcgatttagactcatctacagggggagcatcacccagcaaccacatctgtcctctagagacgtcccctgagagctccgttcctcaccatggactggacctggagatcctcttcgttggtggcagcacgccacgaggacncccactctcgaggtgcagtctgatcgcagtcgngggntgagagaggacgcggtagggcctagagtagacgtcgtcgtacgacgacaaacggttcgtacggtagtaacgtaacggttaccgttacgtaaccgtaccgttagtaacttaacgttacgtacggtacggtacgacgtaaccgaccggacccggtaggaccggtaggtacgtaggaggttaggagtaggagtacgtaacgaccgaaccggttagacggtacgaacgacgaacgtcggtaccacggtacgacctaggtacggttacgtacggggacggtagtaccggaaccgtagaacgtacggtaggtacggtaacgacgacccgggaacgacggtacgaaccgtcgaacgnnnnnnaganananacgananaganagagaganagnganagaganananangngacg

SEQ ID NO: 121145 - DNA, 730 bp, Homo sapiens
  misc_feature: GYAE6OF01DGZGR.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctgaggtgacggagccgtgggcctcgagtagaagctcctccgtagacaacgtacttcgaggtaacgtacgtacggttacctaacgtacctttactaatacgttacacggtgggtagccggacgacggccccgtagggacacgggtacgttaggaggtaggagtcgggagtggtactaaccgaaacccgttaaaggtggtacgggtagaaccgacgtaacgtcccttacgacgtaccgaacgtaggtaccggttacggacgggccgacgggtaccaacgtagtgggtaggtacggtacgaaccgggccggacccgacgggacctaccggaaccggtaccaaccgtaggtaaccgtaacccttacggtacgtcgttagtaacgggttactacgggaggtaacccggtaccggtaccccgttttagtcggtttacggccggtaccgggaaccccgtaaccccgggttcgggtaaccgggggggtaacccgggggtaccctttacccgggaacgggtcccgttcggggtaacccgggg

SEQ ID NO: 121146 - DNA, 655 bp, Homo sapiens
  misc_feature: GYAE6OF01AX8EV.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgacaagtacttcgtggactacgtaggttaccgaacgtacttactataatacacgtggggtcgacggaccacgggtcccctaggacgtacgggtacgttggaggttggacgtggggataggactaccgaaacccgttaaggaggtaggtacgacacgacgtaccctctaggccacgtaggtcgggttaccgaggggacgtacgggtaccaccgtaagtcggaggttcggtacggaccgacgggtacccaaccggagcccgacggtaccacgtagtacggtaaccttaccgagttccgtagtaacgtcgaggacggtccgacgggttcctttacgttcgtcgtggaccgtacggaccccggtacggtacgggggtacccgggggtcccttaaccggtcccgggttagtacgggtacccggg

SEQ ID NO: 121147 - DNA, 683 bp, Homo sapiens
  misc_feature: GYAE6OF01AUGIH.41.2.A02.1.454.CMB.1.raw
tcagtctatactatcacgaccggtgctcgatttagactcatctacagggggagcatcacccagcaaccacatctgtcctctagagagtcccctgagagcctccgttcctcaccatggactggacctggaggatcctcttcttggtggcagcagccacaggacgcccactctcaggtgcagctgatgcagtcgtgggctgaggtgaggagccgtgggcctgagtgaagctctcgtgacaagtacttcgaggactacgtacggttcaacgtacttactatactacgacggtgggtacgacgaccgacggaccccgtggaacgtacgggtacttaggaacggtggacgtagggataggaactaccgaaaccgtaggaggttacgggtacaacgtaccgacgtcctacgtacggtaccacggtaggtacggttaccggacgggtaccgacgggtacctaccggagttacgggtacggtcgggtaacgaccggacccggtaccgaacggtacccgaccggtaccggtacccaacggtacggttaccgttaaaccgtaccgtagtacccgtagttaacgcgtacggacggtaaccgtcggttacctttcgttacgtcgtcgacccggtaaccgccccgggtaaggtaccggggacccgggttacctaccggtcggtacgtcggtaccgg

SEQ ID NO: 121148 - DNA, 648 bp, Homo sapiens
  misc_feature: GYAE6OF01A9YTI.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtggaggaagccgtggggcctcgagtgaacgtctacctccgtgacgtaagtaccttccgtaggactacgtacggttaccaaccgtacttacgtaataactactacggtgggtcgacggaccgaccggcccgtaggacgagggtacgttggagtggagtgggataggactaccgaaaccgtaaggaggtggtacgaacacgacgtccctagtcgacgacgtacggtacggtacggacgggtcgacgggtaccaacgtagtacggtaggtcggtacgacgtaccggaccggaccgacgcgtaaccggtaccgaacgtaacgtacggtaaccgttaccgacgttacgtagtaacgtgacggtacggacgtaccggtccttacgtcgtgtacgcgtacccggacccggtcggacggggtaccggggtactaacggtccggtcgtggtaccgg

SEQ ID NO: 121149 - DNA, 706 bp, Homo sapiens
  misc_feature: GYAE6OF01EJ5E0.41.2.A02.1.454.CMB.1.raw
  modified_base (232)..(232): a, c, t, g, unknown or other
  misc_feature (232)..(232): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgagggtgaggagccgtgggcctcagtgagctctcngcaagacttcgtaggatacgtaggttcaacgtacttctatactacgacgtgggtgacgacgacggccccgtaggacgagggtactggacggtaggtagtagggtacgtggtactaacgtaaaccgtaaggtacggtaggacgtacgaacgacgtcctacgtacgactacggacggtacgggttaccggacgggtaccggaacgggtaccgtaaccgtaggtacgggaacggttgggtaacggaccggtaaccggtacccgaacggaaccgtccggaacccggtaccaacgtaacgtaacggtaaccgttaaccgagttacgtacggtaacggtccgtacgggacggtaccgtaccgggttaccgtttaccgttacgttcggtaccggaccggtacccggaccccggtaccgggaccgggggttaacccgggggtacccttaacggtacccggttacggacgggttaccccgggg

SEQ ID NO: 121150 - DNA, 679 bp, Homo sapiens
  misc_feature: GYAE6OF01ETJP2.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcagccacaggacgccccactctcgaggtgcagctgatgcagtcgtgggctgaggtgaggagccgtgggcctgagtgagctctctgacaagtcttcgtaggatacgtagttacaacgtacttctatactacgacgtgggtcgacggacgacggtccccgtaggaccgagggtactggaggtggtagtgggtatcggactacgaaaccgtaggaggtggtacgacgacgacgtcctcgtacgacgacgacggtacggtccgagggtacgacggtaccacgtagtcggaggtcggtacgaccgaccgggtaccgacggacgtacccggtacggtacccaacgtacgtaaccggtaacccttacgaggttacgtaacgggtaacgtacgtaacgggaacggtacccgtaccgggtttccctttaacgttcggtacggtaccggacccggtacccggaccccgggtgggtaacccgggggggtaacccggggttacccttaacccggggttccggtaccggtacgggtacccgggg

SEQ ID NO: 121151 - DNA, 553 bp, Homo sapiens
  misc_feature: GYAE6OF01BQZZ4.41.2.A02.1.454.CMB.1.raw
  modified_base (286)..(286): a, c, t, g, unknown or other
  misc_feature (286)..(286): n is a, c, g, or t
  modified_base (451)..(451): a, c, t, g, unknown or other
  misc_feature (451)..(451): n is a, c, g, or t
tcagtctatactatcacgaccggtgctcgatttagactcatctacagggggagcatcacccagcaaccacatctgtcctctagagagtcccctgagagctcccgttcctcaccatggactggacctggaggatcctcttcttggtggcagcagccacaggagcccactctcaggtgcagctgatgcagtctggggctggaggtgaggaagcctggggcctcagtgaagctctcctgcaagacttctggatacaggttcaacgacttctatatacatgggtgcgacnggcccctggacagggacttgagtggatgggatggatcgaaccctagacgtggtgacacgagcctcgtgccacgagagggttccgagggccgagggtcaccgagtggagtggtaggacgacggccacgacggcaccggtccacgatggaacttaccgacgtcgtanagtcgtacgaggacgaccggtccgtttaccgttcgttcgttggccgtaggacccccggcggtcgggaaccggggggccgtaccgtccggtcgtcggtaccgg

SEQ ID NO: 121152 - DNA, 787 bp, Homo sapiens
  misc_feature: GYAE6OF01CN8WD.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctctttcgttgggtggcagcacgccaacgaggacgccccactctcgaggtgcagctgatgcagtcggtgggctggaggtggaggaagccgtggggcctgaggtagaacgtccttcgtccgtagaccgtaagttccgttcgtaggaacttacgtaacggttaccaacgttacttactaagttaactaccgtacggtggtacgaccggaccgtaccggccccgtaggacgtacggggtactttaggagggtaggtaggtcgggtaagtacggaactaccgaaaccggtaggtacggtggtacgactaacgacgtccctacgtcggaataccggacggttacgggtaccggacggggacgtaccggggtacccaacgtaggtcggaaggggtccggtacggacccggtacggacccgaagcgaccggtaaccggtacccaacgttaagggtaacccgtaacgttaccggacggttaccgtaaggttaccggttcggaacggtaaaccgggacccgtttaccgggttacccgttttaacggttcggtcgggtaccggtacccgggtaccccgggtacccccgggtagggggtacccggggggttaaaccccggggcctttaaccggggtacggttaaccgggaacgggttcccggggg

SEQ ID NO: 121153 - DNA, 641 bp, Homo sapiens
  misc_feature: GYAE6OF01B82M6.41.2.A02.1.454.CMB.1.raw
  modified_base (222)..(222): a, c, t, g, unknown or other
  misc_feature (222)..(222): n is a, c, g, or t
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccaactctcaggtgcagctgatgcagtctggggctgaggtgaggaagccgtggggcctanagtgaagctctcctgcaagtacttctggatacaggtacaacgacttcatatacactgggtgcgacacggcccctgacgagggacttggagtggaagtcgggatcggactacaacccgtaaagnggtacggtgaaccgactaacgccgtntacggcaacgaggtacggttacccgaggggcgagggtccaaccgataggacggtgtagacacggaccaagacgcgaccggtacaaccgagtacgaaccttaccgagttacgtagaagtcaggaaggaacccgtacgggttaccgttttaacttcggttcggtagggtcccgggaaacccggtacccccgggtaacgggtaccgggggtaaacccggggggggtacccttaaacccggggtaccggtaaccggttaccggtaacccggggg

SEQ ID NO: 121154 - DNA, 710 bp, Homo sapiens
  misc_feature: GYAE6OF01EHK06.41.2.A02.1.454.CMB.1.raw
  modified_base (592)..(592): a, c, t, g, unknown or other
  misc_feature (592)..(592): n is a, c, g, or t
tcagtctatactatcacgaccggtgctcgatttagactcatctacagggggagcatcacccagcaaccacatctgtcctctagagacgtcccctgagagctccgttcctcaccatggactggacctggagtactccttcttcgttggtggcagcacgccagaggacgccctactccgtcgaggtcgcgagtctgatcgcgtaggtcgtcgggctgggaggtacggaacggaacggccggtcgggcctacggagtagacgtctcctcgagactagtcttcgagtacgtacgtacgttacaacgtacttactactaactacgtacggtcgggtacgaccggtaccgtaccggtcccgtaagggaccggtaggttacgttagggtagggtacggtaggagggtacgtacggtaaccgtaccgtaaaccgtagggtacggtacggtaacaaccgccgtaccgtccgtcgtacgaccgacggtacgggtacgggccgagggaccgtacggacctaacggtgtacgggtaggtcggaaccgaccggaccgtaccgacggcgtacccgtacgtacaaggttaacgacgttaccctaggngttacgaacggtgtacgtacgaccggtcttaccggtttccgttatccggtcggagtaccccgcggtacccgggtgggtaaccggggtcggacttaccggtcgtaccgtcgtaccgggg

SEQ ID NO: 121155 - DNA, 775 bp, Homo sapiens
  misc_feature: GYAE6OF01BFQLR.41.2.A02.1.454.CMB.1.raw
  modified_base (225)..(225): a, c, t, g, unknown or other
  misc_feature (225)..(225): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggagcccactctcaggtgcagctgatgcagtcgtggggctggaggtggaaggacgcgtgggcctcgngtagagctctcctagcaacgtcttcgtaggatacgtagttacaacgtacttactatactactacgtggtcgcgacgacggcccgtaggacgaggtacgttacggaggtggaggtcgggtagtcgggtaactaccgaaaccgtaaggtacggtaggtacgaacacgacgtccctacgtacgacgaacgtaggtaccggttacggacggacggtacggtacgaccgtagtacggtacggtagggacggtaaccggaccggtaccgaacggtacggtacccggaaccggttacccaacggttaacggtaaccgggttaaaccgtttaacccggtaacggttaaacggttacggtaaacggttccggtaacgggaaccggtacgggttaaccccgggttaccggtttttaccgtttaccggttcggggttaccggacccgggttaacccgggtacccccgggtaacgggggaacccgggggggttaacccggggggtaaccccgtttaaacgggtttacccggggtaccggttaaccgggggttaaccccgggg

SEQ ID NO: 121156 - DNA, 949 bp, Homo sapiens
  misc_feature: GYAE6OF01DS9DO.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatcctcttcgttggtggcagcagccacgaggacgcccactctcgaggtgcagctgatgcgaggtcgtggggctggaggtaggaggacggtccgtcgggcctgagtagaacgtcctcgtccgtagacgtaaacgtaccgttcgtaggtaactaacgttacgggtttacccaaacggttacctttacttaacgttaactaaccggtacggtttacggggtcggacccggtaaccggtacccgggtcccccgttaagggaaccgggtaacggggttaccgtttaggggtacggttaggggtaaggtacggggtaaggttacgggtaaccgttaaaccccgtaaaaccccgggtttaaagggaccggttaaggggtaaccgtaaccggaacccggtacggttaccccgttacggtacccggaccgtaaaccgggtaaccggggttacgggttaaccggggaccggggtaaccggtaaccggggtaaccctaacccgggtaaggttaacggggtaaggggtttaccgggaacgggaacccccggaaccgggtaccccggaacgggtaccgaccccgggtaaaccgtacccgaacgttaacgggtaccccggtttaaaccgttaccggacggtttaaccgtaacgggtaacgttcccgggtaaggtaacccgggtaccgttacccgggttaccgttttacgttaccgggttcggtaccgggttaaccccggccgggttaccccggtacggggtacccggggggtaacccgggttacccggttaacggttacccggggttaccgaccggggtttaaccccggggg

SEQ ID NO: 121157 - DNA, 722 bp, Homo sapiens
  misc_feature: GYAE6OF01C9S7X.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctggaggtgaggaacgccgtggggcctcgagtgaagctctccgtgacaagtacttcgaggtactacgtacggttaccaacgtactttactaatactacgtacgtggtagacgacgacggcccctaggacgacgggtacttggaggtggacgtgggataggactaaccgtaaaccgtaaaggtaggtagggtacgaacaacgacgtcctacgtacgaccgtaacgacggtacgggttacccggagggaccggtaaccgggtacaaccgtaacgtgggtaaggttgggacggtaccgaccggacccgtacggaacgtaccgtaccggacccaagtacgtaacggtaaccgttaaccgtacgttcgtaacgtacgttacgtacggaccggtaaccgtaccgggttacccgttttacgtacggttcggtaccgggaacggttacccggacccccgggtaacgggtaccggggggtaacccgggggttacccgttaaaccggttacccggtacggttacgggtacccgggg

SEQ ID NO: 121158 - DNA, 634 bp, Homo sapiens
  misc_feature: GYAE6OF01BE2WT.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtggggcctcgagtgacgctctcgtgacaagtacttcgtgatacgagttacaacgtacttctagtactacacgtggtcgacgacgacggcccgtaggacgagggtacttaggaggtaggagtgggatggtaactaccgtaaaccgtaaggaggtaggtacgacgacgacgtccgtcgtgacacgacggtacggtccggagggcgtacgggtccaacgtagtgacggtggtacgaccgacggccgacgacgccgtaacggtccaacgtacgtaccggtaacttaccgagttccgtaagtacgtcgacggtacggaccgtaccggttaccgtttacgtcggtcggtacgacggtacccggacccggtacggggtaccggggtaaccgggggtcccttaacgggtacccggtgtaacgggtcccggg

SEQ ID NO: 121159 - DNA, 719 bp, Homo sapiens
  misc_feature: GYAE6OF01BH3GC.41.2.A02.1.454.CMB.1.raw
  modified_base (277)..(277): a, c, t, g, unknown or other
  misc_feature (277)..(277): n is a, c, g, or t
  modified_base (400)..(400): a, c, t, g, unknown or other
  misc_feature (400)..(400): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaggccgtggggcctcgagtgaagctctcctgcaagtacttcgtggattacgacgggtttacaacgtaccttntatatactacgtgggtcgcgacgacggccctggacgagggtacttggaggtggagtcgggtagtaggtaactaccgtaaacccgtaaaggtacggtagggtacgaacgacgacgtcttaccgnggaccacgagtacgggtaccgaaggggtacgacgggtaccacgtagaggtacggtaggtacgaccgacgaccgacgacggaccgtacggtaccgaacgtacgtacgggaaccgttaccgtaacggttaccgtacggaagttaccggtagtaaccgggaaccgtaccggggttacctttttacccgttacggtttccgggtaggtacccggtaccgggtaccccccggtacgggggttaaccccggggacccggggggggttaaccccttaacccggggttaacccgggtaccggtttaacccggggttaaccccggggg

SEQ ID NO: 121160 - DNA, 857 bp, Homo sapiens
  misc_feature: GYAE6OF01CTDDI.41.2.A02.1.454.CMB.1.raw
tcagtctatactatcacgaccggtgctcgatttagactcatctacgagggggagcatcacccagcaaccacatctgtcctctagagacgtcccctgagagctccgttcctcaccatggactggacctggagatcctcttcgttggtggcagcacgccacgaggacgcccactctcgaggtcgcagtcgtagagtcgaccgtacggttccggtgggggtcgtagggaggggtaggaacggggtaacggtcccgggttcgggggacccttacggtaggttacggaaccgtccttacccgttccgtacgtaccgtaaacggttaccgtttcggtacggtaacttaacggtacggttaacctaaccgttactttactagttaacctaacggtcggttacgggtcgaccggacggtacccggcccgtaggggacgacgggtacgttagggacggtgggacggttagggacgtaacggtaccttaaacccgaaaccggttaaaggcgggttacggtacgaaaccgtacgtaccgtccttaccggtacgacccgtaagggaaccgggttcgggtaacccggagggtaccggtaacgtccgaacgtaggtcgggtacggtacgggacggaccggaccggacccgaacgaccggtacggaccggtaccaacggtagttaacccgtaaccgtaccgtacggtacgttaggtacggtagacgggaccggtaaccgttacccgggtttctttacccggttacggtcgggtacccgggacccgggtaccccgggtaaccgggacccgggttacggggggaaccccggtacgttaacccggggttacccggtacgtacgggggtacccggg

SEQ ID NO: 121161 - DNA, 642 bp, Homo sapiens
  misc_feature: GYAE6OF01EARHU.41.2.A02.1.454.CMB.1.raw
  modified_base (411)..(411): a, c, t, g, unknown or other
  misc_feature (411)..(411): n is a, c, g, or t
tcagtctatactatcacgaccggtgctcgatttagactcatctacagggggagcatcacccagcaaccacatctgtcctctagagacgtcccctgagagctccgttcctcaccatggactggacctggaggatcctcttcttggtggcagcagccacaggacgcccactctcaggtgcagctgatgcagtcgtgggctggaggtgaggagccgtgggcctgagtgacgctcgtcctgacaacgtacgttcgtggtactacgtaggttaccaaacgttactttactaactacttaacgtcgttggggtcgtaccgaacgaccgggtccccgtaggaccgagggtacttaggacggtggagtgggagtggactaccgtaaaccgtagtaggtcggtagacacgacgtcctacncgacgacgtagtaccgggtaccgagggtccgtagggaccacgtagtacggaggttcggacgacgaccggacgacggacgccgtacgacacgacgtacgaaccttacgagtacgtagtacgtacgtagacggtacccgtacggttccgtttacgtcgtcgtacgccggtacccggtccgtacggggtaccgggggtcgggtacccttacgggacggttacgtcggtaccggg

SEQ ID NO: 121162 - DNA, 816 bp, Homo sapiens
  misc_feature: GYAE6OF01D6ELX.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggactcctctttcgttggtggcagcacgccacgaggacgcccactctcgaggtgcagctgatgcgtagtcgtgggctggaggtggaggaacgccgtgggcctcgagtagacgtctctctgacaacgtactcgtagagtacgtaggtacaacgtacttactaatatacgtacgtggtcgacggtaccgaccggtccccgtagggacgtacgggtacgttagggacggtaggtaaggtgggtaagtacgggtaaactaaccgtaaaacccggtaagggtaggttacgggaacgtaacgtaaccgtacgtaccgtacgtacgaacgtacggtaacgggtaccgggttaccggaacggggtaccgtaaccgggggttacctaaccggtaaggttacgggtaacggtcgggtaaccgaaccgggtaccccggtaaccggtaacgggacccgtaccggtaacccggttaaccgaaccgtaacggttaacccggtaaaccgttaccccgtaaggttacccggttaacgtaccggttaacgggacgggtaaaccgtacccgggtaccggttttacccgtttacgttcgggtccggtacgggaccccggtacccgggaccccggggtaaggggtacccggggggtaacccgggttaccttaaccggggtacggtacggttaccgggtaacccgggg

SEQ ID NO: 121163 - DNA, 776 bp, Homo sapiens
  misc_feature: GYAE6OF01C4XSF.41.2.A02.1.454.CMB.1.raw
tcagtctatactatcacgaccggtgctcgatttagactcatctacagggggagcatcacccagcaaccacatctgtcctctagagacgtcccctgagagcctccgttcctcaccatggactggacctggagatcctcttcgttggtggcagcagccacgaggacgcccactctcgaggtgcagctgatgcagtcgtggggactggaggtggagggaacgtccggtggggcctacgaggtacgaagccttctccgtaggaactaacggttactttccggtaggtaacgtaaccgttacgggttacaaaaccgttactttactaagtaacgtacgtaccggtaggttcgacgaccgtaccggtcccgtaggacggtacggtacgttaaggaggtaggagtgggagttggactacgtaaaccgtaaggcgtaggacggacagtactccgtcgagtaaccacggtacggtacggttcgggaacggcgtacgggtacctaaccgagttaggaggtacggttacgaaccggaccgggacccgacggacgtaacccggtaaccggtcgaaccgtaagttaaccgggtaaccttaacccggagtttacggaacgtacgggttaaccgcggaaccggtacgttacccggttttaccggttttaccgacgggtacgtcccgggaacccggtaccccgggtaccccgggttcggggaaaccccggggggttaccggggaaccccttttaaccggggtaccggtccgggtttaaacgggtccccgggg

SEQ ID NO: 121164 - DNA, 707 bp, Homo sapiens
  misc_feature: GYAE6OF01A6GPG.41.2.A02.1.454.CMB.1.raw
  modified_base (292)..(292): a, c, t, g, unknown or other
  misc_feature (292)..(292): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagtacttcgtaggatacgaggttaccaacgtacttctatactacgagtgggtncgacgacggcccgtggacgagggacttggaggtggagtgggatggactaccgaaccgtagagtggtacgacacgacgtcccgtagtcgaccgacgtaggtacgggttccgaaggggtaccgtacgggggtaccaacccgtagtacgggtaacggttacgggtaccgaaccgggtacccgggaccgtaccgggacgacccggtaaccgggtacccaaccgtacggtaacggtaaaccgttacccgtaggtaccgtacggtaacggttccgagggtaacgggtacccgtaaccggggttcccgttttaacgtccggttacggttacggacccgggtacccggtaccccgggtcgggtaaccggggggtacccgggggtaccttaacccgggttacggtaccggtacgggtacccggg

SEQ ID NO: 121165 - DNA, 653 bp, Homo sapiens
  misc_feature: GYAE6OF01BQ6L7.41.2.A02.1.454.CMB.1.raw
  modified_base (273)..(273): a, c, t, g, unknown or other
  misc_feature (273)..(273): n is a, c, g, or t
tcagtctatactatcacgaccggtgctcgatttagactcatctacagggggagcatcacccagcaaccacatctgtcctctagagagtccccctgagagctccgttcctcaccatggactggacctggaggatcctcttcttggtggcagcagccacaggagcccactctcaggtgcagctgatgcagtcgtgggctggaggtgaggaagccgtggggcctcagtgaagctctcctgacaagacttcgtggaatacgaggttcaacgtacttntatatacagtgggtcgcgacgacggcccgtaggacgagggtacttaggacgtaggagtcgggagtggaactaccgtaaacccgtaaaggacggtagggtacgaaccgaagacgtcctacgtgaccgtaacgtaggtacggttaccggaagggcggaaccgggtaccgtaacgacgtaggtacgggtaggtacggaaccgacggacccggacgacggaccgacccggtaccgacgtaacgtacggtaaccttaccgacgttacgtacgagttcgaggacggaccgtaccggttaccgttacgttcgtggtacggaccggaccgaccccggtaggtaccggggtaaccgggggtacctacggtcggtaccgtggtacccggg

SEQ ID NO: 121166 - DNA, 768 bp, Homo sapiens
  misc_feature: GYAE6OF01EN6L0.41.2.A02.1.454.CMB.1.raw
  modified_base (246)..(246): a, c, t, g, unknown or other
  misc_feature (246)..(246): n is a, c, g, or t
  modified_base (498)..(498): a, c, t, g, unknown or other
  misc_feature (498)..(498): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagcccacgaggacgcccactcctcgaggtgcagctgatgcagtcgtggggctggaggtggaggacgccggtcgggcctcgagtgacgctctccgngacacgtacttcgtaggtactacgtacgtacaacgtacttactaatactacgacggtgggtcgcgacgacggtcccgtacggacgtagggtacgtggaggtaggtaggtgggtagtacgggaactacccgaaaccgtaggtacggtgggtacgaccgtacgaccgtcccgtacgtacgaccgtaacgtaacgggtaccgggttacccggaacgggtaccggtaaccgggtaccgaaccgttaggtaacgggnggggttaccgggtaacccgaaccccggaccggggtaacccgacggggaaccgtcccgggtaacccggtaacctaacgggtaacggttaaccgtaaccgttaaccggtagttaccgtaaggtacggtaccgtagggaaccggtaccgtaccgggttttccttacgttccggtacgggacggtacccggtacccgggtacccgggtgggttaaacccccgggggggacgggttacccttaaccggggttacccggttagtccgggtaccggg

SEQ ID NO: 121167 - DNA, 641 bp, Homo sapiens
  misc_feature: GYAE6OF01COVL8.41.2.A02.1.454.CMB.1.raw
  modified_base (625)..(625): a, c, t, g, unknown or other
  misc_feature (625)..(625): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtggaggaacgccgtggggcctcgagtgaagctctcctgacacgtacttcgtggtaatacgtacggttacaacgtacttacgttatactactacgtgggtagcgacgacggcccctaggacgaggtacttggagtggagtggatcggactaccaaccgtaaggtagtaggtacgacacgtaacgtcccgtagtagacgaacgtaggtacgggttccggaagggtccgtacgggttaccaaccgtaggtgaacgggtcggtacggacccgaccggaccgacggacgcgaacccggtcaacgtacgtacgtaaccttaccgacgtgtacggtatcggagacggaacgtccgggttccttacgtcgtcggacggtaccgaccggacccccgtggtacggggtaacccgggggtcttaaccgggtacggngttaccggtaccgggg

SEQ ID NO: 121168 - DNA, 723 bp, Homo sapiens
  misc_feature: GYAE6OF01BEOYT.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggatcctcttcgttggtggcagcagccacatgacgcccactctcaggtgcagctgatgctagtcgtgggctggaggtggaggacgtccgcggggcctcgagtgacgtctctcagacaagtcttcgaggtactacgtacggtactaacgtactttactatacgtactacggttgggtacgcggaaccgaccggtccccgtagggaccgtagggtacgttaggcggtagggtaaggtgggtacgtacggaataaccccggaaacgtaagggtggtacgtacggaccaggtaccgcccttcgacggtacagggtaaccggtacggttaccggggacgggaaccgggtacgggttacccgaacgtacggttacggggtacgtaggggtaccgaaccgggaccggaaccggaccggtacggaacccgtaccggtaacccgtacggtaacgttaacgggtaaccctaccggtaccgttacgtaacgggtacgtacgtacggacgttaccggtaccgttccggttttacgtcggtgtaccggaccggtaccgaccccggaggggtacccgggcggtaccggtacgtacgggtcgtaccggg

SEQ ID NO: 121169 - DNA, 729 bp, Homo sapiens
  misc_feature: GYAE6OF01A75A2.41.2.A02.1.454.CMB.1.raw
  modified_base (367)..(367): a, c, t, g, unknown or other
  misc_feature (367)..(367): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcgagtcgtggggctggaggtgaaggacgccgtaggggccctagaggtcgaagtcctaccgtcctgacgaaacgtctttcggtaggtaactacgtacggttacaaacgttacttacgtattaactacgacggtttcggggcaccggtaacgacccggtaccccgaggaacggtaacggggttntttacgggaaggttacgggaggttagggacgtaggtaactaccgtaaaccggtaaggacgttcgggtacgaactacgacgttccctcgtacgaccggaacgtaacggttacggtaccggacggggtaccctacggggtaccaaccgtaggtcgggtacggttaggtacccggaaccgtacgggcctaacgggacgccgtaccgtacaggtaacgttacggaaaccctttggacgttagacgtacgggttcgaacggaccgtaccgtaccgggttacctttaccgggttacgcggacccggaccgtaccccgggtggtaccggggggtaaccggtccttaaccgggcggttcgacgggtcggg

SEQ ID NO: 121170 - DNA, 865 bp, Homo sapiens
  misc_feature: GYAE6OF01EPGO4.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggaggactccgtcttcgttgggtggcagcacgccacgaggacgcccactctcgagggtcgcagctgacgtgcgagttcggtggggcttggaggttggagggaacgtccggtcggggccttaggaggtagaacggtctccgtccgttagacgtaacgtccttcgtacggtactaaccggtacggttaccaaccgttacttactataacgtaccgtacggttgggtcgaccggtaccgacccggtcccggtacggaaccggtagggtacgttagggtacgtagggtacggtacggggtaagtacggtaaccgtaaccgtaaaccggttaagggtaggttacggtaacggtaactaccggtacgttacccgtcggtacggaccgtaacggtacgggttaaccgggtaccggtaacggggtaccgtaacggggtaccctaccgggttaggtaacgggtaacggttacgggtaaccggtaaccgacccggtaaccggacggaacggtacccggtacccggtaaccctaggtacggttaaccccgttaaaccgttacccgtacgggttaacttacggggtaaccttcggggtaaccggaaccggttaccggtaccccgggttttacttccggttacggtacggaccggtacccggaacccgggtcccggggttaaccggggaccgggggggttaaccccgtacgttaacccgggtcgggttaacggtacccggttacccgggggg

SEQ ID NO: 121171 - DNA, 635 bp, Homo sapiens
  misc_feature: GYAE6OF01ATS28.41.2.A02.1.454.CMB.1.raw
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctggaggtgaggacgccgtggggcctcgagtgagctctcctgacaagtcttcgtaggatacgtaggttacacgtacttctatactacacgtgggtcgacgaccgacggcccgtaggacgtagggtacgttggaggtggagtgggatggactaccgaaccgtagngtggagacagacgtcctacgngacgacgacggtacggtcccggaagggacgtacgggtacacggtagtaggacggttcggacgaccgtaccggaccgacggacgaccgaccggtaccagaacgttacgaacctttaccggagttacgagtaagttccgaggtaccggtaccgtccggttacctttacgttcgtcgtcggacgaacccgggtcccggtagggtaccgggggtaaccgggttcccaaacgggtttccggtaccgtcgggttacccgggg

SEQ ID NO: 121172 - DNA, 547 bp, Homo sapiens
  misc_feature: GYAE6OF01DJNPJ.41.2.A02.1.454.CMB.1.raw
  modified_base (365)..(365): a, c, t, g, unknown or other
  misc_feature (365)..(365): n is a, c, g, or t
  modified_base (504)..(504): a, c, t, g, unknown or other
  misc_feature (504)..(504): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtctggggctgaggtgaggaagccgtggggcctcagtgaagctctcctgcaagacttctggatacaggttcaacgtacttctatattaacacgtgggtgacgacaggcccctggacgagggacttgagtggatgggatggatacaaccgtaagaggtgtagacacaggccctatgacanacgaggttccgagggcagggtcaccatgtaaggtggtacgacgacggccgacgacgacacgtccacagtacgtaaccttaacagtactagaagtctagacgaacgacggtccgtttactcgtgtgacggtacgacccgngtacggggtacgggggtacctacggtacggtcgtaggtaccgg

SEQ ID NO: 121173 - DNA, 762 bp, Homo sapiens
  misc_feature: GYAE6OF01E2YHE.41.2.A02.1.454.CMB.1.raw
  modified_base (315)..(315): a, c, t, g, unknown or other
  misc_feature (315)..(315): n is a, c, g, or t
tcagtctatactatcacgaccggtgctcgatttagactcatctacagggggagcatcacccagcaaccacatctgtcctctagagagtcccctgagagcctccgttcctcaccatggactggacctggaggatcctcttcttggtggcagcagccacaggacgcccactctcaggtgcagctgatgcagtcgtgggctgaggtgacggagccgtgggcctgagtgacgtctctccgtgacaagtaccttcgtacggtaatacgtacggttaccaaaccgtactttactaactaattaccgacggttcggggtacnccggaaccgtacccgggtccccgttaaggggaacgtaacggggttacttagggacggttaggaggtacgggtactaggtaaccgtaaccgtaaaccggtaaaggtacggttggaccgaaccaaacgtccgtcccgtacgacggaaccgtaacggacgggtaccggttaccggacgggtaccgtacggggtacctaaccggtaggttacgggtacgggtcggaacggaccgggaaccgaacccgtacgacggaccgtaacggtaccaacgtacgtaacgtaacccgtacgtacggtactaagtacgtcggaacgtacggtaccggtccggtttaccgttacgttacggtcggtacgtacccggtaacccgggaccccggtacggggttaacccgggggaacccgggggttaccctaccgggtaccggttcggtaccgggtacccgggg

SEQ ID NO: 121174 - DNA, 724 bp, Homo sapiens
  misc_feature: GYAE6OF01BQRQ5.41.2.A02.1.454.CMB.1.raw
  modified_base (320)..(320): a, c, t, g, unknown or other
  misc_feature (320)..(320): n is a, c, g, or t
  modified_base (383)..(383): a, c, t, g, unknown or other
  misc_feature (383)..(383): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctaggaggtgaggaagccgtggggcctcgagtagaacgcttcctcctgacgaagtacttcgtaggactacgtacggttacaacgtacttctaataactacacgtgggtcgacgacgaccggcccgnggacgacgggtcttggaggtcggtagtgggagtggaactaccgaaaccgtaggtaggtggtanaccgacgcgtctcgtgcacgaggtacgtcggaggtcgtacgggtaccacgtagtaggtacggtacggtcggaacccgacggaacccgacggtaaccgggacccgtacccgggtaaccctaaacggtacggttaacccggttaaaccctttaacccgggtaacgttaaccggttaggttaaacccggtggtaccggaacgggttacccggtaccgggtttacccgtttacgttaccgtgggttacccaccggggtaacccggacccccgggttggggtaaacccggggggttacgggggaccccttaaccgggtaccggttaacggtcgggttacccggggg

SEQ ID NO: 121175 - DNA, 839 bp, Homo sapiens
  misc_feature: GYAE6OF01BXSRK.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtgggcctcgagtgaagcctctcctgacaagtacttcgtaggactacgtaggttacaacgtacttactaatactacacggtggggtcgccgacgaccggtccccgtaggacgacgggtacgttggaggtggagtgggtagtaggactaccgaaaccgtaaggaggtaggtacgaacgacgtacgtccctcgtcgaccgtaacgacggtaacgggttcccggaaggggtccgtaacggggtaccctaaccggtaggttacgggtagggttcgggtaaccggaaccgggtacccgggacccgaaccgggaccgggacccggtaacccgggtaccctaacggtaacggttaaccgggttaaaccctttaacccggtaacggtttaccgttaacgggtaaacggtttccggtaacgggtaaacccgggtaaccccgggttaaccggggtttaccccgtttttaaccggttaccgggtttccgggttacccgggtaaccccgggtaacccccgggtaaccccccggggtacgggggttaaccccggggggggtaaaccccgggggggttaccccgtttaaaccccgggggttaacccggggtttacccgggttaaccggggttaaccccgggggg

SEQ ID NO: 121176 - DNA, 708 bp, Homo sapiens
  misc_feature: GYAE6OF01BIP74.41.2.A02.1.454.CMB.1.raw
  modified_base (190)..(190): a, c, t, g, unknown or other
  misc_feature (190)..(190): n is a, c, g, or t
  modified_base (437)..(437): a, c, t, g, unknown or other
  misc_feature (437)..(437): n is a, c, g, or t
  modified_base (449)..(449): a, c, t, g, unknown or other
  misc_feature (449)..(449): n is a, c, g, or t
tcagtctatactatcacgaccggtgctcgatttagactcatctacagggggagcatcacccagcaaccacatctgtcctctagagacgtcccctgagagcctcccgttcctcaccatggactggacctgggagactcctcttcgttggtggcagcacgcccacgagggacgcccctactcctcgagggtncagctgatgcgagtcggtgggctaggaggtgaggacgtccggtcgggcctagagtgaacgtctcctcgtgactaagtcttcgaggtaactacgtacggttacaacgttacttacgtaatacgtacgacggttgggtacgaccggacgaccggtccccgtaagggaacggacgggtacgttagggaggtgggtaaggtagggatacggactaaaccgtaaaccgtaggtacggtgtaccgaacgtacnccgttacccgtntaccgacgaagtaacgggtacggtccggaacgggtcacgggtaccgacgtagcggaggtcggtaccgaacgacccgggacaacggaccgccgtaaccgtaccgacgtagtaaccgtaacctacgtacggtcgtacgtacgtcgacgggtacgaaccgtcgttaccggtttagtcggtcgtagtacccgggacggtaccccggtacggggtcgggaaacccggggtcctaacgggttaccggtacggtaccgggtacggg

SEQ ID NO: 121177 - DNA, 637 bp, Homo sapiens
  misc_feature: GYAE6OF01BL7Y3.41.2.A02.1.454.CMB.1.raw
  modified_base (149)..(149): a, c, t, g, unknown or other
  misc_feature (149)..(149): n is a, c, g, or t
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
tcagtctatactatcacgaccggtgctcgatttagactcatctacagggggagcatcacccagcaaccacatctgtcctctagagacgtcccctgagagctccgttcctcaccagtggactggacctgggaggactcctcttcgttggnggcagcacgccacgaggacgcccactctacgaggtcgcagtctagatggcaggttcggtggggctggagggtgaggtacgcgtcgggcctacgaggtagacgtccttacgtccgtgacgaacgtcttcgtgaactacgtaggtacaacggtacttataatactacgacggtggcacgacgcgccctggaacgcggtagtggacggtaggtacgtggatacggactaccgaaacgtaggnggtacggtacgacncgacgtctcgagactagaggtacgtcgaggtgacggtcacgagtgtaggtacggacgacgcggacgacgcgaccgtacgactacgacgtacgtaacgtccgtagtacgtagagtacgacggtaccgtacggtaccggttccgttagtcggtagtacggaccgtaccgggtaccggtacgggggtacccgggtaccggggtaccttacgggttaccggtcgttaccgggtaccggg

SEQ ID NO: 121178 - DNA, 838 bp, Homo sapiens
  misc_feature: GYAE6OF01DX4H2.41.2.A02.1.454.CMB.1.raw
  modified_base (241)..(241): a, c, t, g, unknown or other
  misc_feature (241)..(241): n is a, c, g, or t
  modified_base (297)..(297): a, c, t, g, unknown or other
  misc_feature (297)..(297): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacaggagcccactctcgaggtgcagctgactgcagtcgtggggctggaggtgaaggacgccgtggggcctcgagtagagtctctcngacagtactcgtgactacgtaggtactaacgtacttactatactacgacgttcggngtacggacgtaccggcccgtaggacggtacgggtacttaggaggtggtagtgggtataggactaccgtaaacccgtaaaggtacggttaggtacgtaaacgacgtaacggtcccgttcgtacggtacgaaccgtaacgggttaccggttacgggaaccggggtacggtaaccggggtaccgtaaccggtacggtagggtaagggttacgggttaccggaacccggggaacccggacccgaacgggaacccgacccggtaaccggtaacccgtaacgtaacgtaacggttaaccgttaacccggtaacgtaccgttaaggtaacccggttacggtaccggtaacgggtaacccggtaccccgggtttaccgtttttaaccccggtttaccggttaccgggttacgggaaccccggttacccccgggtaaccccccgggtaccgggggttaaacccggggggtaacccccgggggggttaacccggttaccccgggtttaaaccggggttaacccgggttaccggggttaaacccccgggggg

SEQ ID NO: 121179 - DNA, 726 bp, Homo sapiens
  misc_feature: GYAE6OF01CEODG.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatccctcttcttggtggcagcagccacaggacgcccactctcgaggtgcagctgatgcagtcgtggggctggagggtgaggaacggccgtgggcctacgagtcgaagcctcgtccgtgacaagtacttcgtggaacttagtacgttaccaacgtacttactaagttataccgtacggtgggtacgaccgtacgacccggtccccgtaggggaccgtaaggggtacgttagggagggtaggaggtagggaacgttaggacctaaccgtaaaaccgtaaagggtagggttacggtaacgaacgtaccgaccggttaccgtcgtacggacctaacggacgggttaccggttacggacgggtacgacggtccgaaccgtgtacggtaggtacggtacgaccgaccgggaaccgtacggaccgaccggtaaccggtccaaacgtacgtaacggtaaccttaccgtagttaccgtaggtaacgtgacggtacggaccgtacggttcccgtttacgtcggttcgtccggacggtacccggtcccggacgggttaccggggaccggggtaccgtaccggttaccggtggttacggtacccgggg

SEQ ID NO: 121180 - DNA, 812 bp, Homo sapiens
  misc_feature: GYAE6OF01BOWN9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagcgtgggcctcgagtgagctcctctgacaagtcttgtggatacgaggttaccaacgtacttctacgttatacctacggttggggtacgaccggtaacgaccggggtcccccgttacgggacggtaacggggtaccgtttagggtagggttacgggaaggttaggggtaatggggtaaaccttaccgaaaaccccggttaaaggtacgggttagggtacggaaccgtaaccgacgcccgttacgtacggtaccgaaaccggtaacggttaccggggttaccccggaacgggggtcccggtaacggggttacccaacccggttagggtacgggtaacggggttagggttaaccggaaccggttacccggggaaccgtacccgggtaaccggacccggtaaccgggttacccgaacgtaaccgttaaccggtaaaccgtttacccggtagtaccgttaacggtaacggttccgtaacggaggtaacccggtacggttacccgttttacgttaccgttcggttacggacggtaccccggacccggttacggggtaccggggaaccgggggtacccttacggtacccgggttcgtacgggtaaccccgggg

SEQ ID NO: 121181 - DNA, 667 bp, Homo sapiens
  misc_feature: GYAE6OF01BRYK7.41.2.A02.1.454.CMB.1.raw
  modified_base (193)..(193): a, c, t, g, unknown or other
  misc_feature (193)..(193): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcagctgatgcagtcgngggctggaggtggaggaacgtccggtcggggcctcgagtgaacgtctcctcgtgacaacgtacttcgagtaactacgtacgttacaacgtacttactaatactacgtacggtggacgaccggaccgccggtcccgtaggacggacgggtacgttaggacggttacggaggttagggtacgtacggtactaaccgtaaaccgtaaggtacggtaggtaccgaacgacgacgtccgtacgacgacgaacggtacggtacggtaccggacgggtacgaccgggtacaacggtagtacggtggtacggtacgacccgaccggtacgaaccgggacgacccggtaccgacctaacgtaggtaacctaaccgtacggtacgtcgtaacgtgtacgagacgtacgtacgttcgttactgtcgtagaccggcgcccggtagggacgggtaccgggactaccggtacggtcgcggtaccgggg

SEQ ID NO: 121182 - DNA, 736 bp, Homo sapiens
  misc_feature: GYAE6OF01CG2RA.41.2.A02.1.454.CMB.1.raw
  modified_base (277)..(277): a, c, t, g, unknown or other
  misc_feature (277)..(277): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactcctcgaggtgcagctgatgcagtcgtggggctggaggtgaggaacgccgtgggcctgagtagacgtctcctctgactagtacttcgagatacgtagtacaacgtacttntatatactacggtgggtcacggaccgaccggccccgtaggtaaccgagggtacttgggaggtaggtaggtggtacgtggtaacctaccgaaaccgttaaggaaggttcggtacgaacgaactacggcccttacgcgtacgacggtaagggttaccggggttccggaaggggtcccggaacgggtttacccgaaacccgtagggtaccggtaaggggttaccgggtaccggacccgacccggtaaccgaacgtacccggtccggtaaccgtccccaaggtaccggtaaccgttaaccgttacctacggtagtacgggtaatcggtaggaacccggttaggtccccgttaacgtttcggtacgtccgtacgacccgggtacccggccccggttaaggggtaccccgggggtaacccggggtacttacccggggtaacccggttagggaggttaccccgggg

SEQ ID NO: 121183 - DNA, 823 bp, Homo sapiens
  misc_feature: GYAE6OF01B3MFK.41.2.A02.1.454.CMB.1.raw
  modified_base (636)..(636): a, c, t, g, unknown or other
  misc_feature (636)..(636): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcccttcttcttggtggcaggccaggccacgaggacgcccactctcgaggtgcacgtctgatcgacgtgtcggtgggtctagggagggtggaacgggaacggtccgggtcggggtccctacggtaaggtacggtaacgtccgtccgttaccgtaggtaaccgtaaacgttcgtttacgtacggaactaccggttaggttaaccaaccgttactttacctaagtactaaccgtacggttgggtaccgaccgaccgtaccgggcccgtagggacggaacgggtacgttagggtaggtcggaaggtgggtagtcggtaacgtaaccgtaaccgtaagggacgttacggacgaacgaacggtcgtaccctgtaccgacgtaacgtaggtaccggtaccggaggtacggtacggtaccaggtagtggtacgggacgtaacggaccgaccggaaccggtacggagaccccggtacgaccgtacgaacggttacgtaaccttaacccgggngttaccgtaggtaacgttcggacccgtaggttaacccggaccgttttaccgttaccgttacggccgggtacccgaacccggggtccccggttaaccccgggtagggggttaccccggggggtaaacccgggttcccggttaaaccccggggttccggtaaaggttccccgggttaaaccccgggggg

SEQ ID NO: 121184 - DNA, 663 bp, Homo sapiens
  misc_feature: GYAE6OF01E1MBG.41.2.A02.1.454.CMB.1.raw
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtcgcagctgatgcagtcgtgggctgaggtggaggagccgtggggcctcgagtgagtctctccgngacaagtacttcgnggtactacgaggttaccaacgtactttactataactacgtacggtcggggttcaccggaaccaccgggtccccgtaggggaacccgaggggttaccttggacgggttggtaggtaggggactaggtaactaccgtaaacccggtaaggacggttggtacgaaccgtacgacgtccctacgtacgacacgtaggtaaccggtcggacgggcgtacgggtacctacgacgtggaggttcggacgaccgtacggccgaacggacgccgtacgaccacgaagtacgtaactaccgtagtcctagtacgtgacggagtaccgacggttccgttacgttcggtcgtgaccggtacccgacccggtacgggtacggggtacccggggtaccttaaggtccgggtacgtggtacccggg

SEQ ID NO: 121185 - DNA, 610 bp, Homo sapiens
  misc_feature: GYAE6OF01EDQW0.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggagggtgaggaagccgtggggcctcgagtgaagctctcctgacaagtacttcgtaggactacgtaggttcaacgtacttactatatacagtgggtgcgacgacggcccctggacgagggtacttggagtggagtgggatggactacgaacccgtaagaggtgggtagaacacgacgccctcgtacggcaacgaggtacggttccgagggtccgacgggtacaccgtagtaggaggtagggtacgacgaccggacccgacggacgccgaccggtccaacgtacgtacggtaaccttaccgacgtcgtagtacgtcgtacggagtaccgtacggttccgtttacttcgtcggtcgcggaccgacccggcggtacggggaccgggggtactacggtacggtacgtcggtaccggg

SEQ ID NO: 121186 - DNA, 754 bp, Homo sapiens
  misc_feature: GYAE6OF01CEAAH.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcgaggtgcagctgatgctagtcgtggggctggaggtggaaggaagccgtgggcctcgagtagaagtctctctcgacgaacgtacgttcgtaggactaacgtacgttactaacgtacttactaactactacgtacggtcgggtacgcgaacgaccggcccgtaggacgacgggtacgttaggagtagggtagtagggacgtaggactaaccgtaaacgtaacggtaggtacggacgtaacgaacgtacgtccctacgtacgaccgtacgaacggttacggtaccggacgggtaccgtacggggacctaccgtagtacggtaggtggtaaccgaccggtaccggaccggaccggacggaccgtaacccggtacccgtaacggaacggttaaccgttaacccgttaccggtacgttacgtacgtaacgtacggtacggtacccggaaccgttaccgggttccgtttaaccgttaccggttcggtacggtaccccggtaccgggtaccccgggtacgggttacccggggggtaaccggggttaccccggtaaggttacccgggttaacggttccgggttaccccggggg

SEQ ID NO: 121187 - DNA, 748 bp, Homo sapiens
  misc_feature: GYAE6OF01BIY1I.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacgaggagcccactctcaggtgcagctgagtgcgagtcgtggggctggaggtgagaagccgtggggcctcgagtgaagctctctgcaacggacttcgtggatacgtggttacaacgtacttactataataccgagtcgggttagaccgaccaggtccccgtggaaccgtaagggtaccgtttaggaggtaggagttggggagtagggtactaacgtaaacccggtaaagaggtacggttaggaacctaacgtacggtccctagttacggacgtaccggtaaggtaccggttcccggaacggggtacgaaccgggttaccgaaaccgtaagttagggtaccgggttagggttacggaaccggaccgggaccctaaccgggaacggaccgtaacccggggtaacctaaccgaggttaacgaaaccgtttaccgaagggttccttaagaacgtttaccgaggtaaccggacgtaaccgggttacctttaagtttcccggtacggttacgaccggttaacccggcccccggtagggtacggggtaacccggggggtacccttaaccgggtacggttacccggtaagggtaccccggg

SEQ ID NO: 121188 - DNA, 689 bp, Homo sapiens
  misc_feature: GYAE6OF01A439A.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctctttcttggtggcagcagccacaggacgcccactctcgaggtgcagctgatgcagtcgtgggctggaggtggaggaacggccgtcggggcctacgaggtggaacgtcctcctccgtcgacgtaacggtactttcgtaggactacgtacggttacaacgtacttacttatactactacgtggtcggcgaccgacggcccgtaggacggacgggtacgttaggaggtaggtaggtgggtagtacggtaacgtaaccgaaaccgtaaggtaggtggtacggaacacgtacgtcctacgtcgactacggacggttacggtaccggagggtccgaacgggtaccaacgtagtacgggaggttcggtaacggaccgaccggacccgagtaccgtacccgacggtaccgaacgtactacgggtaaccttacggacgttacgtaggtacgtacgtaggacggttaccgtacgggttaccctttacgtcgtcgtacgacggcccggaccggtacgggacgggggttaccgggtactaccggtacggttaccgtacgggtccgg

SEQ ID NO: 121189 - DNA, 658 bp, Homo sapiens
  misc_feature: GYAE6OF01COZWD.41.2.A02.1.454.CMB.1.raw
  modified_base (218)..(218): a, c, t, g, unknown or other
  misc_feature (218)..(218): n is a, c, g, or t
  modified_base (289)..(289): a, c, t, g, unknown or other
  misc_feature (289)..(289): n is a, c, g, or t
  modified_base (370)..(370): a, c, t, g, unknown or other
  misc_feature (370)..(370): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtgggcctnagtgaagctctcctgcaagtacttcgtggatacgtaggttacaacgtacttactatatactacgtgggtcncgacgacggccctggacgagggtacttggacggtggagtgggagtgactcaaaccgtaggacggtggtagacacacgtccncgtagcacgaggtacggttaccgagggcgagggtccaacgtagtagtacggtggtacgacgaccggacgaccggagccgaccggtaccacgaagttaccgaaaccgtttcaacggttcgtacgtaacggttcgacggaaccgggaccgtaccggtttacccggttttaaccgttccggttacgtacgggaccggttacccgggaccccccggtacgggttaaccggggggtaacccgggggttaaccctacggggtttaccccggtacggttaccgggtaacccgggg

SEQ ID NO: 121190 - DNA, 702 bp, Homo sapiens
  misc_feature: GYAE6OF01CD6RI.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgagggtgaggaagccgtggggcctcgagtgagctcgtcctgcaagcttcgaggactacgtaggttacaacgtacttactagttactacgtacgttgggtcgtacggacgaccgggccccgtaggaccgaggggtacttaggaggtggagtagggtacgtaggactaccgtaaaccgtaggtagtggtacgaaccacgacgcccgtacgtacgaccgtaaacgacgggtacgggttaacccggacggggaccgtaacggggttacccaaccgtaggttagggacggttagggaccgaaccggaccgggaacccgaacggtacggaccgtacccgggtaccaaccgtacggtaaccggtaaccttaccgtaacgttaccgtaaggtacgtacgtacggaaccggaccgttaccgggttacctttacgtcgtcggtacggacggacccggccccggtagggtacggggacccggggtactacgggtacggttccgtacggtacccggg

SEQ ID NO: 121191 - DNA, 611 bp, Homo sapiens
  misc_feature: GYAE6OF01ATHOJ.41.2.A02.1.454.CMB.1.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctggaggtgaggagccgtgggcctcgagtganctctcngcaagtacttcgagactacgtacggttacaacgtacttctatatacacggtggtcgacgacgacggcccgtggacgaggtactggagtggagtagggagtgactacgaaccgtaaggaggtggtacgacacgacgtacctcgtcgacacggacggtaccgggttaccgacgggcgtacggggtaccacggagtggacgggtggtaccggaccgaccggaccgacgacggaccgtaccggaccaagtacgtacgtaacctaccgaggtacgtacgtaagtctacgggacgaccgtcggttacccgttatcggtgtacggtccggaccggcccggtaggtaccggggacggggtacctacggtaccgtgtacggtcggg

SEQ ID NO: 121192 - DNA, 649 bp, Homo sapiens
  misc_feature: GYAE6OF01DFU7E.41.2.A02.1.454.CMB.1.raw
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
  modified_base (361)..(361): a, c, t, g, unknown or other
  misc_feature (361)..(361): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcagctgatgcagtcgngggctggaggtgaggagccgtgggcctgagngagctctccgtgacaagtacttgtaggactacgtaggttacaacgtacttactattactacgacggtggtcgcgacgacggtcccgaggacgagggtacttggaggtggagtcgggatagactacgaaaccgtaggngtcgtacgacgacgacgtctcgacgactaacgacggtacgtaccggacggacgacgggtaccacggtagtaggacgtggtacgaaccgcggtaccacggagcccgtaacggtccctaaagtcgtaaccgtaaaccttacgtaccgtagttacggaacgttcggacgtaccggtaaccgtaccgtttaccgtttacgttcggtacggcgggtaccgacccgtaccccgggtaggggtaccgggggaaccgggttacccttacgggacggtcggtaacccgggttacggg

SEQ ID NO: 121193 - DNA, 728 bp, Homo sapiens
  misc_feature: GYAE6OF01DI3RY.41.2.A02.1.454.CMB.1.raw
  modified_base (251)..(251): a, c, t, g, unknown or other
  misc_feature (251)..(251): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcagccacaggacgcccactctcaggtgcagctgatgcagtcgtgggctggaggtgaggaacgccgtggggcctcgagtgagcctctcctgacaagtacttcgnggaactacgtaggttacaacgtacttactagtactacgtacggttgggtacgccggtaccgaccggccccgttaggaaccggacgggtacttggaggtggagtgggataggactaccgaaaccgtaaggtggtaggtacaaccgacgacgtcctagtcgacgaacgtaacgggtacgggttaccggaagggtccggtaacgggtacccaaccgtagttagggtaacggtagggtacgaccggacccggacccgaacggacgacccggtaccgtacccgaacgtacggtaaccgtaaaccttaaccgacgttcgtaaggtaaccgttcgtagggaaccgggtaccgttaccggttcccgtttttacgtcggttacggtaccggacccggtaacccggtacccccgggtacggggtaacccggggggtacccggggttaccttaaccgggttaaccgggtcgtaaccgggtacccgggg

SEQ ID NO: 121194 - DNA, 812 bp, Homo sapiens
  misc_feature: GYAE6OF01A3GVG.41.2.A02.1.454.CMB.1.raw
  modified_base (313)..(313): a, c, t, g, unknown or other
  misc_feature (313)..(313): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacaggacgcccactctcaggtgcagctgatgcagtcgtgggctgaggtgaggacgccgtggggcctcgagtgaacgtcctctccgtgactaagtccttcgtaggactacgtacggttaccaacgtactttactaattataaccgtcggttcggggtanacccggtaaccgaccgggtacccccgttagggaacccggtaaggggtaccgtttgggaacgggttgggaagttcggggtagttacgggaacgtaaccccgtaaaacccggtagggtacggtaaggtccgaaacacggtacgtcccgtaggtacggacccgaaggtaaccggttaccgggtacccggaaggggtaccggtaaccggggtaccaacccgggtaaggtaacggtacgggtacgggtaaccggaacccggtacccggaaccggaaccggtaccggaaccggtacccgggtaacaaccgtacgttaacccggttaaacgttaacccggtagttacccggagttacgggtacacgggtaccggaccggttacccggttaccgtttaacgttcggtcggttaccggacccggtacccggtcccgggtacgggtaccggggggtaacccgggttacccgttaccgggttacggttaccggtacgggttaccccgggg

SEQ ID NO: 121195 - DNA, 676 bp, Homo sapiens
  misc_feature: GYAE6OF01D0RS0.41.2.A02.1.454.CMB.1.raw
  modified_base (176)..(176): a, c, t, g, unknown or other
  misc_feature (176)..(176): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggagcccactctcaggtncagctgatgcagtcgtggggctggaggtgaggaacgccgtggggcctcgagtaggaagtcctcctccgtagactaacggtaccttcgtaggacttaacgtacggttacaacgtacttactaatactacacgtggtgacgacgacggcccgtggacgacgggtactaggaggtggacgtgggatcggataccaaaccgtaagaggttggacgaacgacacgtcctcgtgacacgaggtcggttaccggaggcgaacggtcaacgtacgtgaagtggtacgacgtacggaccagacgccgacggtaccagtacgtaacggtaaccttacgagttcgtaagtacgtacgacggacgggtaaccgtacccgggttacgtttaccgtaccggttacgggtacggtacccgggtaaaccgaccccgggtcgggtaaacggggggtaacccgggggtaaaccccgggttaccggtaacggggttacccggttaacggtaacccgggg

SEQ ID NO: 121196 - DNA, 647 bp, Homo sapiens
  misc_feature: GYAE6OF01EK3BT.41.2.A02.1.454.CMB.1.raw
  modified_base (163)..(163): a, c, t, g, unknown or other
  misc_feature (163)..(163): n is a, c, g, or t
  modified_base (178)..(178): a, c, t, g, unknown or other
  misc_feature (178)..(178): n is a, c, g, or t
  modified_base (576)..(576): a, c, t, g, unknown or other
  misc_feature (576)..(576): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacaggacncccactcctcaggtncagctgatgcagtcgtgggctggaggtgaggacgccgtgggcctagagtagaacgtccttacctccgtagacgtaacgtaccttcggtaggtaactacggtaacggttaccaaacgtacctttactaatacttaccgacggtcgggtacgacgtaccgccggtacccgtggacgagggtactggagtggagtgggatacgactaccgtaacgtaggtgtcggacactacgcgtcctcgacgaccagacgggtaccggtacgacgggaccgtaacggtacaccgttaggtacggaggtacggtacaccgggtacgccgtacgacgtaccgacgacagtaccgtacgtaacctacgtgtacgtagtcgtacgaggacggtccctacggttaccttgtcgnggttacgaccgtcccggacccgggtgggacccgggggtaccggtcttaccgggacgtcgtcgggtaccggg

SEQ ID NO: 121197 - DNA, 962 bp, Homo sapiens
  misc_feature: GYAE6OF01BXIOA.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtgggctggaggtgaggagccgtgggcctcgagtgaagtcctctccgtgactaacgtacttcgtaggaacttaccgtacggttaccaaccgtacttacttaatactacgtacgtgggtacgacgtaccgaccggtccccgtagggaccggtacggggtacgttagggtacggtacgggtaggttaggggtacgttacgggtaaccgttaacccgtaaaacccggttaaagggttacgggttaacgggtacggtaaacccggtaaccgtacccggttacccgtttaccgtacggtaacccgtaaaccgggtaacgggtttaacccgggggtttaaccccggaagggggtaaccccggtaacgggggttaaccccaaacccggttaaggttaccgggtaaacggggtttacggggtaaccggaaaccccgggtacccggggtaaccccggaaaaccgggaccgggtaacccccggtaaacccggggttaaccctaaaccgtaacgggttaaacccgggttaaacccgtttaaccccggtaaggtttaacccggttaacgggtaaacgtttaccggtaaggggtaacccgggtaccgggttaccccggggttttaaccgttttacccggtttacgggtaccgggttacccggtaacccggggtaacccccgggtaccccgggttaccgggggttacccggggggaaaccccggggggtttacccttaaacccggggtttacccggggttaaccgttaccggggttaccccggggg

SEQ ID NO: 121198 - DNA, 661 bp, Homo sapiens
  misc_feature: GYAE6OF01EUOUT.41.2.A02.1.454.CMB.1.raw
  modified_base (175)..(175): a, c, t, g, unknown or other
  misc_feature (175)..(175): n is a, c, g, or t
  modified_base (539)..(539): a, c, t, g, unknown or other
  misc_feature (539)..(539): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtncagctgatgcagtcgtggggctggaggtgaggaagccgtggggcctcgagtgaacgtctcctcctgcaagtacgttcgtaggtaacttaaccgtaggttaccaaaccgtactttactataatacgtacgtggggtcgcgtaccgacggccccgtaggaccgagggtactaggaggtggagtgggagtggacgtaccgaaccgtaagtcggtaggtacgaaccgacacgtccgtcgtcgacacgacggtacgggttaccgagggcgaacgggttaccaccgtagtcggtagggtcggtaccgacggaccgggtaccgacgggtacgaccgtaaccggtaccaagtacgtacggtaaccttaccgngttacgtaggtacgtacgtacgggagtacccggtacgttccgtttacgtcgtcggtacggccgtaaccggcccggtacggtacgggggacccgggtctaaccggtcggtcgtaggtaccggg

SEQ ID NO: 121199 - DNA, 800 bp, Homo sapiens
  misc_feature: GYAE6OF01AYTNO.41.2.A02.1.454.CMB.1.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (285)..(285): a, c, t, g, unknown or other
  misc_feature (285)..(285): n is a, c, g, or t
  modified_base (393)..(393): a, c, t, g, unknown or other
  misc_feature (393)..(393): n is a, c, g, or t
tcagtctatactatcacgaccggtgctcgatttagactcatctacagggggagcatcacccagcaaccacatctgtcctctagagagtcccctgagagcctccgttcctcaccatggactggacctggaggatcctcttcttgggtggcagcagccacaggacgcccactctcaggtgcagctgatgcgagtcgngggctggaggtgaggaagccgtggggcctcgagtganctctcngacaagtcttgtggatacgacggttacaacgtcttactatactacgngtggtcgaccgacgaccggtccccgtaggaaccgtacgggtagttcggagggtcggagtggggaagtcggtaactaccgtaaaccgtaggagtacggtcgaacgtacnccggtcctagtacgcgtaacgaggtaccggtccggagggaccgtacgggtaaccacggtaaggtgggtaccgggtagggtacccggtaacccggacccgggtaccgaaccggtaccggaccggaaccccgggttacccaaaccggtaacgtaacccgggtttaaacccgtaccgtaacggtttaccggtaaccgggttacgtaccgggaacgggttaacccggtaaccgggttaacccccggttttaccgtttttacccgtcgggttaacggtaacccggttacccgggtaaaccccgggtacccccgggttacgggggtaaaccccgggggggtaccccggggggtttacccttaaaaccccggggtttacgggtaccgggttaaaccccgggggttaccccgggg

SEQ ID NO: 121200 - DNA, 614 bp, Homo sapiens
  misc_feature: GYAE6OF01DR5M3.41.2.A02.1.454.CMB.1.raw
  modified_base (190)..(190): a, c, t, g, unknown or other
  misc_feature (190)..(190): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcnggggctgaggtgaggagccgtgggcctcagtgaagctctcctgacaagtacttctaggactacgtaggttaccaacgtactttactaatactacacgttggggtcgaccgacgacggcccctggacgagggtactggagtggagtggggatcggactaccgaaacccgtaagacggttggtagaaccgacacgtcctcgtcgacacgacggtacggttaccgaagggcgaacggggtaccaaccgagtggagtggtacgaccgaccggcccacgacgccgtaacggccaagcgtacgtaacctacgagttcacgagtcgtaggacgaccgtacggtccgtttacgtcgttacgtcggaccgtaccggaccccggtggaccgggggtaccggggtaccctacgggttacgtcggtcggtaccggg

SEQ ID NO: 121201 - DNA, 751 bp, Homo sapiens
  misc_feature: GYAE6OF01C5JS2.41.2.A02.1.454.CMB.1.raw
  modified_base (146)..(146): a, c, t, g, unknown or other
  misc_feature (146)..(146): n is a, c, g, or t
tcagtctatactatcacgaccggtgctcgatttagactcatctacgagggggagcatcacccagcaaccacatctgtcctctagagacgtcccctgagagctccgttcctcaccatggactggacctggagatcctcttcgttggngcagcagccacaggacgcccatctcgaggtgacagctggatcgccgtagtcgtggggctggagggtagaggaacgtccggtcgggtccctagtaggtcggaagtcccgttcttcccgtagacgtaaacgttcccgtttagaggtaaccttaacgtaccggttaccgtaaaccgttactttactaacttacgttacggtaaccggtggggtacgccgtaaccgccgggtacccgtagggaccgaacgggtactgggaacggtaggtaggtagggtattacggacttaacccgaaaccggttaaggaggttaggtaacgaacgaccgacggttccctcggtaacgaccgaacggtacggttaccgggtaccggacgggaccggacgttacgaacgtagtacgggtcggtacgacggaccgaccggtacgaacggacgtccggaccgtacaccgtagtaacgtaccttcgacgttcgaagtacgttacggacgacggtaccggttaccggttacccgtttagtcccggtaggttccgaaaccggttcccgggaccgtacggggaacccggggacggggttacctaggtaccgtcggaacggtaccggg

SEQ ID NO: 121202 - DNA, 651 bp, Homo sapiens
  misc_feature: GYAE6OF01CMM37.41.2.A02.1.454.CMB.1.raw
  modified_base (297)..(297): a, c, t, g, unknown or other
  misc_feature (297)..(297): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagccccactctcaggtgcagctgatgcagtcgtggggctggaggtgaggaagccgtggggcctcgagtgaagcctctccgtgacaagtacttcgtggatacgtaggttaccaacgtacttctatactacacgtgggtncgtaacgcggccccgtggacgagggtacgttggaggtacggagtgggtatagggtactaccgaaacccgttaaggacggttagggtagaaccgtacaacggtccctacgttcgacctacggaggtaacgggttccggacgggacggtacgggtaccaacgtaggtacggtaggtacgggtcggaaccgtacggaccgaacggacgaccgtaccggtaccaacgtacgtacgtaaccgtactacgtgtagacgtcgtaggacggaccgtccggttaccgttacgtcgtcgtcgacggacccggaccgtcggtacggggaccgggtacgttaccggacggtcgtacgggtcccggg

SEQ ID NO: 121203 - DNA, 732 bp, Homo sapiens
  misc_feature: GYAE6OF01BCG7E.41.2.A02.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (583)..(583): a, c, t, g, unknown or other
  misc_feature (583)..(583): n is a, c, g, or t
tcagtctatactatcacgaccggtgctcgatttagactcatctacagggggagcatcacccagcaaccacatctgtcctctagagagtcccctgagagctccgttcctcaccatggactggacctggaggactcctcttcgttggtcggcagcacgccacgaggacgcccctactctaccgaggtcgcgagctgatgcngtcgtgggctgaggtggaggacgccgnggggtacctcgagtgaagtcctctcgngacgtaatcgttcgngagtacgtacggtacacgtacttactacgtataccgtggtgggaccgtacgtaaccgccgggtccccgtaagggtaccgaacggggttacgtttagggacgggttacgggtaacgggtgggtaacggttacgggaaaccttaaccggtaaaccccgtaaaggggtacggtttacggggtaaccggaaccgtaaccggtacccggttaaccgtccggtacgtaccgaacggtaaccggggtcgttacccgggaagggtcgaccggggtaccacgtacgttagggacgggtgtaccggaactcccggaagtcggacncccggacgtccaacgagttacgacctacgacggtcgagtacttcggacgaaccggcgttaccgttccgttacgttcgcgttcgacggtcccgcccgtaacgggcgggggtaacccgggtccttaacgtacggttccggaaggttccggg

SEQ ID NO: 121204 - DNA, 832 bp, Homo sapiens
  misc_feature: GYAE6OF01EN9XB.41.2.A02.1.454.CMB.1.raw
  modified_base (164)..(164): a, c, t, g, unknown or other
  misc_feature (164)..(164): n is a, c, g, or t
tcagtctatactatcacgaccggtgctcgatttagactcatctacagggggagcatcacccagcaaccacatctgtcctctagagacgtcccctgagagctccgttcctcaccatggactggacctggaggatcctcttcttggtggcagcagccacgaggacnccctactctcgaggtcgcagctgatgcaggtcgtgggctaggagggtgaggacgccggtcgggcctagagtagacgtcctcgtccgtgactaacgtcgtttcgtaggaacttaccggtacgttaccgtaaacgtactttactaatacttaaccgtcggtagggtcgaccggaaccggccggtacccggtagggacggtacggttacgttagggacggttggtacggtgggaacgtacggaactaacccgtaaaaccggttaggtagggtacggacgtaaaccgacgtccgtacccgtacggtacaaccggtacggtaacggggttaccggggttaccggaacgggtaccggtaccgggtaaccaaccgggttagacggggttacggtacgggtacccggaacccggacccgggaaccaccgggacgtaacccggaccgtaaccacgtaacggtaaccttaaccgttacgtaacgttcgacggttaacgtcggaacggtaccggtacccgttaccgggtttccttttacggttacggtcccggtaccggggtaacccgtaccccggggtacccccgggggtagggggttaaacccccgggggggtacccgggtttaccccggtttaaacggttccgggggtacccgttaaccgggggtacccccggggg

SEQ ID NO: 121205 - DNA, 717 bp, Homo sapiens
  misc_feature: GYAE6OF01D1I13.41.2.A02.1.454.CMB.1.raw
  modified_base (666)..(666): a, c, t, g, unknown or other
  misc_feature (666)..(666): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatccttcttcttggtggcagcagccacaggacgcccactctcgaggtgcagctgatgcagtcgtgggcgtggaggtggaggaacgccgtcgggcctcgagtgacgctcctcctgacaagtacttcgtggatacgtaggttacaacgtaccttacgtaatacgttacgacggttggggtcgaccgtaccgaccgggtccccgttacgggaacggtacgggtacgtttagggaacggttagggaggttacgggtagtacgggtaacgtaacccgaaaccggtaaggtacggttaggtacgaacgacgacgtccctacgtcgaccgacgtacgggttacggtccgagggaccgtacgggtaccaacgtagtacgggtaggtcggtacgaccgaccggaccgtacggacgacccgtacggtaccgaacgtaacggttaccgtaaccgttaccgaggttacgtaacggaacgtcgtagggaaccggtaccgttaccggttaccgtttaccgtcgtaggtccgaccggccggtaaccccggnggggtaccggggaaccggggtacccttacggtacgggtcgtacggtccggg

SEQ ID NO: 121206 - DNA, 809 bp, Homo sapiens
  misc_feature: GYAE6OF01CCAYY.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagcccacgaggacgccccactcctcgagggtcgcagctgatgcgtagtcgtggggcgtggaggtggaaggacggtccggtcggggcctacgaggtaggaacgtcctccgtccgtagaccgtaacgtcgttcgtaggtaactaacggtacggttaaccaacgttacttcttaatactacggtacgtgggtcgacgacggacccggcccgtagggacgtagggtacgtaggaggtgggtacggagggtgtacggaacctaccgtaaaccggtaagggtcgggttacgaacgaccgaacgtaccggtccctacgacggtaaccaaacgggtaacgggttacggttacccggggaacgggtccgggtaaccgggtaccgtaaccggtagggtacgggtaacggggtaacggtacgaaccccgggtaccgggaccgtaaccgggtacccggaccggttacccgaaccgaacttacgggttaaccgtaacccgttacgtaaggttccgtaaaggtacggttacggacggtaccgggtaccgttaccgggttcctttaacggtcgttacggaccggtacccggtacccgggtcccgggtaccggggttaacgggggacccggggtttacctaaccgggttcgggtaccggtcgggtaccccgggg

SEQ ID NO: 121207 - DNA, 725 bp, Homo sapiens
  misc_feature: GYAE6OF01B0KZX.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgtggggctgaggtgaggagccgtggggcctcgagtgagctctcctgcaacgacttctggtatacgaggttacaacgacttctatatacacgtgggtgcgacgacggcccctaggacagggtacttggagtggagtgggatggactacaacccgtaagaggtaggtcgacgacgacgccctcgtgaccacgaggtacggttaccgagggtacgacgggtacacccgtagtcggaggtcgggacgaccgaccggaccgacggacgccggtaaccggtaccgaaccgtagttaccgggtaaaccttacccgaacggttaccgtagtaacggttaccggtaggtaacccgggtaaccggtaccgggttacccggtttttaacccgttttccgttacgggttacccgggtacccgggtaaccccggtacccccccgggtaccggggttaaccgggggggtaaacccccgggggggggttacccttaaaccccggggttaacccgggtttacccgggttaaacggggttaacccccggggg

SEQ ID NO: 121208 - DNA, 795 bp, Homo sapiens
  misc_feature: GYAE6OF01ALEN9.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcaggtgcagctgatgcgagtcgtgggctgaggtggaggagccgtgggcctcgagtgaagctctcctagcaagtacttcgtaggtactacgtacggttacaacgtacttctagttaactaccgacgtgggtcgacgaccgacgggtcccccgtagggaaccgtacggggtaacgtttacgggagggttacggagggttacggggtaacggttacgggaacttaacccggtaaaaccccggttaaagggtaaccgggttacgggtaacgaaccgtaaccgtaccggtaacccgtcgttaccgaccgtaaccggtaacgggtaccgggtttaccggacggggtaccggtaccggggtacctaacccggaaggtagggtacgggtggttaaccgggaacccggaccgggacccgtaaggacccggaccggaacccgggtaccaaccggtacgtaccggtaacccgttaaccggtcgtacgtagtaacgtcgtacggaaccggaccgttacccggttccgtttacgtcccggttcggccggtaccggtaccggacccccgggtacgggttacggggggaaccccggggttacctaaccggtacccgggttcgtaaccggggtacccggg

SEQ ID NO: 121209 - DNA, 857 bp, Homo sapiens
  misc_feature: GYAE6OF01BCEDZ.41.2.A02.1.454.CMB.1.raw
tcagtctatactatcacgaccggtgctcgatttagactcatctacagggggagcatcacccagcaaccacatctgtcctctagagagtcccctgagagcttccgttcctcaccatggactggacctggagatcctcttcgttggtggcagcagccacgaggacgcccactctcgaggtgcagctgatgctagtcgtgggctggaggtgaggacgccggtggggcctcgaggtacgaagccttccgtcgtcgacgtaacgtaccgttgtacggtaagtacgtaacggttaccgaaacgttacttcttaaattaacgttaactacggttgggtcgacggtacgcccggtacccgtcgggaaccggtacgggttacgttaaggtacgggttcgggtaaacggttcggggtaacgtttacgggaaaacccttaaccggttaaaaccccggtaaagggtaaggttaacggggtacccggttaaaaccgaaccggtttaacccggtcccgtaccggttacggaaacccccggttaaggtaacccgggttacccggggttaaccggaacggggtaccccgttaacggggtaacccgtaacgttacgggtttaaggggaccgggttaacggtacgggtaaccgggtaacccgggacccgtaacgggtacggaccccggttaacggtaccctaaaccggtagttacccggtaaaccgttcggttaacgtacttaacggttacgtacggtacgtaacggttacccgtaccgggtttacttaccgggttcgacgttcgacggtaccccgtacgggtaccggacggggttaacccgggctttaccgggaggttcccgaaggtccccggg

SEQ ID NO: 121210 - DNA, 765 bp, Homo sapiens
  misc_feature: GYAE6OF01EPZGX.41.2.A02.1.454.CMB.1.raw
  modified_base (244)..(244): a, c, t, g, unknown or other
  misc_feature (244)..(244): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcacgccaacgaggacgcccactctcgaggtgcagctgatgcagtcgtgggctggaggtgaggacgcgtagggcctcgagtgaacgcttctccgtnacgaagtcgttcgtggtaactacgtacggttacaaaccgtacttacgtataacttaacgtacgtggggtcgtacggaccgacggtccccgtaggacgtaacgggtacgttcgggtaggtaggtaggtacgggagtagggaacctaaccgtaaaacccgtaggtaacggttcgggaacgaaccgtacgacggtaccgtacgttacggactaacggaagggttacccgggttacgaaccggggttacggtaacgggtccgtaaacgtaggtacggtaacggtagggtaccgaaccggtaccggaccgaacgcgtaaccggactaaccgacgtaacgtacggtaacctacgtacggtactaaggtacgtacgaaggaccggtaacgttcccgggttacctttcgttacgggtcgaaccgggtaccggaaccccggtcccgggtacggggtacccggggggtaaaccccggggttacccgttaaaccgggttacccgggttacggtacggttaaaccccgggggg

SEQ ID NO: 121211 - DNA, 626 bp, Homo sapiens
  misc_feature: GYAE6OF01BI4IB.41.2.A02.1.454.CMB.1.raw
  modified_base (192)..(192): a, c, t, g, unknown or other
  misc_feature (192)..(192): n is a, c, g, or t
  modified_base (233)..(233): a, c, t, g, unknown or other
  misc_feature (233)..(233): n is a, c, g, or t
  modified_base (584)..(584): a, c, t, g, unknown or other
  misc_feature (584)..(584): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatcgcagtcgngggctgaggtgaggagccgtgggcctcgagtgaagctctcngcaagtacttcgtggatacgaggttacaacgtacttctatacttacacgtgggcgacgacgacggccccgtggaacgagggtacgttggaggtaggagtgggtagtggtacgtaccgaaacccgtaaggtaaggtgggtacgaacctacgaacgtcccgtacgtacgacgaacgtacggtacggttccggagggtaccgacgggtacaccgtagtacggtacggtggacgacgacccggaccgacggcgaccgtaacggacccagtaacgtacggtaaacctcgagtaccgtaggtagtacggtaggacgtaccgacggttccgttacgttcgtgtcgacggccgacccgngggtacggggacggggtcctacggtacggtcgcggtaccggg

SEQ ID NO: 121212 - DNA, 891 bp, Homo sapiens
  misc_feature: GYAE6OF01C0NPU.41.2.A02.1.454.CMB.1.raw
  modified_base (132)..(132): a, c, t, g, unknown or other
  misc_feature (132)..(132): n is a, c, g, or t
  modified_base (206)..(206): a, c, t, g, unknown or other
  misc_feature (206)..(206): n is a, c, g, or t
tcagtctatactatcacgaccggtgctcgatttagactcatctacagggggagcatcacccagcaaccacatctgtcctctagagagtcccctgagagctccgttcctcaccatggactcggacctggaggntccttcttcgttggtggcagcacgccagaggacgcccactctcgaggtgcagctgatgcgtagtcggtggggtntggtaggtaggaacgggaacggtccggtcggggcctacgaggtagacgtctccgtccgtgaacgtaacgtacgttcgtaggtaactaacgtaacggtttaaccgaaccgttaccttactaagttaacgttaaccgtcggggttacgggtacgccggaaccgtacccgggtccccggttaaggggaacggtacggggttacgttaagggagggtaggtacgggttagggtacgtaacggtaaccgttaaacccgaaacccggtttaaaaggtcgggttaacgggaaccgaaccgtacccggtacgtccccgttagtacggtaaccgaacggtaccgggttacgggtaacccggtacggggacggttaccggtaacacgggtaagtcggtaaggtggtaccgaccggtaccgacgggaacgcggaacccgtacggtacccaagttacggtaacccgttaacggttaccgtaggtacctaaggttacggtacgtacgggtaacccggtaaccggttaccccggttttaacgttttaccgtccgggttaacgggtacccggtaacccggggttaaacccccggtaccccggggggtaaggggtttaccccgggggggaaaccccgggggtttaacccttaacccgggggtttaaaccggttccggggtaaacccggggttacccggggg

SEQ ID NO: 121213 - DNA, 736 bp, Homo sapiens
  misc_feature: GYAE6OF01AJZHN.41.2.A02.1.454.CMB.1.raw
  modified_base (162)..(162): a, c, t, g, unknown or other
  misc_feature (162)..(162): n is a, c, g, or t
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcacgccacaggacncccactctacgaggtcgcgacgtctagactgacgtagtcggtgggctggacggtaggacggacgtcggtcgggcctcgaggtcgacgtctctcgtgactacgtcgttgagacgtacgagttacacgttactcgtatactacgaggtggtacgaccgacgccggtccgaggtacgaggtacgtgacggngtacgtggagtcgaactaccgtaaacgtagggngtacgtaacgacctagtaccgtcttgtacgaacgacggacgggttaccgtacgacgggaccgttacgggaaccttacggtaggtacggttacggtacgggtaccgaacccggaaccggtacgacggtaacccggtaccgtacccggttacgaacggttacccggtaccggttaaaccttccggaggtttacgacggttaacgtccggttaacggacggttacccggttcggtttaccgtttatccgggtacgtaccgggtacccggtccgggtaccccgggtagggggttaacccgggggaccgggtttaaccgttaaccggttcgggtaaaccgttcggggttacccggggg

SEQ ID NO: 121214 - DNA, 981 bp, Homo sapiens
  misc_feature: GYAE6OF01EGGRN.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctctttcttggtggcagcagccacgaggacgcccactctcgaggtgcagctgatcgctaggtcgtggggctaggagggtaggaacgggaacgtcccgggtcggggtcctacgtaggttcggaaacgtcccttccgtccgtacggacgtaaacgttaccgtttacggttacgggtaaacgttaaccggtaacggttttaaccgaaaaccggtttaaccttttaaccgttaatttaaaccgttaaccgtaacgggtttccggggggttaccggtaaccgggaacccggtaaccccggggtcccccgttaaggggaaccggtaacggggttacgtttagggtaagggtgggtaaggtcggggtaacgtacgggtaaccttaacccggtaaaaacccggttaagggtacgggttacggtacggaaacccgtaaccggtaccgtcccgttcgtaccggtaacccgaaacgggtaacgggttacccggggttaaccgggacgggaacccggggttaacgggtaccccgtaaaccgggttggtaacgggggttacggtaccggggttaccggaaccggaccccgggacggaacccgacggtaacccgtacccgggtaccaacggttaacggtaaccgttaaacccttcgtaacggtaccgttaggtacgttacggacgggaaccggttacccgtaccgggttttacccgttttaacgttaccggtaggttccgggtaaccccggtaccccgggttaccccccggggtaaggggggttaaccccgggggggtaaccccggggtttaccgtttaaccccgggtacggggtttaaccgaacccggggttacccggggg

SEQ ID NO: 121215 - DNA, 729 bp, Homo sapiens
  misc_feature: GYAE6OF01BA1C9.41.2.A02.1.454.CMB.1.raw
  modified_base (193)..(193): a, c, t, g, unknown or other
  misc_feature (193)..(193): n is a, c, g, or t
  modified_base (287)..(287): a, c, t, g, unknown or other
  misc_feature (287)..(287): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcagctgatgcagtcgngggctggaggtgaggacgccgtggggcctcgagtgacgtctcctctgacaacgtcttcgtggactacgtaggtacaacgtacttctatactacncgtgggtcgccgacgcggcccgtaggacgaggtacgtggacggtggagtgggtatacgggaactaccccgtaaaccgtaagggacggttagggtacgaaaccgtaaccgcggtacccctcggtacggacccaaggtacgggttaccggggttaaccggcgggggtaaccgtacgggtaaccctacgtaaggttcgggaaggttaggggccgacccggacgggacccgaacggtacgacccggtcgtaacccgacgtacggtacgtaaaccttcggtacgttcgtaacggtacgtccggaaggtaccggtaccgtaccgggtttaccttttacgtcggtacgttccgggaaccggtcccccggtacccgggtcggggtaaccggggggtacccgggggtaccctttaaccggggccgggttaaccgtacggggtaccccgggg

SEQ ID NO: 121216 - DNA, 983 bp, Homo sapiens
  misc_feature: GYAE6OF01CPJJM.41.2.A02.1.454.CMB.1.raw
  modified_base (258)..(258): a, c, t, g, unknown or other
  misc_feature (258)..(258): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcacgccaacgaggacgccccactctcaggtcgcagctgatgcaggtcgtggggcgtggaggtaggaggaacggccggtcggggacctcgagtgaacggtcctcgtccgngacgaacgtacttcgtaggtaacgtacggtacggttacaaacgtacctttaactaacttaacgtaaccgtacgggtcgggttacgaccggaaccgacccggtccccgtagggtaccggtaagggttaccgtttagggaagggtacggtaaggggtaggtaacgttaccgggtaaagttaccccggtaaaaccgttaaggggaggtttacggaacgaacgacgtaccggtcctacgaccggtaacaacgtaacgggttaccgggttacggaacggggtaccggttaaccgggtaccgtaacgtaacgttagggtacgggtacgggtaccgggaaccgaaccccggggtacggaacccgggtaccggtaacccgtaaccccggggtactaaaccgggtaaaccgggttaaccccgggtttaaaacccgttacccggtaaacgggtttacgggaaccggtttaaccggtttacccggaaccgggggttaaaccgggttaaccccggttacccgggtttacccccgggttttttaacggttaccgggttttccgggtaaccccgggggaaccccggttacccccggggttaaccccccggggtaacccgggggggtttaacccggggggggtaaaaaccccccggggggggttccctttaaaccccggggggttttaaaacccggggtacccggggtttaaacccccgggggtttaaaccccggggggg

SEQ ID NO: 121217 - DNA, 767 bp, Homo sapiens
  misc_feature: GYAE6OF01DCEGL.41.2.A02.1.454.CMB.1.raw
  modified_base (181)..(181): a, c, t, g, unknown or other
  misc_feature (181)..(181): n is a, c, g, or t
  modified_base (474)..(474): a, c, t, g, unknown or other
  misc_feature (474)..(474): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcgttggtggcagcacgccacgaggacgcccactctcgaggtncagctgatgctaggtcgtggggcttaggagggtaggagggaacggtccggtcggggcccttagtaggtacgaacgtccttccgtccgtagaccgtaacgttccttacggtaggacttaacgtacggttaccgaacgtactttacttaatacgtaacgtacggtggtaccggacgaacccgtaccggtccccgtagggacgtacgggtacgtttaggacgggttaggtaacggttgggaactcgggtaacctaacggtaaaccgtagggaggtttacgggaacaccgagtaccnccgttacgacggaccgaagtcgggttaaccggtcggaacgggttaccggacgggttaaccacgggttagtacgggtacgggttacgggacctaaccgggccggtaccgtaaacgtccggtacccggtacggtacaaccgtcggtaaaccgttaactacggtcgttaagacggtaaccgttgaagaccgggtaaccctcggttacgtttccgaggtcggtacggacccggtacccgtcccggggagttaacggggggtcccggtactacggttaccggttgaacggtcccgggg

SEQ ID NO: 121218 - DNA, 757 bp, Homo sapiens
  misc_feature: GYAE6OF01ECPPY.41.2.A02.1.454.CMB.1.raw
tcagtctatactatcacgaccggtgctcgatttagactcatctacgagggggagcatcacccagcaaccacatctgtcctctagagagtccctgagagctccgttcctcaccatggactggacctggagatcctcttcttggtggcagcagccacaggacgcccactctcaggtgcagctgatgcagtcgtgggctgaggtgaaggagccgtgggcctcgagtgaagctactcctgacgaacgtacttcgtggtaactacgtagttacaacgtacttactaatacttacgtacgtgggtcacggtaccgacggccccgtaggaccgtagggtacgttaggaggtaggtggtaggtacgtacggtaactaacccgtaaaccgtaaggtacggttgtaacgacaacgacgtcctcgacgacgaacgtacgggtaccggttacgggaggtaccggtaaggtacccaaccgtaggtacggtacggtgggtaacccgtaaccggacccgggtaaccgaacggtaccgaacccggtaccggtaacccaagtacggtaacggtaacccttaccggtaggttaacctaagggtacgtacggtaaggaacccggttaaccgtaccgggttttacccgtttaacggttcggttaccgggaccggttacccggaacccgggttaccccgggtacgggttaccgggggggaaccccggggttacccttaaacggggttaccccggttaccggaacgggttaccccgggg

SEQ ID NO: 121219 - DNA, 739 bp, Homo sapiens
  misc_feature: GYAE6OF01BP1ZA.41.2.A02.1.454.CMB.1.raw
  modified_base (291)..(291): a, c, t, g, unknown or other
  misc_feature (291)..(291): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagtctgatgcagtcgtgggctggaggtgaggaagccgtggggcctcgagtagacgctctcctcgacaacgtacttcgagtatacgtaggttaccaacgtcttactaatactacnggtaggtcgcgtaccgacggcccgtaggacgtagggacgttaggacggttaggagtagggtagtacggtaacttaccgtaaacccgtaggtacggtaggtacgacgtacgtacgtcccgtacgtcgaacctacggacgggttaacccgggttacggacgggtccggtaagggtaccccgtaacgtaggtacggtaggttacgggaccgaaccggtcccggaaccggtacgccggtaaccgtaaccggtaccaaccggacgttaaccgttaacccttacgacggttaccgtaaggtaccgtacggtagaacgggtacccggtaccggttttaccgtttacgttggtccgtaggcccggtaaacccggggcccggttacccgggaacccggggggtacccgggggtaccctttaaccggggtaccgttagggtaaccgggttacccgggg

SEQ ID NO: 121220 - DNA, 729 bp, Homo sapiens
  misc_feature: GYAE6OF01BW8QV.41.2.A02.1.454.CMB.1.raw
  modified_base (249)..(249): a, c, t, g, unknown or other
  misc_feature (249)..(249): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcacgccacgaggacgcccactctcgaggtgcagctgatgcagtcgtgggcgtggaggtagaggacggtccggtcggggcctcgagtgaacgtctctccgngacgaacgtacttcgtagacgtacgtacggttacaacgtacttactaatactacgtacggtgggtcgacggaccggaccggtcccgtagggaccgagggtacgttggaggtgggtagtagggtagtacggtactaaccgtaaaccgtaaggtacggtaggtaacgacgaacgcgtcctcgtacgacacgacggtacggtccggagggacgtacgggtaccacgtagtgggtacgtagggacgaccggacggaccgacggaccggaccgtaccggtaccaacgtaggttacccgaaaccgtttacgagtttccggaaggttaacgtcgtacggaaccgggttacccgttaccgggtttaccttccggtttggaccggttccggaaccggtaccccgggtaccccgggtacggggtaaccgggggggtaaccccggggttacccttaacggggttaccggttcgggtaccggtacccggggg

SEQ ID NO: 121221 - DNA, 851 bp, Homo sapiens
  misc_feature: GYAE6OF01BD870.41.2.A02.1.454.CMB.1.raw
tcagtctatactatcacgaccggtgctcgatttagactcatctacagggggagcatcacccagcaaccacatctgtcctctagagacgtcccctgagagctccgttcctcaccatggactggacctggaggattcctcttcttgggtggcagcacgccacgacggacgccccactctcgaggtcgcagctgatgcgtagtcggtgggtctaggaggtggaaggtacggtccggtcggggcctaggacggtagacgtcctccgtacgtgaactacgtccttacggtagacttacgtagtacaacgttcttactatacacgtaggtaggcgacgacgccgcgtaggacgtaggtacgtagtacggtaggagtcggtagtacggtaacctaacgaacgtagggcgttaggaccgactacgtcgtcccgtagtacgaaccgtacggtacggtaccgggttaccggacgggtaccgtaccggggtaacctacggttaaggtacggggtaaccggttaccgggaaccgtaaccccggggtaccgtaacccgggtaaacgtcccgggtaaccccgtaaccgggtaacccaagggtttaacccgggtaaaaccggtttaaccccggtttaaccggacggggttaacctttaacgggaaacccgtttaccgggtaaccgtaaccccggggttaacccggtttaacccggggtttttccctttaaccggggtcgttaccgggtacccgggtaacccggtaccccggggttaccccgggaccggggggttaaaccggggggttacccgggtttaaacccctccgggtttaaaccggggtacctaaaccgggggtccccgggg

SEQ ID NO: 121222 - DNA, 877 bp, Homo sapiens
  misc_feature: GYAE6OF01BQDGF.41.2.A02.1.454.CMB.1.raw
tcagtctatactatcacgaccggtgctcgatttagactcatctacagggggagcatcacccagcaaccacatctgtcctctagagacgtcccctgagagctccgttcctcaccatggactggacctgggaggatcctcttcgttggtggcagcagccacgaggacgccccactctcgagggtgcagctgatcgcgtaggtcggtggggcgtggagggtacggaacgggaacggtcccggtacggggtcctacgtaaggtacggaacgtccgttccttccggtacgaccgtaaacggttacctttcggtacggtaacttaaccggttacggttaccaaacgttactttaccgtaataacgtacgtacggtcggggtacgaccggaaccggtaccggtccccggttagggacggtaacggggtacgttagggtagggttacggtaagggtgggtaacggtacgggtaactaacccggtaaaaccggtaaagggtacgggttacggtaacgaaccgtaaccgtacggtacccgttcggacgtaaccgtacggtaaccgggttacgggttaccgggaacgggtaccggtaacggggtactaacggtaggacgggtagggtacgggtaaccgaccggacccgggtaaccgaccggtaccgaccggacccgttaacgaacgtacggttaaccgtaacccgttcggtaacgttaccggaaggttaacggtttacggaacgggtaaccgttacccgttacccgggtttaccttttcgggacgtaccggggttagcccccgggtaaccgtaccccggggtacggggggacccgggtaacggggttccctaaccggggtttacggtccgggttaaacgggcccgggg

SEQ ID NO: 121223 - DNA, 729 bp, Homo sapiens
  misc_feature: GYAE6OF01D5TQ4.41.2.A02.1.454.CMB.1.raw
  modified_base (208)..(208): a, c, t, g, unknown or other
  misc_feature (208)..(208): n is a, c, g, or t
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
tcagtctatactatcacgaccggtgctcgatttagactcatctacgagggggagcatcacccagcaaccacatctgtcctctagagagtccccctgagagcctccgttcctcaccatggactggacctgggaggattcctcttcgttggtggcagcagcccacaggacgccctactcgtcgaggtcgcaggctgatgctaggttcggnggggctggaggtggaaggacggccgtcggggcctnaggtagaactcgttccgtacgngactaacgtccgttacggtgactaacgtaggttaccaacgttcttactatactacgnggttcggcgacggacgccggtcccggtagacgtagggtnttcgggaggtcggtagtgggtacgacggtactaccgtaaaccgtaagggtggtacgggtacaacctagtaccggtacgtccgtacgacccgtaacgggacgggttacccgggttgggaacgggcccgtaacggggtaccagtacggtagggtaggtccgggtacggaacccggccggtaaccggaccgacgtaccggacccgtacaaccgggtaacgtccgtaaaccggtccggtaagtttaccaagggtacttaggacggtaccggtaacggtccgttaccgttaccgtggttcgcggtacccgaccgggtcccggtaggggtacccggggacgggtttccacggtttcggtcggtacggtcccggg

SEQ ID NO: 121224 - DNA, 763 bp, Homo sapiens
  misc_feature: GYAE6OF01BYUYH.41.2.A02.1.454.CMB.1.raw
tcagtctatactatcacgaccggtgctcgatttagactcatctacagggggagcatcacccagcaaccacatctgtccctctagagagtcccctgagagctccgttcctcaccatggactggacctggaggatcctcttcttggtggcagcagccaacaggagcccctactctcgaggtgcagctgatgcagtcgtggggctggaggtggaggtaaggccgtggggccctcgaggttgaacgtcttcctccgtgcaagtccttcgtaggtataccgagttccaaacgtcttactatacacgacgtgggtgccgaacgaccgggtccccgtagggaccgtagggtactttaggaggtcggtagtgggtagtacggtaactaccggtaaaaccctaaggtcggttagggtaccgaacgtaccgaccgtacccttcggacgcccgtaaacgtaacggtaccgggttacgacggggaccggtacgggtacccgacgtaggtaggtacggttgggtaccgaccgaccgggacccgaaaccggtacgccggtaaccggtacctaccgaacggtaaccggttaacccgttaccgtacgttacgtacggtaacgttaacggtaccggaaacggtaaccggttacccggttccggtttacgttcgtcgggttacgacccgggtaaccggtaccccccgggtgggttaaaccgggggacccggggggttaccctaaaccggggtacccggttaacggtccgggtaacccgggg

SEQ ID NO: 121225 - DNA, 680 bp, Homo sapiens
  misc_feature: GYAE6OF01AE1QX.41.2.A02.1.454.CMB.1.raw
  modified_base (352)..(352): a, c, t, g, unknown or other
  misc_feature (352)..(352): n is a, c, g, or t
  modified_base (669)..(669): a, c, t, g, unknown or other
  misc_feature (669)..(669): n is a, c, g, or t
tcagtctatactatcacgaccggtgctcgatttagactcatctacagggggagcatcacccagcaaccacatctgtcctctagagagtcccctgagagcctccgttcctcaccatggactggacctggaggatcctcttcttggtggcagcagccacgaggacgcccactctcgaggtgcagcctgagtcgcaggtcgtggggctggaggtgaggacgtccgtgggctcgagtgacgtctcgtctgacaagtcttcgcggatacgtaggtactaacgtctactatactacgacggtggtacgccgacgacggtcccgtacggaacgtgggtacgtcggtaaggtcggaaggnggtacgtacggtaacgtaccgaaacgttagtacggttgaacggccaagtaccgtacccgtggtacgactaaacgggtacggtaccgtcgggaacggtccggtacgggtaccgacgtagtcggtagtcggttacgacccgacgggtaccgacgtacggtaccgccggtaaccgacgtcggtaacgtaaccttacggacgttcgaggtacgtaccgtaggaacggtacccgccggtttaccgttcggttcgtaccggttcggaccggtaccggcccggttacgggaccgggggtaccgtacgaccgttccgggtaccgngggtaccccgg

SEQ ID NO: 121226 - DNA, 908 bp, Homo sapiens
  misc_feature: GYAE6OF01BSR01.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacaggacgccccactctccgagggtcgcgagctcgatcgcgtagtcgtcggggctggaggtagaggaacgccggtcggggcctacgtagtacggaacgtcctcgtccgtgacaacgttaccgtttcgtacgggtaactaccgtaacgggttacctaaaccgttacctttactaattaacgtaaccgtacggttcggggtaccgtaccggaaccggtacccgggtccccgtaggggaaccgtaacggggtaccgtttagggaacggttacgggtaaggttaggggtaacgttcgggtaaacctaacccgtaaaacccggttaaggtacgggtacggtaccggtaaaccacggtaacccggtcccttacgtacgaccgtaaaccggagggtttaaccggggttcccggaacggggtaccggttaccggggtaacctaacccgtaaggtacgggtacgggtttacgggaacgaacccgggtaccggtacccggaacggtacccggtacccggtaacccgtaacccgtaacgtcgggtaaacccggtaaaccctttacccggaaggttacccggtaacgttaacgggtcgtacgggaacccggttaaccggtacccgggttttaacccgtttaccgtttcgggacccgttacgggaacccccggtacccggtaaccccgggtggggttaacccccggggggaacggggtttacccccttaacggggttaaccggttcccgggtacgggttacccggg

SEQ ID NO: 121227 - DNA, 680 bp, Homo sapiens
  misc_feature: GYAE6OF01BGIWB.41.2.A02.1.454.CMB.1.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
tcagtctatactatcacgaccggtgctcgatttagactcatctacagggggagcatcacccagcaaccacatctgtcctctagagagtccctgagagctccgttcctcaccatggactggacctggaggatcctcttctggtggcagcagccacaggagcccatctcaggtgcagctgatgcagtcgtgggctgaggtgaggagctggggcctcgagtgaanctctcngcaagacttcgtggaatacgtaggtttaccaacgactttctaatactactacgtgggtncgacgacggccctaggacgngggtacttggaacgtggactgggatggaatcaaccgtaagacgtggtcgaacactacggcctacgtgtaccgaactaggtacgggttaccaacggggctaaggggtccaaccgtagtacggacggttaggtacggaccgacggccgaaccggtacggaccgaaccggttacccaacgttaaccgtaccgggtaaaccttacccgtaacggttacgttaaggtacgtcccgtttaggaacgggtaaccgttaaccgggttcccgttttaaacgttcccgtagttacgggaaccgtacccggggtaccccgtacgggtacggggtacccggggggtaccttaacgggttacccggtacgtcgggttaacccgggg

SEQ ID NO: 121228 - DNA, 797 bp, Homo sapiens
  misc_feature: GYAE6OF01A7SLN.41.2.A02.1.454.CMB.1.raw
  modified_base (289)..(289): a, c, t, g, unknown or other
  misc_feature (289)..(289): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctgaggtgaggaagccgtggggcctcgagtgaagctctcctgcaagacttcgtggatacgaggttcaaacgtacttctatataacacgtgggtncggacacggcccgtggacgagggtactggagtggagtgggatggactacaacccgtaaggacggtaggtacgaaccacgacggtcctacgttacggacctaacgtacgggtaacgggttacccggaacggggtaacccggtacggggttaacccgaacccgtaaagggttacgggtaacgggtttacggggtaacccggaaccgggaaccccgggacccgaaccgggaaccggaccggtaaccccgggtacccaaaccgtacggttaaccggtaaaccccgtttaaccgaaccgggtttaccgttaacgggtaacggttaccggttacgggaccggggtaaacccgtacccggggttacccggttttaaccgtttccgttgggttaccggtaccgggtaaccccggtaacccccgggtacccgggttaaccggggggaacccggggggggttaccccgttaaacccgggtttacccgggttaaccgggtaccgggttaaccccggggg

SEQ ID NO: 121229 - DNA, 762 bp, Homo sapiens
  misc_feature: GYAE6OF01BH6TQ.41.2.A02.1.454.CMB.1.raw
tcagtctatactatcacgaccggtgctcgatttagactcatctacagggggagcatcacccagcaaccacatctgtcctctagagacgtcccctgagagcctccgttcctcaccatggactggacctggaggatccctctttcgttgggtggcagcagtacacgacggacgccccactctcgaggtcgcagctgactgcgtagtcggtggggctggagggtagaaggacggtccggtggggcctagagtacgacgtcctcgtcctgactaacgtcttcgaggactacgtaggtaccaacgttacttacgtatacgtaccgtacggttgggaccgacgaccgtaccggtcccgtaggaaccggtagggtacttgggaggtaggtagtagggtactacggaactaccggtaaacgttagggtaggtcgtacgaaccgacgtaccgtacgtcgtacgacgaacgtacgggtaccggtaccggagggtaccgtaccgggtacaaccggtaggtaggtacggtagggaccgaccggaccgggtacccgacggtaccgacccgtaaccggaccctaacggtaaccgtaacggttaacccttacggacgtttaccgacggtacgtacggtacggacggttaccggttaccggttcctttaccgtcgggtaccgtaccgggacccggtacccggtcccgggtaacggggtcccgggggtaacccggggttacctaacccgggttcggttacccgggtaccggttccgggg

SEQ ID NO: 121230 - DNA, 931 bp, Homo sapiens
  misc_feature: GYAE6OF01B38YN.41.2.A02.1.454.CMB.1.raw
tcagtctatactatcacgaccggtgctcgatttagactcatctacagggggagcatcacccagcaaccacatctgtcctctagagacgtcccctgagagctccgttcctcaccagtggactggaccgtgggaggatccttcttcgttgggtggcagacgacgacccaacgacgggacgccccaactcgtacgagggtgaccgagcttaggagttcggcgtacggttccggtgggggcgttgggaggggtacggaagggaaccgtccgggtccggggtccttacggaggtacggacggtcccttccgtccgtacgacgtaacgttacgtttcggaaggtaccgtaacggtaggttaccgtaaccgtaacttcgtaataccgtacgtacggttgggggcgaccggaccggtaccggacccggttacgggacggttacggggtacgtttagggtaacgggtagggtaaggttaggggtaacgttacggggaaccttaaacccgtaaaaccggtaggtaccgggttagggtaaccggacggtaacgtacccgtaccggttcgacggtaccgtaaaccgtcggggttaacgtcccggggagggtaaaccccgggtacggtaacccgaaccgttagggttaacggggaacgggtttacgggacccggtaccccgggaacccgggacccggtaaccgggaacccgtacccgggaaacccggttaccgaaggtaacggttttaacggaaacccccgtttacggtaacgggttaacgtacgggtaaaccttcgggaacggtaccggtaacccgggtttaccggttacttttacccgggagtaccgggttcggaaccccgggttaaccgggccccgggttagggaccccgggggttaacgggtccctaacggggtttaaccgccggtttacgggacccggg

SEQ ID NO: 121231 - DNA, 905 bp, Homo sapiens
  misc_feature: GYAE6OF01EM49S.41.2.A02.1.454.CMB.1.raw
  modified_base (178)..(178): a, c, t, g, unknown or other
  misc_feature (178)..(178): n is a, c, g, or t
tcagtctatactatcacgaccggtgctcgatttagactcatctacagggggagcatcacccagcaaccacatctgtcctctagagagtcccctgagagctccgttcctcaccatggactggactggagatcctcttcgttggtggacagcagccacgaggacgcccactctcgaggtncagctgatcgacgtgtcggtggggcttaggagggtacggaagggacgtccggtcggggcctacgaggtagacgtccttcctccgtagaccgtaacgtaccgtttcgtaggtacgttacgtaacgggttaacctaacgttacttacttaataacgttaactacggtcggggtacgtaccggtaaccgacccgggtcccgtaggacggtacggtacgttagggtaggtaggtacggtagggtaacggtaggtaacctaaccgtaaacccggttaagggtacggtaggtacggaaaccgtacgtaccgtaccgttacgtacgtaaccggtaacgtacgggttaaccgggttaccgggaacgggtaacccgggtaacgggtaaccgtaaacccggtaggtaacggggttacgggttacgggtaccggaacccgggacccggaacccggaccggtaacgggacccggtaaccggtaaccgaccgtaaccggtttaacgtaaccccgttagtaaccggttaccgtaacggtttaacgggaccggttaacgggaacccggtaaccggtttacccgggtttaccgttttaaccggttcggtttaccggtacggttaaccccgggtaaccccgggacccggggttaccggggggttaaaccccgggggggttaacccgggttaccccggtttaaacccgggaaccggggttcccgtaacggggtttaccccggggg

SEQ ID NO: 121232 - DNA, 731 bp, Homo sapiens
  misc_feature: GYAE6OF01B7FK6.41.2.A02.1.454.CMB.1.raw
  modified_base (500)..(500): a, c, t, g, unknown or other
  misc_feature (500)..(500): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttgggtggcagcacgcccacgagggacgccccacttcctcgaggtgcagctgatgcagtcgtgggctggaggtggaggacggtccggtggggcctacgaggtagacgtcctcgtcctggacaagtcttacgtagactacgtagttaccaacgtcttactatactacgtaggtcgggtcgaccgaaccgaccggtcccgtagggacggtacgggtcgttagggagtggtaggtgggtatacggtaactaaccgtaaccgttaaggcggttaggtacgacgaccgtacgtccctacgtacgaccgacggtaagggtacccgttacgggaggggtaccgtacgggacctaacgtaggtacggngggtggtaaccggaccgtaccgggacctacggacggtaccgaccggtacaacgtaggtaaccgtaaccgttcgtacgttacgtacgttagcgtacgggaccgtaccggtccggtttaccgtttaccgtacgtcggtaacggtccccggtacccgggaccccggggttacgggacccggggggtaaacccgggtacccgttaccggaccggttacgtacggggtaccccggg

SEQ ID NO: 121233 - DNA, 725 bp, Homo sapiens
  misc_feature: GYAE6OF01D1SAR.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggactggaggatccttctttcgttggtggcagcacgccacgacggacgcccacttctcgaggtgcagcgtgatgcgagtcggtgggctggaggtggaggacgcgtcgggcctcgagtgacgtctctccgtgactaacgtacttcgtagtacgtacgtacggttacaacgtacttactataacgtacgtacgtcgggacgaccggtaccggaccggtccccggtaggaaccggtacgggtacgtttagggaacggttagggtaggtagggtacgtacggtaaccgtaaccgtaaacggtaaggtaggtacggtacgaacgacgtacgtccgtacgtacgaccgaaggtacggttacgggtacggacggtccgaacgggtacaacggtagtggtaggtcggtacgaccgtaccggacgaccggacgaccgtacgtacacgtacgtacgtaacctacgtacgtcgttaacgacggtacgtacggaccgtaccgtaccggtttaccgttagttaccggtcgtaccggtacggtacccgggtaccgggcggggttaacccgggggaccggggttaacctaccgggttaaccggtcgttacgggtaccgggg

SEQ ID NO: 121234 - DNA, 880 bp, Homo sapiens
  misc_feature: GYAE6OF01DC9BZ.41.2.A02.1.454.CMB.1.raw
  modified_base (151)..(151): a, c, t, g, unknown or other
  misc_feature (151)..(151): n is a, c, g, or t
  modified_base (188)..(188): a, c, t, g, unknown or other
  misc_feature (188)..(188): n is a, c, g, or t
  modified_base (374)..(374): a, c, t, g, unknown or other
  misc_feature (374)..(374): n is a, c, g, or t
  modified_base (419)..(419): a, c, t, g, unknown or other
  misc_feature (419)..(419): n is a, c, g, or t
  modified_base (482)..(482): a, c, t, g, unknown or other
  misc_feature (482)..(482): n is a, c, g, or t
  modified_base (519)..(519): a, c, t, g, unknown or other
  misc_feature (519)..(519): n is a, c, g, or t
tcagtctatactatcacgaccggtgctcgatttagactcatctacgagggggagcatcacccagcaaccacatctgtcctctagagacgtcccctgagacgctccgttcctcaccatggactggacctgggagactcctcgttcgttgggnggcagcacgccaacgacggaccgccctacttcctagnggtcgcgacgtcgtagagtcgccgtagggtccgggtggggtacgtagggtagggtagggaaacgggccggtccgggtcggggtaccctaggtaaggacgtaccgtccttccgtaccgtacgaacgtaacgttacgttacggtagaacgttacggtaccggtaacacgttactataacgataccggnggtcggtaccgacgaccggcgtacccgaggtcgacggtggttagnggtcggtagtgggactacggaactaccggaaacgtggtagtacggacacggacacgtcgtacngaccgtagcggtacgcggtacggacgtacgcgtacgnggtagggtacggtacgaaccgacggtcccggtaacggacggtacccgaccgggtaacccgttacgaaccgggttaaccgttaaccgggtttaaccctacgggttaacccgggtaaccggttaacggttaaccgggtacggttaaccggacccggtttaaccccgggttacccggttttacccgttaacgggttcccggttacccggtacccgggggttaaccccccggacccccggggggtttaacccggggggtacccggggggttaaccccccggggggtttaaaccggggtaacccgtttaaaccccggggtttcccggggtaaaaccccggggttggggttaaaccccccggggggg

SEQ ID NO: 121235 - DNA, 834 bp, Homo sapiens
  misc_feature: GYAE6OF01AUPFZ.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggaccgtggaggactcctcttcttgggtggcagcgagccacaggagccccactcctcgagggtgcagctgatggccgagtcgtgggctggaggtggaggaacggccgtaggggccctagacgtaggtaacgtccgtcctaccgtcgaccgtaaacgtaccgtttacggtacggtaacttaaccggtacggttaaccgtaaaccggttaacctttactaaacttaacgtaacccgtacggttacgggggtaccgtaccggaacgtacccgggtaccccgtaggggaccggtacgggtaccggttagggtaggtacggtaacggtaggggagtaggtaaccgtaccgaaacccggttaaggtacggtacgggtacggacctaaccgacgtaccttccggtacgaccgtaacgtacgggtaaccgggttacccggacgggtaccgggtaaccgggttaccgtacccggtaagttacggggtaaggttacgggtaccggaaccgtaacccggggtaccgaaacggttcgggaacccggttacccggaccgtaaccgtacgttaaccggtaaccgtacggttaacgtcgtacgtaacgttacgggacgtaaccggtacgtacccggttccgttacgttcgcgttacggacccggtacgccccggggtacgtaccgggggtaccggtacccgtaggttaccggtacggtcgggtacccggg

SEQ ID NO: 121236 - DNA, 714 bp, Homo sapiens
  misc_feature: GYAE6OF01ARA64.41.2.A02.1.454.CMB.1.raw
  modified_base (217)..(217): a, c, t, g, unknown or other
  misc_feature (217)..(217): n is a, c, g, or t
  modified_base (478)..(478): a, c, t, g, unknown or other
  misc_feature (478)..(478): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatccttcttcgttggtggcagcagccaacaggacgcccactctcgaggtgcagctgatgcagtcgtgggctggaggtgaggacgcgngggcctgagtgacgctcctcgtgactaacgtcttcaggatacgtagtacaacgtacttctaatactaccgacgtggtcaccgacgtccggcccgtaggacgtaggtacgttggaggtggaggttaggacgtacggaactaaccgaaaccgtaggacggtcggaacgaccgtacgaccgtccttacgacgaccgtaacggtacgggtaaccggggtaccggaacggggccggtaaccggtaacgtacggtagggttaacggngggttaccggaacggacccggaccgggaccgaaaccggcgaccggtacccgaacgtacgtaacgtaccgtaacctacgtgtacgtacgtacgtacgtaacggccgttaaccggtacggttttcccgtttaacgtcgttaccgggccgttaacccggccccgggtacccgggaccggggttaccgggggaaacccggttcccgttaacggaccgggtttccggaccggtacccgggg

SEQ ID NO: 121237 - DNA, 765 bp, Homo sapiens
  misc_feature: GYAE6OF01C49C5.41.2.A02.1.454.CMB.1.raw
  modified_base (181)..(181): a, c, t, g, unknown or other
  misc_feature (181)..(181): n is a, c, g, or t
  modified_base (205)..(205): a, c, t, g, unknown or other
  misc_feature (205)..(205): n is a, c, g, or t
  modified_base (424)..(424): a, c, t, g, unknown or other
  misc_feature (424)..(424): n is a, c, g, or t
tcagtctatactatcacgaccggtgctcgatttagactcatctacagggggagcatcacccagcaaccacatctgtcctctagagagtcccctgagagctccgttcctcaccatggactggacctggacggatcctcttcttggtggcagcagccacgaggacgcccactctcgaggtgcngctgatgcgagtcggtgggctggnggtaggaggacgccgtggggcctagtagtgactctcctcgtcgactaacgtcgttacgaggtactacgtacggttactaacgtacctttataacttatacggtacgtgggtacgacgtaccggaccggtacccgtaggaccggtacgggtacttacggagggtcggtacggtgggtactaggaccttaaccgtaaccgtaaggtacggtgtacgtaccncgtacggtcctagtcgacgtacgacgggtacggtacccggaggccgggtaaccgggtactacgggtaagtacgggtacgggtacggtacccggaaccggccgtacccggacgggaccgtacccggtaccggacctaaggtaaccgtaacggtaacctttaccggtaggttaccgtaagggttaaccgtcggtacgggaaccggtaccggtttaccggtttaaccgtttccgtgttacccgggacggtaacccggtaccccggggtacccggttacggggggtacccggggtaacccggggttacctaacccgggtttacggcccggttacggggtccgggg

SEQ ID NO: 121238 - DNA, 624 bp, Homo sapiens
  misc_feature: GYAE6OF01B9389.41.2.A02.1.454.CMB.1.raw
  modified_base (436)..(436): a, c, t, g, unknown or other
  misc_feature (436)..(436): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagccccactctcaggtgcagctgatgcagtcgtgggctggaggtgaggagccgtggcctgagtgagctctccgtgcaagtcttgagatacgtaggttcaacgtacttctatatacgacgttgggcgcgtacaccggccctggaacgagggtacttggaaggtggagtgggatacgggactacgtaaacctaagggtggtacgtacggaaccaacgcggtccctaggtcgacgtacgaacggtcgggttaccgaagggtacgtgggtaccgtaaccgngtaacggtaggttgggacgacgtacggaccgaacggcgaccgtacgtccgaatacggtacgtaactaccgagttcgtagtagtcgagacggtacgtaccggttccgtttactcggtcgtaggccgtacggaccccgtgggtacggggtaccggggtcccgtacgttaccgggcgttaacggtccgggg

SEQ ID NO: 121239 - DNA, 690 bp, Homo sapiens
  misc_feature: GYAE6OF01CFKH9.41.2.A02.1.454.CMB.1.raw
  modified_base (220)..(220): a, c, t, g, unknown or other
  misc_feature (220)..(220): n is a, c, g, or t
  modified_base (285)..(285): a, c, t, g, unknown or other
  misc_feature (285)..(285): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtgcagcagccacaggacgcccactctcaggtgcagctgatgcagtcgtggggctggaggtgaggagccgtggggcctnagtgaagctctcctgacagtacttcgtgatactaggttacaacgtacttcgtatatacacgtggngtacgacgacggcccctaggacgtagggtacttgggagtaggagtggagtcggaactacctaaaccgtaaagcggtaggtacgtacacgacgtcctacgtcgacacgaggtacggttacggacgggtcgacgggtacaacccgtagttacggaggtcggtacgaccggaaccggaccgaaccggacgcccggtaaccggtacccaacgtagtaacggtaacctttaccgacgttcgtaagtaacgttcgtacggaacggaaccgtaccggtttacccggtttaccgtttacgtcggtaccggtaccggtaacccggtaaccccccgggtgggttaaccggggggaaccccgggggttaccctttaacccgggtaaccgggttaccgtaacgggttaaccccgggg

SEQ ID NO: 121240 - DNA, 652 bp, Homo sapiens
  misc_feature: GYAE6OF01EFH03.41.2.A02.1.454.CMB.1.raw
tcagtctatactatcacgaccggtgctcgatttagactcatctacaggggggagcatcacccagcaaccacatctgtcctctagagacgtcccctgagagctccgttcctcaccatggactggacctgggaggactcctctttcttgggtcggcagcagccacaggacgcccactctcgaggtgcagctgatgcagtcgtgggctggaggtgaggacgccgtggggcctcgagtgaagtctctctgactaagtccttcgtagtactacgtaggttacaacgtacttctatatacagtcgggtgcggacgcggtcccgtaggacgacgggtactggaggtggtagtgggagtggactaccgtaaccgtaggtacggtggacgaacaccgacgtcctcgtcgacacgtaggtacggttaccgagggaccgtagggtaccaccgtagtaggaggtcgggtacgaaccggccggaccgacggacgccgacggttaccagtacggtaccggtaaccttacgacgtaccgttaggaacgttcgaacggacggtaccggtacggttacccgtttagtcgtacggtccggtaccggacccgcccgggtacgggaccgggggtacggggccctaacggtaccgggttgacggtacccgggg

SEQ ID NO: 121241 - DNA, 681 bp, Homo sapiens
  misc_feature: GYAE6OF01DS3S6.41.2.A02.1.454.CMB.1.raw
  modified_base (192)..(192): a, c, t, g, unknown or other
  misc_feature (192)..(192): n is a, c, g, or t
  modified_base (425)..(425): a, c, t, g, unknown or other
  misc_feature (425)..(425): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagtcgnggggctgaggtgaggaacgccgtggggcctcgagtgaagctctccgtagacaagtaccttcgaggtaactacgtacggttacaacggtactttactaattactaacgacgttggggtacgtaccgaacgacccgggccccgttaggaacgaacgggtactttaggacggtggtagtgggatacggactaccgaacccgtaaggaggtggtacgacaaccgacgtccctgtacnccgtaacgaagggttcggtacgacgggacgacgggtacaccgagtagaggtaggacgtacgaccgaccgacgacgaccgtacgtaccaactacgtaacgtaaccgttaccgtacgtacgtacgtaagttcgtacggacgaaccggtaccggttaccgtttaccgttcgttcggtacggccggacccggtaacgggtccccccccggagggggtacccggggtacccgttacggtaccggtcgtacgggtacccggg

SEQ ID NO: 121242 - DNA, 855 bp, Homo sapiens
  misc_feature: GYAE6OF01C683Z.41.2.A02.1.454.CMB.1.raw
  modified_base (97)..(97): a, c, t, g, unknown or other
  misc_feature (97)..(97): n is a, c, g, or t
  modified_base (530)..(530): a, c, t, g, unknown or other
  misc_feature (530)..(530): n is a, c, g, or t
tcagtctatactatcacgaccggtgctcgatttagactcatctacagggggagcatcacccagcaaccacatctgtcctctagagagtcccctgagngctccgttcctcaccatggactggacctggagatcctcttcttggtggcagcagccacaggacgcccactctcgaggtcgcagctgatgcagtcgtgggctggaggtacggaggaacggtccggtcggggtcctcgaaggtagaacgtccgtcctaccgtggaacgtaacggttacctttacggtaggttaacttaaccggtaacggtttaacctaaaccggttaccgttttactaaacggttaacttaacccggttacgggttccggggtacgacccgggtaccggtaccccgggtacccccggtaaggggtaacccggtaggggttaaccgttttagggaagggttggggaaggtttggggaacgttacggaacgttaacccgtaaaccggttaaaggcggtttggaaacgaccgtaacgcgtacccgttncgaccgtaagtacgggttacggtaccgagggacgtaaccggggtacaaccgtagtacggacggttacgggtaccgaccgggaccgtacccggaaggccggtaacccggtaccgtacctaacggtaacggtaaccgtttaaccgttaaccggtagtttacgacgttaacgtacggtacggaacggttaacccggttcggtttaacccgttttcggttcgtacgggtacggtacccgggacccggttaacccccgggtggggtaacccggggggtacccgggggttaacccttacggggttaccctagggttaccgggtacccgggg

SEQ ID NO: 121243 - DNA, 674 bp, Homo sapiens
  misc_feature: GYAE6OF01CLBSF.41.2.A02.1.454.CMB.1.raw
  modified_base (601)..(601): a, c, t, g, unknown or other
  misc_feature (601)..(601): n is a, c, g, or t
tcagtctatactatcacgaccggtgctcgatttagactcatctacagggggagcatcacccagcaaccacatctgtcctctagagagtcccctgagagctccgttcctcaccatggactcggacctggaggactcctctttcttggtggcagcacgccaacgaggacgcccactccgtcgaggtcgacagcttagattgctaggtcggtggggtctgggaagggtgaacgggaacggccggtcggggccctagaaggttcgaacggtccttccgttccgacggtacgaacggtttccttacggtaggtaaccgtagtacgttaccgaacttccgttactataacgtacgtggtcgggtacacgcgaccggtccagggaccgtggtacgttagggagtcgggagtgggtagtcggaactaccgtaaaccgtagggcgttaggacaccgacgtacgtccgtcgaggtaccgacggtacggtacggtacggtacgggaccggtacggtacaaccgtaggttacggaggtcgtaacggaccggaccgacggaccgacgccgtaccgtccaggaacgtacgtacctacgagttcgaagtcgtacgngaacgtcgtacgtcttgtcgtcgacgccggcgtaccgtcgggacgggtacgcgttaggtcgtgtacggtcggg

SEQ ID NO: 121244 - DNA, 773 bp, Homo sapiens
  misc_feature: GYAE6OF01ACPWR.41.2.A02.1.454.CMB.1.raw
tcagtctatactatcacgaccggtgctcgatttagactcatctacagggggagcatcacccagcaaccacatctgtcctctagagagtcccctgagacgctccgttcctccaccatggactggacctggaggatcctcttcgttggtggcagcacgccacgaggacgcccactcctcgaggtcgcagctgatcgcgaggtcgtgggcgtggaggtaggaacgggaacggtccgtcggggcctacgtaggtacggtaacgtccttcctcgtcgaacctaaacgttcttacggtacggtaactaacggtacggttaccaaaccgttactttactaatactacgtaacggtcggggtacgaccgaaccgtaccggcccggtacggacgtaacgggtacgttggaacgggtaggtagtagggacgtacggtaactaacccgaaaccggttaggacggttcggtacgtaccaacgaccgtcccttacgacggtaccaacggtacggtacgggttccgaacggggaccggtacgggtaccagtaggtcgggtagtcgggaccgtaccggaccggaccggaaccgtacggaccggaaccgtcccgaagtacggttaaccgtaacctaaccgtgttaccgaaggtaaccgtcgtacgggaaccggttcgtccggtttaaccgttcggttcgtacggtacggacccggtacccgggtaccccggaggggttacccggggggaaccgggttacccttacggggtacggtgtaaccgggtcggg

SEQ ID NO: 121245 - DNA, 673 bp, Homo sapiens
  misc_feature: GYAE6OF01BGP1X.41.2.A02.1.454.CMB.1.raw
  modified_base (160)..(160): a, c, t, g, unknown or other
  misc_feature (160)..(160): n is a, c, g, or t
  modified_base (359)..(359): a, c, t, g, unknown or other
  misc_feature (359)..(359): n is a, c, g, or t
  modified_base (513)..(513): a, c, t, g, unknown or other
  misc_feature (513)..(513): n is a, c, g, or t
  modified_base (549)..(549): a, c, t, g, unknown or other
  misc_feature (549)..(549): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttctggtgcagcagccacaggacncccactcgtcaggtgcagctgatgcgtagtcggtggggtcgtggtagggtaggaacgggacgtccggtcggggcctacggaggtgaacggtccttcgccgtggaactaagtaccttcgtagactacgtaggttacaacgtactcgtactactactaggtgggcacggtacgaccgggccctggacggtacgtcgtaggnggtacgtagacgggttacgggtaactaccgaaaccgtagtaggtagtacgacaacggcaccgtagtcgaaccgtacgaggtaccgtagggacgggtacgtacgggaccacggtacgtacggtaggtacgtacgacggaccggtacgacggaacncggtaacggcccaagtcgtaaccggtactaacccgngtactagacgttcggacgtaccggtctaccggtttacgtaccgtttgccggtcggaaccggccggtcccggtacgggtaccggggtacggggaccttacccgggttacgcggtttcggaccggg

SEQ ID NO: 121246 - DNA, 713 bp, Homo sapiens
  misc_feature: GYAE6OF01AFVYP.41.2.A02.1.454.CMB.1.raw
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
  modified_base (314)..(314): a, c, t, g, unknown or other
  misc_feature (314)..(314): n is a, c, g, or t
tcagtctatactatcacgaccggtgctcgatttagactcatctacagggggagcatcacccagcaaccacatctgtcctctagagagtccccctgagagcctccgttcctcaccagtggactggacctggaggatcctcttcttggtggcagcagccacaggacncccactctcaggtncagctgatgcagtcgngggtctgaggtgaggacgccgtgggcctcgagtgactccgtctctagacaagtccttcgtggtaactacggtacggttaccaacgtacttactataactactacggtgggtcacgtacnccggtacccgtaggaacgtagggttacttaggagttcggaggtacgggtagtagaacccgtaccgtaaaaccggtaggtacggtaggtaccgaccaacgtccgtaccctgacaccgaacggtcggtaccggtccgaagggccgtacggggtacccaacgtagtacggtaggtccggaggtacccggtacgacccgaggtaccgaccgtaaccggaccaaggtacgtaaccgttaaccgttaccgacgttacggtaacgtacgtcggtacgacggttaccgtccggtttacccttacgtaggtcggacccgtacccggaaccgggtcccccgggtaacgggaacccgggggggtaccccggtaccttaacccgggaccgtttagggtacccggtacgggg

SEQ ID NO: 121247 - DNA, 748 bp, Homo sapiens
  misc_feature: GYAE6OF01BM05A.41.2.A02.1.454.CMB.1.raw
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
tcagtctatactatcacgaccggtgctcgatttagactcatctacagggggagcatcacccagcaaccacatctgtcctctagagagtcccctgagagcctccgttcctcaccatggactggacctgggaggatcctcttcttggtggcagtcacgccacaggacgtcccactctcgaggtcgcagctgatgcagtcgngggntggagtagaggacgcgtcgggctacgagtgacnccgtactcgtagacgtaagtacttgagtacacgtacggttaccaacgttcttacgtactaataaccgtacggtggggtcaccggtaacggaccggtacccgttaaggacccggtaagggttaccgtttagggaagggttagggtagtacgggggtacttacggtaccttaaaccgaaacccggtaaggttacggtacggtaacaaccgtacgaccgtccgttagaccgacgttacggacggttaccgggtacgacgggtaccggacggtaccgacgtaggaggtaacgggtacggtaacggtaccgacggaaccgacgacgtaccgacccggtaacctacggaaccgttaacgtaaccttaaccgagtacgttagtacggtcgtacggccggtaacgtaccggttacttaccggttcgtacggtacggaccgggtaccgacccgggttacggggaccgggggtacccgggtaccggttaacccggttaccggacggtttccggtaccggggg

SEQ ID NO: 121248 - DNA, 734 bp, Homo sapiens
  misc_feature: GYAE6OF01DN9MV.41.2.A02.1.454.CMB.1.raw
  modified_base (193)..(193): a, c, t, g, unknown or other
  misc_feature (193)..(193): n is a, c, g, or t
tcagtctatactatcacgaccggtgctcgatttagactcatctacagggggagcatcacccagcaaccacatctgtcctctagagacgtcccctgagagctccgttcctcaccagtggactggacctgggaggatcctcttcttggtggcagcagccacgaggacgcccactctcgaggtgcagctgatgcgngtcggtggggctggagggtaggacgggacggccggtcggggcctcgaggtcgacgtcctcctccgcgacaagtcgttcgtagtaactacgtacggttacaaccgttacttctaagtactacgtcggtacgggtcgacgaccggaccggcccgtaggacggagggtacgtaggaggtggaggtgggtagtacggtaacgtaccgtaaaccgttagggacggttagggacgacgaaccgtaccgtccgttcgaccggtacgaaaccgggttaccgggttacgggttacccgggaagggtaccgggtaaccgggtaacccctaaggaacggttgggtaacgggttcgggaccgaaccgggtaccgggacccaacgggccgacccggtaccgttacgaacgttaacgtaccggtaacctacgacgttacgtagtacgtacgaggactaccggttaccgttcgttactcggtacgtcggacccgcggaaccggtcggggaaccgggggtacccgggaccttgggaaccgttggcgggtaacccggg

SEQ ID NO: 121249 - DNA, 730 bp, Homo sapiens
  misc_feature: GYAE6OF01AEALN.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtgcagcagccacaggcacccactcctacaggtcgcgagctagatgcgagtcgcgggctggagtggaggtacgccgtcgggcctgagtacgacgtcctctaccgtagactaacgtacgttacgacgtaactacgtacggttaccgtaaccgttaccttacgtaacttacgtaaccgtcggtacggtacgaccgaccggtacccggtaccggtaggtacggtaacggtacgtggtaggtggtaggtacgggtacgtacggtaaccgtaaccgtaaaccgtaggtacgtacggaactacgacgtacgtccgtacgtacgacgtacggtacggttaccggtaccgggacggtacggtacgtaccgtacgttacggtacgggtaacggtaccggaccggaccgtaccggaccgaccggtacgaccggtaccgtaacgaacgtacggtaaccgtaaccgtacgtacgtacgacgtaacggtacgtacggtaccggtaccggttccgttaccgttacgttacggtcggtaccgaccggtccggtaccggtgggaccggggtaccggtacggtacggtcgtacggtccggtacgg

SEQ ID NO: 121250 - DNA, 778 bp, Homo sapiens
  misc_feature: GYAE6OF01CP6A5.41.2.A02.1.454.CMB.1.raw
  modified_base (518)..(518): a, c, t, g, unknown or other
  misc_feature (518)..(518): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacgaggacgcccactctcgaggtcgcgagcgtgatcgcgaggtcgtggggctggaggtggaacggacgtccggtcgggcctgaggtgaacgtcctccgtccgacgacgtaaacgttcgttcggtaggtaacgtaacgtacggttaaccgaaccgttactttacttaacgttaacttaccggtaacgggtttcgggtaccggtaccgaaccggtacccggtccccggttaggggaaccgtacgggttacgttggacgggtaggtaggtagggtacgtacggtaactaaccgtaaaccggtaaggtaggtacggtacgacgaacgtcgtaccgtcgtacgaccgtaacgacgggtcgtaaccggngggacgtaacgtacaacgtgtggtaagggtcgagaacccgacgggccgtaaacggcgtacccggtaaccgacgaagttacgggaaccctaacgtaccggtacgtaacggttacggaacgtttcggaacgggtacggacccgtttaccggttacctttgtcggtgtaaccccgggacgttaccccggggcccggttacggggaccggggggtaaccccggttattaccccggtagggttaccgtccgggtaaacccggggg

SEQ ID NO: 121251 - DNA, 630 bp, Homo sapiens
  misc_feature: GYAE6OF01CFRI4.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaagccgtggggcctcagtgaagctctcctgcaagacttcgtggaactactaggttacaacgtacttctatatacacgtggtcgcgacacggccctaggacgagggtacttggaggtggagtagggactggactaccgaaaccgtaagtacggtggtacgactacgacgcctacgtcgactacgaggtacggttaccgaggggcgacgggttacaaccgtagtcgtaaggttcgggtaggaaccaccgggaacccgaacggacgaacccgacgggtacccgaagtaacggtacggtaaaccttaccgagttacgtacgtaacgttcgtaggacgaccgtaccgttaccgtttacttcgtacgtacgacgaccgaccccggtggtacggggaccggggtaccttaggtaccgtggtcggtaccgggg

SEQ ID NO: 121252 - DNA, 588 bp, Homo sapiens
  misc_feature: GYAE6OF01DGMTL.41.2.A02.1.454.CMB.1.raw
  modified_base (176)..(176): a, c, t, g, unknown or other
  misc_feature (176)..(176): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (438)..(438): a, c, t, g, unknown or other
  misc_feature (438)..(438): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtncagctgatgcagtcgtgggctggaggtgaggacggccgtggggcctcgaggtgaacgctctccgtagacgaagtacttcgtaggtaactacgtagttacaacgtacttactactatacacggtggcgccgacgcggcccgtggacgaggtactggaggtggagtgggatggactacgaacgtagnggtgngacncganctcgcgacgagagtcgtcgaggcgaggtccagtgtggagtgagacgacggccagcgacgccganaccagtacgtactacgtagtgacgtagttcgacggacggtaccgtacggtcccgttttagtccggttcgagggcccgtaacgggaccccggtagggaaccgggggttacccggggaccgttaccggtacgggtaccgtgggtaccccggg

SEQ ID NO: 121253 - DNA, 649 bp, Homo sapiens
  misc_feature: GYAE6OF01DURX4.41.2.A02.1.454.CMB.1.raw
  modified_base (256)..(256): a, c, t, g, unknown or other
  misc_feature (256)..(256): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcacgccacaggacgcccactctcaggtcgcagctgatcgcaggtcgtggggctggagggtcggaggaacggtccgtggggtcctcgtaggtagaacgtctactccngacaagtcttgtggtatacgtacgttactaacgtcttactaatactacgtacggtgggtacgaccggtacgccgggtacccgtggaacggtagggtaccttggaggtggaagtgggataggactacgtaacgtagtagtgganacncgatctncgacagaggcgtcgaggcgagggtacacgtagtacggtacggtacgggtacgacgacccggtaccgaacgggaccgaccggacccgtaccaaggtacgtaacggtaacctacgtagtcgtaggtacgttcgtacggaggacgtacccggttcttacgttcgtacggcgtacggccccggaccggggtgtaaccggggggtaccgggtacccgttacggtacgggtcgtacgggtaccggg

SEQ ID NO: 121254 - DNA, 791 bp, Homo sapiens
  misc_feature: GYAE6OF01D6ZP9.41.2.A02.1.454.CMB.1.raw
  modified_base (461)..(461): a, c, t, g, unknown or other
  misc_feature (461)..(461): n is a, c, g, or t
tcagtctatactatcacgaccggtgctcgatttagactcatctacagggggagcatcacccagcaaccacatctgtcctctagagagtcccctgagagcctccgttcctcaccatggactggacctgggaggatcctcttcttgggtggcagcacgccacgacggaccgccctactctacgaggtgcagctgatcgactggtcgtggggctggagggtagaaggacgtccggtacgggcctacgagtagaacgtctcctcgtgacgtaacgtccgttcgagtactacgtacggttaccaacgttaccttactaacgtactaaccggtacggtcggggtacgaccggaccggaccggtcccggtaggacggtacgggttacgttagggaggtacggtaggtcgggtaacgtacggttaacctaacccgtaaacggtaacggtgggtaacggtacgtaaaccnccggtaacgtccgtacgtacggaccgacggttaacgggcggttacggaacgggtaccggaacgggtacctaacggagttcgggtaaggtacgggtaaccgaccgtaccggaccgtaacgggtaccgtaccggtaaccgtaccgtaacggtacggtaaaccgtacccgttacgtacgttacgtaacggttacggacggtacggaccggtaccggttaccgttacgtttaccgtcgtccggtaccggaacccggttacccgggtaccgggaacgggttacccgggggtaacggtcccggttaaccgggtacggttcgggtacggtaccgggg

SEQ ID NO: 121255 - DNA, 658 bp, Homo sapiens
  misc_feature: GYAE6OF01DXLUD.41.2.A02.1.454.CMB.1.raw
  modified_base (315)..(315): a, c, t, g, unknown or other
  misc_feature (315)..(315): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcacgccacaggagccccactctcgaggtgcagctgatgcagtcgtgggctgaggtgaggagccgtgggcctgagtgagcgtctcctgacgagtacttcgtaggactacgtagttacaacgtacttactaatatacgtacgtggtcgacgacgcgtccccgtagacgnggtacgtgagtggagtggagtaggactacgtaaaccgtaaggtggtaggtacacaacgtacgccgtccgtacgaccagtaacggtccggtaccggaacgggtcgacggtaccacgtagtaggtacgtgggtacgacgtaccggccaacggtacgaccgtaacggtaccaacgtaacggtaaccggttacctaaccgtacgttacgtacgtaagtaccgtaggtaccgtaacggtacccgttccgttttaccgttcgtacggttaccgccggtaaccggaacccggtgggtaacccggggtacgggttaacccgtacggttaaccggtcggtacggtacccggg

SEQ ID NO: 121256 - DNA, 694 bp, Homo sapiens
  misc_feature: GYAE6OF01BXA03.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcagccacaggagcccactctcaggtgcagctgatgcagtcgtgggctggagtgaaggagccgtgggctcgagtagagctcgtcctgactaagtacttcgagaacttacgacggttacaacgtactttactaataactacgtagtgggtgaccgacgtaccggcccctaggacgtagggtactaggaggtggagttgggatagggactaccgaaaccgtaaggtgtacggtacgaacacgtaccgtactcgtagaaccgagtacgggacggttaccgagggtacgtaacgggacctaaccgtaggttacggaggttgggtaaccgaccgtaacccggcgaaccgacgggaccgtaacccggtacctaacgacggttaaccgtaaactacccgtaagtacgtaacgtaacgtaccggtagaacggtaacccgttaccggttaccgttttaacctacggttggaccgggacccgtaacccggaaccccggttgggtaacgggggaccccggggttactaaccgggttaccggcggttacggtacccggg

SEQ ID NO: 121257 - DNA, 679 bp, Homo sapiens
  misc_feature: GYAE6OF01BEO5D.41.2.A02.1.454.CMB.1.raw
  modified_base (264)..(264): a, c, t, g, unknown or other
  misc_feature (264)..(264): n is a, c, g, or t
  modified_base (583)..(583): a, c, t, g, unknown or other
  misc_feature (583)..(583): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcagccacgaggagcccactctcaggtgccgagctgatgcgacgtcgtcggggcgtggaggtgaggacgccgtggggcctacgagtagacgtcctcgtcctcgacaagtaccttntaggactacgagttacaaccgtacttctatatacacggtgggtcacgaccgacggtcccgtagacgagggtctaggtaggtcggaggtacgggtagtcggtaacgttaaccgaaacccgtaaggtagtcggtacgacgtacgacctccgtctagactaaggacggtacgttaccgacgggaccgtaacgggtaccacgacgtggtacggtggtacacgtaccgccgtagaccgacgcgtaaccacgtaaggtacccgaagttacgcgttacgtaagtagttacggacgacggtaaccggtacggttacccgttcggttntacgggtagacccgggtacccggaccccgggtaggtaccccgggggaaccggggttaccggttacccgtagggttaccggtaacggttacccgggg

SEQ ID NO: 121258 - DNA, 1058 bp, Homo sapiens
  misc_feature: GYAE6OF01C3HJI.41.2.A02.1.454.CMB.1.raw
tcagtctatactatcacgaccggtgctcgatttagactcatctacgagggggagcatcacccagcaaccacatctgtcctctagagagtcccctgagacgctccgttcctcaccatggactggacctggaggatcctcttcgttgggtggcagcagccagacggacgcccactctcgaggtgcagctgatgcgagtcggtgggctggaggtaggaggaacgccggtgggacctacgagtagacgccgttactccgagacgtaacgtacgtttacgacggtaacgtaacgtagggttaccaaaccggttaccttaacgtaactaacgttaaccgtacgggttacggggtacgacccggtaaccggtacccgggtaccccggtagggtaaaccgggtacggggttaaccgttagggtaacgggtacgggtaacggttacgggggtaacgtacggtaacccgttaaacccgggtaaaacccgttaaggggtaacgggtttacggtaaaccggaaaccgtacccggtaaccggtccctttacggtaacccggtaacccgtaaacgggtaacgggttaaccgggggttaacccggtaaaccggggaccgggttaaaccgggttaacccgaaaccggtttaacggttaccggggtaagggtttaaaccggggaccgggttaaacccggaacccggggttaccccggtaaacccgggtaacccgtaccccggggtaaaccccggttaacccggtaaaccccgggtttacggttaaaacccgggtttaaacccggttaaccccggtttaaaaccggggtaccgtttaaaccgggtacggttaaccgggttaaccggaaccggggtttaaccccggtaccccggggtttaccgttttaccggtttaacgggtacccgggttaacggtaaccccggggtaacccccggttaaacccgggggtaccgggggtttaaaaccccgggggggtaccccggggggtttaaacccggtttacccgggtttaaaacccgggggttccgggttaaacccgggtttaccccgggggg

SEQ ID NO: 121259 - DNA, 714 bp, Homo sapiens
  misc_feature: GYAE6OF01C2IAB.41.2.A02.1.454.CMB.1.raw
  modified_base (138)..(138): a, c, t, g, unknown or other
  misc_feature (138)..(138): n is a, c, g, or t
  modified_base (158)..(158): a, c, t, g, unknown or other
  misc_feature (158)..(158): n is a, c, g, or t
  modified_base (244)..(244): a, c, t, g, unknown or other
  misc_feature (244)..(244): n is a, c, g, or t
  modified_base (592)..(592): a, c, t, g, unknown or other
  misc_feature (592)..(592): n is a, c, g, or t
  modified_base (656)..(656): a, c, t, g, unknown or other
  misc_feature (656)..(656): n is a, c, g, or t
tcagtctatactatcacgaccggtgctcgatttagactcatctacgagggggagcatcaccagcaaccacatctgtcctctagagtagtcccctgagagctccgttcctcaccatggactcggacctggaggatcctntcttggtggcagctagccanaggagccactctcgaggtgccagctgatgacagtcgtggcgtgaggtcgagacgccgtagggcctcgagtgaacgtctcttaccgngacgtacgacgtttcgtacggaactaccgtacggttacgaaaccgtacgtttactaactacgtaccgtacgtttacggggttcgaccgtaccgtacggtacccccgttaggaaccgtacggggtaccgtttacggaaggtgggtacggttagggtaacgttaggtaacgtaaccgtaacccgttaaagggacggttacggttagaaccgtacgtaccgggtacccttagaccggtccgtaacggaacggtcgggtttacccgtaacgggacctaacggggtttacaacccgtagtaccggtagttacggtacgaacgtaccggaccgaacgtcggtacaccgacgtanagtacgtaacacgtagtacatacgtcgagacgtaccgagggttaccctttagtccgtaggttanacggtccgacccgacgggtacgggaccggggtcctacggtcggtcgtaacgtaccggg

SEQ ID NO: 121260 - DNA, 677 bp, Homo sapiens
  misc_feature: GYAE6OF01C5BKA.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggaacgccgtggggcctcgagtgaagctctccgtgacaagtacttcgtgtactacgtaggttacaacgtacttctatactactacgtggtgcgacgacggccctggacgagggtacttaggagtgggagtgggagtaggactaccgaaacccgtaaaggaggttggtacgaacaacgaccgtccttcgtagacgaacgacgggtacggttaccggacggggcccggtaacgggtccgaacccgtaggttacgggtaacggggttacgggtacgaacccggaccgggaccccgaacggacggtaccgtaaccgggtaccaacgtaaggtaccggtaaaccttaccgtagtcgtagtaacgttccgtagggaaccggttacgtaccggttccgtttacgttcgtgtccggacggtacccggaccccggtgggtacggggtaacccggggtccttaggtaccggcgtcggtaccggg

SEQ ID NO: 121261 - DNA, 612 bp, Homo sapiens
  misc_feature: GYAE6OF01D2LEW.41.2.A02.1.454.CMB.1.raw
  modified_base (476)..(476): a, c, t, g, unknown or other
  misc_feature (476)..(476): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaagccgtggggcctcgagtgaagctctcctgactaagtactttcgtaggattacgtaggttacaaaccgtactttactaatataccgtacgtgggtgtaccgacgacggtcccctagggacgagggtacttggacggtggtaggtgggagtggactaccgaaaccgttaagaggttggtagaaccacgacgtcctcgtcgactacgaggtaccggttacgaggtcgacggtccaaccgtgtaggtagtggtacgacgaccggccgacgngaccgccgtacacgtagacgtaacctctacgtacgtacggtaagtcgtaggacgacgtaccgggttccttgtcgtcgtgcggtaccgcccgtcgggacggggtaccgggggtacctacggtcgtgacggtaccggg

SEQ ID NO: 121262 - DNA, 791 bp, Homo sapiens
  misc_feature: GYAE6OF01COPS3.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctgggagatcctcttcgttggtggcagcagccacgaggacgcccactctcgaggtgcagctgatcgcagtcggtgggctaggaggtagaggacgccgtagggcctgagtgtacgctcgtcctagacgtaacgtaccgttcgtagaacttacgtacggttaaccgacgttaccttacttaatacgtacgtacggtttagggaccgaccggtaccggtacccggaccccgttaggggaaccgtaacgggttaccgttagggtaagggtacgggtaacgggtacgggtacgttaacgggtacttaaccccggaaaacccgttaaggggtaacggttacgggtactaccggacgtaccgtccgtacgtacggtaacgaccggtaacgggttaccggggttaccggaacgggtaccggtaaccggggtaacgtacccgggtaggtacgggttaagttaccgggaccggtaacccggtacgggacccggaaaccgtcggtacccgtacccgggtactaagtaccggttaaccggtaacgttaccgtacgtcgttacggagtacgtacggtaaccgcgttaccgttacgtttaccgtggtacggcgttaccggccggtacccggtagggacccggggtaccgggtccttaagggtacgccgttaaaggtcccggg

SEQ ID NO: 121263 - DNA, 666 bp, Homo sapiens
  misc_feature: GYAE6OF01B1IHM.41.2.A02.1.454.CMB.1.raw
  modified_base (239)..(239): a, c, t, g, unknown or other
  misc_feature (239)..(239): n is a, c, g, or t
tcagtctatactatcacgaccggtgctcgatttagactcatctacagggggagcatcacccagcaaccacatctgtcctctagagagtcccctgagagctccgttcctcaccatggactggacctgggaggatcctcttcttggtggcagcagccacgaggacgccccactctcgaggtgcagctgatgcagtcggtgggctggaggtggaggagccgtggggcctacgagtgagctcnccgtgacaagtaccttcgaggatacgtacggttaccaacgtacctttactatacgtaaccgacggtgggtacgcgacgtccggacccccgtgggaccgtagggtacttggaggtaggtagtggagtggaactaccgaaccggtaaggtggttacggacgtaaccacggtacgtccctacgcgaaccgacggtaacgggtaccgtaccggaggggtaaccggacgggtaccaccgtaggtcggtcggtagggtaccgacgggtaccggccgaacggacgtccgaacggtacccagtacgtaacgttacctacgtacgtacgaagtaccgtcgagggtacccacgttccggttacctttcgcgtggtcccgcggacccgcccggtagggaccggggtaccgggtcgtacgtacggtccgtagggtccgg

SEQ ID NO: 121264 - DNA, 927 bp, Homo sapiens
  misc_feature: GYAE6OF01DTAZJ.41.2.A02.1.454.CMB.1.raw
  modified_base (168)..(168): a, c, t, g, unknown or other
  misc_feature (168)..(168): n is a, c, g, or t
tcagtctatactatcacgaccggtgctcgatttagactcatctacagggggagcatcacccagcaaccacatctgtcctctagagagtcccctgagagctccgttcctcaccatggactcggacctgggagattcctcttcgttggtgacagcacgccacgagggacnccctactctcgagggtcgacgtagctaggactgacgtcgtcggtggggacttagggaggtacggaaggaacgtcccggttacggggccctagtaggtgaacgtcctttccgtccgtagaccgtaacggtactttcggaacggtactaccgtaggttaccaacgttaccttctaatacgtacgtaggtttcgggactaccggacggtaaccgggtccccgtagggaccggtacggttacgtaggtaaccggtggtaagggtggtaacgtaggaacccgtaccgtaaaccggtaaggcgggtttacgggaacaaccggaccgtaccggtaccgggttaccaacggaccgtaacgggtaaccgggttaccggggttaaccgggtaacgggaccgggtaaccgggtacccgtaaaccgggttaacggttcgggtaaccggggttacgggtacccgggttaacccgggtacccgggaaccccgtaccggaaccgggtaacccggtaacccgggtaccctaaccgggttaacggttaacccgttaaacccggttacccggtaacgttaccggtaacgttaacgggtaccgtaccggggtacgtaacccgggtttaccggttaccgtttacccggttacggtcgggttaccggaacccggttaaccccggtacccgggttacggggttaacccggggggtaacccggttaacccgggggggtttacccttaacgggttacccggtaaaccgggttaaccccggggg

SEQ ID NO: 121265 - DNA, 673 bp, Homo sapiens
  misc_feature: GYAE6OF01D1SRF.41.2.A02.1.454.CMB.1.raw
  modified_base (156)..(156): a, c, t, g, unknown or other
  misc_feature (156)..(156): n is a, c, g, or t
  modified_base (634)..(634): a, c, t, g, unknown or other
  misc_feature (634)..(634): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccanaggagcccactctcaggtgcagcgtgatcgcgtaggtcgtggggtctggagggtggacggagcccgtggggcctacgagtagacgtctcctacctgactaaagtccttcgaggtaactaccgtaggtaccaaaccggttaccttactaacgtaactaaccgtacggttaggggtaccgaccgaaccgtccgggaccccgtagggacggtacgggtacgttggagggttaggagtagggtagtacgtaagtacccgtaaacgtaggtaggtcgtacgaaccacgctccgtacgtagacagtaacgggtccggttaccggagggtaccgtacgggtcctaccggtagtggagtacgggtcgaaccgaccggacgaacgtaccggacgaccgtacaacgagtaacgtaactaccgagttccgtagtaaccgtagacggacgtaacgtccggttccgttattcggtcgtcgacggacgtacncgggtacggtcgggaacggtcctacgtcgtgtaaccggg

SEQ ID NO: 121266 - DNA, 831 bp, Homo sapiens
  misc_feature: GYAE6OF01B86ID.41.2.A02.1.454.CMB.1.raw
  modified_base (164)..(164): a, c, t, g, unknown or other
  misc_feature (164)..(164): n is a, c, g, or t
tcagtctatactatcacgaccggtgctcgatttagactcatctacagggggagcatcacccagcaaccacatctgtcctctagagagtcccctgagagcctccgttcctcaccatggactggacctggagatcctcttcgttggtggcagcagccacgaggacncccactcctcgaggtcgcagtcgtgagttgcgtacgttccggtggggtcgtaggagggtacggaagggaacggtcccggtggggccctcgaggtagacgtcctcgtccgtagaccgaagttcttcggtagtaactacggttacgttaaccgaacgttactttactattaactaccgaacggtttggggacgtccgtaaccggaccggcccgttagggaccggtagggtacttagggagtgggagtagggtagtacggtactaaccgtaaacgtaggtagagggtaccaacgtaccgacgtcccttacggtcgaacgtacggtacgggttacggtaccgggtaacgggtaccggtaacggaccgtaaccgttagtacggggttagtacgggtacccgaacccggaccgggtaccaaccggtaaccggcccgggtaacccgtaccgaaagttaccggttaacccggttaaccgtaccggtttagggttaaccgtacggtttaacgtaccggtacgggtaaaccgggttccccggtttaaaccggggtttccttttaacgggtcggtacggtacccggaccggtaaccccgggtcccggtaaaccgggggttcgggggtaacccccggtcggtttaacggtaccggttccgggtaaaccgggtccggggg

SEQ ID NO: 121267 - DNA, 756 bp, Homo sapiens
  misc_feature: GYAE6OF01B78U9.41.2.A02.1.454.CMB.1.raw
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacgaggacgcccctactctcgaggtgcagctgatgcagtcgtggggctggaggtgaggacgccggtgggcctcgaggtaggagcctcgtccgtagacgaacgtccttacgtaggtaactaccgtacgttacaaccgttccttactaattacacgtacggtgggtcgaccgacgtacccggtcccgtaggacgtaacgggtnttaggnggtaggtagtgggacgtagacgtaaccgtaaacgtaggaggtggacgtacagtcgtcctcgacgtacgaggtacggttacggtaccggacggtaccggtacggtacctaccgttaggtacgtaggggttaccggacggaacccggacccgggaaccgtaccgggaccggtaacccgaccgggtaaccctaacggttacgggtaacccgtaaccgttaaccggtagttacggtaacgtacggttcgtaacgggacggtaaccccgttacgggtttaccctttacgtacggtcggttacccggacccggtacccgggtccccgggtacgggggttaaccgggggaaccccggggttacctacgggttaccgggttaaccggtccgggttacccggg

SEQ ID NO: 121268 - DNA, 739 bp, Homo sapiens
  misc_feature: GYAE6OF01DR8JS.41.2.A02.1.454.CMB.1.raw
  modified_base (385)..(385): a, c, t, g, unknown or other
  misc_feature (385)..(385): n is a, c, g, or t
  modified_base (490)..(490): a, c, t, g, unknown or other
  misc_feature (490)..(490): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttgggtggcagcagccacaggagcccactctcagggtgcagctggactgcaggtcgtggggctgagggtggaggaacgccgtggggcctcgagtgaagtctcgtcctgacaagtacttcgaggaactacgtaggtacaaacgtacgtttactatactaccgtagtgggtcgacgacgccggacccgtggacggtaggacgttaggaggttggagtagggatggtactaaccgtaaaccgtaagggnggttaggtacgaacgaccgtacgtcccgttacgcgtacgaacggaacggtacgggttacccggaggcggtaacggggtccaaccggtaggtggtaagggtcgggngtaaccggacccggaccggtacggaccgcccggttaaccggacccaagtacggtaccgtaaaccgttaccgagttaccagggtacgtacgtcggaaaccggtacccgtacgggtttacccgttttacgttaccgggttcggtacccgggaccgggtccccggaccccgggttaccggggttaaccgggggggaaccgggggttaccccttaaccgggttaaccgggtccgttaaacgggtccccggggg

SEQ ID NO: 121269 - DNA, 883 bp, Homo sapiens
  misc_feature: GYAE6OF01DE1RN.41.2.A02.1.454.CMB.1.raw
tcagtctatactatcacgaccggtgctcgatttagactcatctacagggggagcatcacccagcaaccacatctgtcctctagagagtccccctgagagcctccgttcctccaccatggactggactggaggatcctcttcttggtgcagcagccacgaggacgcccactcctcaggtgcagctgatgcagtcgtgggctaggaggtgagggaacgccgtcggggcctcgtaggtcgaacgtccgttcctccgtcgacaacgtcgttcgtagactaaccggtacggttactaaccgtaccttagtaacttaacgtaacgtacggttggggtcgaccggtaaccggacccggtccccgtagggacggtacgggttacgttagggtaagggtaggtacggtagggtaacgtcgggtaaaccttaacccgtaaaacccgggttaagggtacgggttaagggtaccgaaccgaaccggtaccggttaccctttacggaccggtaaccgtaaaccgggttacgggttaaccggggttaacccggggtaaccggggttaccgggaaccgggtaacccgtaaaccggtaaggtttacggggtaacgggttacggggtaccggaaacccgggccgggaaacccgaccgggttaaccgaccggtaccccggtagaacccgttaggtaaccgttaacccttaacggtaccgttaggtaccgtaggttcgtacggaacggtaccgttacccggtttaacccgttctttaccggcgttaacccgggtacccgaccccgggttaaccccgggtcccgggggtaaacgggggttaacccccggggggtaacttaccccgggttaaaccgggtcgttaaaccccggggttaccggggg

SEQ ID NO: 121270 - DNA, 788 bp, Homo sapiens
  misc_feature: GYAE6OF01B4MHZ.41.2.A02.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggacgcccactctcgaggtgcagctgatcgcagtcgngggctgaggtgaggagcgtgggcctgagtgacgctctcgngacgaagtccttgagtatacgtagttacacgtacttctatactactacgtgggtacgccgaccgaccggtccccgaggaccggagggtacgttacggtaggtcgggtagtacggggtagtcggtaactaacccgtaaaaccgtaaggtacggtttacgggaacgtaaccgaccggtaaccgtacccgttacggtacgtacgaaaccggtaacgggttaccgttaccggggacggggtaccggttaccgggtacccgaaccgttggtaccgggtacgggtaccggttacggaacccgggtaccgaccggtaaccgtacgggacccggtaacccgtacctaacggtacgttaaccggtaacccgttaccgtacgggttactaacgggttacccgtaggtacgggaaccggttaccggtaaccggtttccccgtttagttccgtacggttacccggacccgggaaccccgggttacccgtacgggggttaacccgggggtaacccgggggttaacccttacgggttaacccgggtccgtaaccggggttacccggg

SEQ ID NO: 121271 - DNA, 772 bp, Homo sapiens
  misc_feature: GYAE6OF01CUJ2V.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggagactcctcttcttggtgcagcagccacgaggacgtcccactctcgaggtgcagctgatgacaggtcgtggggctggaggtaggaaggacggtccggtcggggcctaggaggtagaacgtctccgtccgtagaaccgaaagttaccttcggtagtaacgttacgtaacgtttaaccgaacgttacttactaactaacgtaacgtacggtgggtacaccggaacgtaccggcccgtaggaacgtacggtacgttagggagtaggtaggtgggtaactacggaactaaccgaaaccggtaaggtaccggttaggaaccaacgacctacggtcctacggtaacgacgtaacggacgggtaccgtacggaacgggacgtaccggtacaactaggtagcggtagacggaaccgcgacgacgtacgaccggtaccacacggtaacgtaacggtaacctcgtaacgtgtaacggacgttacggaagggtacccgttaaccggtaccggtttacccgttacgtttacggtcgggtaccggtacccggaaaccgggttccccgggttaaaccggggaaccgggggggttaaaccccgggggttacccggttaacggtttacccgggttaaccggtaaggggttacccccggggg

SEQ ID NO: 121272 - DNA, 678 bp, Homo sapiens
  misc_feature: GYAE6OF01EOZ1X.41.2.A02.1.454.CMB.1.raw
  modified_base (416)..(416): a, c, t, g, unknown or other
  misc_feature (416)..(416): n is a, c, g, or t
tcagtctatactatcacgaccggtgctcgatttagactcatctacagggggagcatcacccagcaaccacatctgtcctctagagagtcccctgagagctccgttcctcaccctggactggactggagatcctcttcttggtggcagcagccacgaggagcccactctcaggtgcagctgatcgcagtcgtggggctggaggtgaggaacgccgtcgggcctcgagtgaacgctctaccgtgacgtaacgtaccgttcgtaggacttaacgtaggttaccaacgtacctttctatactacgtacgtgggtcgacgaccgacggccccgtggacgagggtacgttgaggtggagtagggtgtaggacgtaaccaacccgtaaggtacggtaggtcgacacgactccgtacgtggacncgacggtacggtcggacggtcgtacggtaccacgtacggtagtacggtgggtacgacccgtacgggcccgtaaggtaccgaccgtaccgggtacctacgtaacggtacgttaaaccgttaccgtacggtacggtagtacgttcgaggtaccggtacccgtcggttaccgtttaccgttgcggtccgacccggtaaccggcccggtcgggtaacggggacggggtcccttacggtaccgttacggtaggtccggttaccgggg

SEQ ID NO: 121273 - DNA, 715 bp, Homo sapiens
  misc_feature: GYAE6OF01A5TD2.41.2.A02.1.454.CMB.1.raw
tcagtctatactatcacgaccggtgctcgatttagactcatctacagggggagcatcacccagcaaccacatctgtcctctagagacgtcccctgagagctccgttcctcaccatggactggacctgggaggactcctcttcttgggtggcagcacgccacgaggacgcccctactcgtcgagggtgcagtctcgatcgcgtgtcggtggggctggagggtggaaggacggtccggtcggggtcctcgaggtcgacggtctctccgtgacaagtcgttcgtaggacttacgtaggtacaacgtacttactatactacgtcgtgggtcaccgacgccggccgtggacgaggtacgtgaggttggagtacgggagtacggaactaaccgtaaacggaaggtacgttacggtacgaacgtacgtaccgtcctagtcgaacacggtaagggtccggtacggacgggacgtacgggtacctagtacggtagggtacggtcggacggaccgaccgtacggaacccgcggtacccggtacggaacgtaacgttaacgggtaacgtaaccgttaccgacgggttcgtaaccgtcggtacgaggtaaccggtaccggttaccggttaccgtttacgtcggttcgtaccgggccgtaacccgggcccggtggggtaaacccggggtacccggggtactacggtaccgggtagtccggtacccggg

SEQ ID NO: 121274 - DNA, 755 bp, Homo sapiens
  misc_feature: GYAE6OF01CM0I8.41.2.A02.1.454.CMB.1.raw
  modified_base (157)..(157): a, c, t, g, unknown or other
  misc_feature (157)..(157): n is a, c, g, or t
  modified_base (178)..(178): a, c, t, g, unknown or other
  misc_feature (178)..(178): n is a, c, g, or t
  modified_base (662)..(662): a, c, t, g, unknown or other
  misc_feature (662)..(662): n is a, c, g, or t
tcagtctatactatcacgaccggtgctcgatttagactcatctacagggggagcatcacccagcaaccacatctgtcctctagagagtcccctgagagcctccgttcctcaccatggactggacctggaggatcctcttcttagtggcagcagccanaggacgcccactctcgaggtncagctgatcgcagtcgtgggctggaggtaggaggacgccgtggggcctagagtcgaacgtctctcctgactaacgtacttcgtaggatacgtaggttacacgtacttctataactactacggtcggtcgaccggaccgtccggacccgtaggacgtacgggtacgttagggacggtggtaggtgggtagtacgggaccttaaacgtaaacccggtaaggtacggacgggttacgaacgtacggtaaccgtccgtacgtacggaccgtaaaccggtaagggtacccgggttacgggaacgggtacggtaaccggggtaccaaccggttagacgggtaaggtacgggtacgaaccgggtaaccggacccgtacggacgccggaaccgtacaaccgtacggtaacccgtaacttacccgtaacggtacgtaacggtacgtcggtacggaaccggtaccggtaaccggtttaccgtttacgttaccgnggttaacccggccggtacccgggtaccccggacgggtaccggggtaaccggggttaccgttaacggtaaccggtacgggtaccggtacccggg

SEQ ID NO: 121275 - DNA, 662 bp, Homo sapiens
  misc_feature: GYAE6OF01AQ72K.41.2.A02.1.454.CMB.1.raw
  modified_base (293)..(293): a, c, t, g, unknown or other
  misc_feature (293)..(293): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtgggctgaggtgaggagccgtgggcctcgagtgacgtctcctcctgacaagactttcgtggactacgtaggttcaacgtacttctatactactacgtgggtcncgaccacggccccgtggacgagggacttcgagtggagtagggatcggactaccaaaccctaaggacgtcgggtagacgacgagtcccgtgtcgactacgacggacgggttaccgagggaccgtacgggtaccaccgtagtaggtaggtcggtacgtaccgaccgggtacccgacgacggaccgacccggtaccgaacgtaacgtaccggtaaaccttaccgtagttaccgtaggtaacggtcgtacggaacggtaccgaccgggttaccgtttacgttccgtcggtaccgggacggtaccggtacccccggtgggtaccggggtaacccgggggtctaaccgggttccggtacggtacggtacccgggg

SEQ ID NO: 121276 - DNA, 647 bp, Homo sapiens
  misc_feature: GYAE6OF01C5SF8.41.2.A02.1.454.CMB.1.raw
  modified_base (164)..(164): a, c, t, g, unknown or other
  misc_feature (164)..(164): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (458)..(458): a, c, t, g, unknown or other
  misc_feature (458)..(458): n is a, c, g, or t
  modified_base (475)..(475): a, c, t, g, unknown or other
  misc_feature (475)..(475): n is a, c, g, or t
  modified_base (542)..(542): a, c, t, g, unknown or other
  misc_feature (542)..(542): n is a, c, g, or t
  modified_base (597)..(597): a, c, t, g, unknown or other
  misc_feature (597)..(597): n is a, c, g, or t
tcagtctatactatcacgaccggtgctcgatttagactcatctacagggggagcatcacccagcaaccacatctgtcctctagagagtccccctgagagctccgttcctcaccatggactggacctgggagactcctcttcttggtggcagcagccagaggacncccatcgtcaggtncagntgatgctaggtcggtcggggtctaggagggtggaacgggtacggtcccggtggggccctacggaggttcgaacgtcctacgtcaggacctagttacctgaggtacctacgtacggtaactaaccgtcttacgtaatcttaacgcgttgggaccgaccgaccgccggtcccgtaggacggtagttcgtaggaggttggagtcgggtataccggaactaccggaacgtaggtcggtacgacactcgacgtctagacgactacggaggtccggtacggngacggtacgcctaaggngtacgggtagccggacaccgccggtacgaccgacgtaccgactcgaatcgggaactaccgtagtcgngtaacgctagcgtaaccgtcgttacggttcctagtcgcgtcccgcggttacccgnggggaccggtaccggggacggttcctaagggtctcgggcggtacccgggg

SEQ ID NO: 121277 - DNA, 789 bp, Homo sapiens
  misc_feature: GYAE6OF01BWOH1.41.2.A02.1.454.CMB.1.raw
  modified_base (578)..(578): a, c, t, g, unknown or other
  misc_feature (578)..(578): n is a, c, g, or t
  modified_base (775)..(775): a, c, t, g, unknown or other
  misc_feature (775)..(775): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccaacgacggacgccccactcctcgaggtcgcagctgatgctaggtcggtggggctggaggtaggaggacgcggtcgggcctcgagtgacgtctcgtccgtagactaagtccttgacggtaacttaacggtacggttaaccaaacggttacctttactaacttaacgttaccgtacgggttggggaccgtaaccggaccgtacccgggtaccccgtaggggaaccggtaacggggttccgttaagggagggttacggggtaagggttacggggtaagttaccggaaccgttaaacccggtaaaaccgggttaaagggtacggggttaacgggtaacgaaaccgtaaccggtccgttcccgtttaacggacgtaaccgaaacgtacgggttaaccggttacccggagggtaaccggtacggtaaccncgttaaggtacgggacgggttagaccgaaccggtcgaacccggaacgtcgaacccgtaccgtacaacgtaggtaaccgtaaccttcggtagtacgtaggacgtcggacgacggtccttaccggttcgttacttcgggcgtcggacccggccggtacccgggtagggacggggtaaccggacccttaggtaacccggngggtacgtccgggg

SEQ ID NO: 121278 - DNA, 730 bp, Homo sapiens
  misc_feature: GYAE6OF01AT54E.41.2.A02.1.454.CMB.1.raw
  modified_base (451)..(451): a, c, t, g, unknown or other
  misc_feature (451)..(451): n is a, c, g, or t
tcagtctatactatcacgaccggtgctcgatttagactcatctacagggggagcatcacccagcaaccacatctgtcctctagagacgtcccctgagagcctcccgttcctcaccatggactggacctggaggatcctcttcttggtggcagcagccacgaggacgcccactctcgaggtcgcagctgatgcgagtcgtgggctggaggtgaggacgccggtcgggcctcgagtagacgcctctccgtgacacgtcttcgtagactacgtacgttacgaacttacttactatacacgtcggtggacgacgacgccggtccgtaggaccgagggttacgtaggaggtcggtaggtggacaggtaactaccgaaacgtaggtacgtggtacgactacgcgtcctagtcgacacggtacggtacggtcggacggaggtaccggtacacggttancgggtacgtacgggtacggaccggccggtacgaaccggcgtacccgtaaccggacgtaaccgtacggtaacgtaacccttaccggaggtttcgaacggttacgggtaccgtaaggggtacccgtaaccggttcccgggtttaacctttccggtttacggcccggttacccggaccgggtaaccccccggggtaccgggtacgggggttaaaccccggggggaccccggggttacccctaaacgggttccggggtaaccggtaacggggttaccccgggg

SEQ ID NO: 121279 - DNA, 850 bp, Homo sapiens
  misc_feature: GYAE6OF01CWJBP.41.2.A02.1.454.CMB.1.raw
  modified_base (259)..(259): a, c, t, g, unknown or other
  misc_feature (259)..(259): n is a, c, g, or t
tcagtctatactatcacgaccggtgctcgatttagactcatctacagggggagcatcaccagcaaccacatctgtcctctagagagtcccctgagagctccgttcctcaccatggactggacctggaggatcctcttcttggtggcagcaggccacaggacgcccactctcaggtgcagctgactgcaggtcgtgggctgaggtgagaagcgtggggctcgagtacgaagctcgtccgtagactaacggtacttaccgnggattacgtacggttacaacgtacttacgtaatactaaccagtcggggtacaccgacgccggccccgttaggacgttacgggtacttacggtacggtaggacgtcgggaagttgggaacttaccgtaaacccggttaaggaacggtcggtacgtaaccgacgtacggtaccccttggtaaccggataaccgtaagggtacggggtttacccgaacgggggttaccggaacgggtttacgaaccccgttaggttaacggtacggggtttaaacgggacgtacccggaacggggttacccaacgggaaccggtccggtaccggaccctaacgacggtttaaaccggaacccgtttaaccgaacggttccggtaaggtaaccggttacccgtcgggtaaaccggggaaccccgtttacggggttacccctttttaacgggtccgtttaaacggggttcgtaacccggggttaacccggtaaccccgggggtttaaccggggttaaccggggggggtaaaaccccccggggggttaccgtttaaaccccgggtttacggggttaaaaccccgttacccggggggtaaaccccggg

SEQ ID NO: 121280 - DNA, 1002 bp, Homo sapiens
  misc_feature: GYAE6OF01BJK8G.41.2.A02.1.454.CMB.1.raw
  modified_base (222)..(222): a, c, t, g, unknown or other
  misc_feature (222)..(222): n is a, c, g, or t
  modified_base (261)..(261): a, c, t, g, unknown or other
  misc_feature (261)..(261): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcagcgtgggctggaggtgaggaacgccgtggggcctnacggtagaagcctcttccgtgacgaacgtaccgtttcgngggtacttaaacggtcgggtttaccaaaccggtactttactaataattaacccgtacggttgggtacgaccggtaacgtacgggtccccgttaggaaccgtaaggggtacctttagggacggttagggtaacgtggggtaacttaggggaacctttaaccgtaaaacccgttaaagggtcggttcgggtaaaccgtaacccgtaacggtaaccggtcccgtttaccgtacgggaaacccgaaccggtaacgggtttaacccggggtttaccccgggaacgggggttacccggtaaaccgggggttaacccgtaacccgggttaaagggttaacgggttaacggggtttaaccggggttaaccggtaaaccccgggaccggggtaaccccttaaacccgggggaacggtaacccccggtaaccggggtacccctaaaccgggttaccggttaaacccggggttaaacccgtttaaccccggaaacggttacccgggttaaaccgggtaacggtttaacccggtacgggttaaaccgggtaaccccgggttaacccggggtttaccccggttttttaacccgggttaccggtttaacccggggttacggtaaccccggggtaaacccggttacccccggggttaaccggggtttaaacccgggggggtaacccccgggggggtaccctttaaacccgggggttaaaccccgggttccggttaaccgggggttaaaccccgggg

SEQ ID NO: 121281 - DNA, 805 bp, Homo sapiens
  misc_feature: GYAE6OF01DM2DW.41.2.A02.1.454.CMB.1.raw
  modified_base (199)..(199): a, c, t, g, unknown or other
  misc_feature (199)..(199): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttgggtggcagcagccacgaggacgcccactctcaggtcgcgagctgatgcgtagtcggnggggctggaggtggaaggaacgtccggtcgggtcctacgaggtacgacgtccgtcctccgtagacctaacgtacgttcgtagtactacggtacggtacaacgtacttactatactacgtaggtgggtagccgacgcggtcccgtgacggaggtcgtaggaggtacggtagtgggtataggtacaacccgtaaaccgtaaggtacggtcgggtacgaacgtcgtaaccgccgttacgtcgaacgtacggtaacggtaccgggtacgggaacgggaccgggtacgggtaccgaaaccgtacggtacgggtacggttacgggtacccggtaaccggtacccgggaccggaccgggtaccgtacccgggtaacccggtacccgtaacggttacggtaaccggtttaaccctaaccggttacggttacggtacggtaacggttacgtacgggtaacgggtaaccggttccggtttaaccgtttcgttaccggttacggaccgggttaccggaaacccgggtcccggggtaacggggtaccggggggggtaacccgggttaacccggtttaccgggtaaccgggttaccggttaccgggttaacccgggggg

SEQ ID NO: 121282 - DNA, 743 bp, Homo sapiens
  misc_feature: GYAE6OF01B4YLK.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcgttggtggcagcacgccacgacgggacgcccctactccgtcgagggtgcagctgatcgcgtagtcggtggggtctaggaggtaggaagggacgtccggtcggggtccctagtaggtcgaacgtccttaccgtccgtagtacgtaaacgtccgttacgtagtaacttaacgtacgttaccgaaccgtaactttctaatactaacgacggttcgggacgaccgaacggaccggtccccggtaggacgtacggggttacttacgggaggtgggtagtaggtacgaggtaacctacgtaaaccgtaggtaggtagtacgacgtactcgtcctagacgtccaaggtacgggtacggtaccggagggtacgtaccggtacacgtaggtagagggtacggacgaccgtacggaccgaagaccgtccgtaaccggactaagacgtaaccgtactaacgtcgttaggataaccgtgtaacggaaccggtacccgttaggtttccccgtttaagtccggttacgggaccgttacccggaccccgggtacccgggtgggaacccggggggtaccggttaccctaaccggggtccggtaccggtgggtcccccggg

SEQ ID NO: 121283 - DNA, 744 bp, Homo sapiens
  misc_feature: GYAE6OF01C6CVD.41.2.A02.1.454.CMB.1.raw
  modified_base (130)..(130): a, c, t, g, unknown or other
  misc_feature (130)..(130): n is a, c, g, or t
  modified_base (589)..(589): a, c, t, g, unknown or other
  misc_feature (589)..(589): n is a, c, g, or t
tcagtctatactatcacgaccggtgctcgatttagactcatctacagggggagcatcacccagcaaccacatctgtcctctagagagtcccctgagagctccgttcctcaccatggactggactggaggntcctcttcgttggtggcagcagccacgaggacgccccactctcgaggtcgcagtctgatcgcaggtcggtgggctaggaggtaggaggacgccggtcggggcctgagtagacgcctcgtccgtagactacgtccgttagtagtaactacgtacggttaaccaaccgttacctttactactaacgtaccgtagggttcggtaccgaccgtaccggaccgggtacccccggtaggggaacggtacggggttacttaggggtaaggtgggtacggtaggggtatacggtaacctaacccggtaaaccggtaagggtggttacggaacacgtaccgtacggtccctacgtgacccgtacggacgggttacggtaccggaggggtccgtaacgggcctaacggaaggtggtaacgggtacgaccggaccgaccggcctaacgggcgtacccgtaacggtaaccnggttaacggtaaccgtaactaccggacgttagacgaacgtgtaggaccgtaccgttacgttccgttacctggcggtacccgcgtacccggggtaccccggtgggggtaacccggggtaacccgggtaccttgggtacccgtggtacccgggcggg

SEQ ID NO: 121284 - DNA, 746 bp, Homo sapiens
  misc_feature: GYAE6OF01DURPX.41.2.A02.1.454.CMB.1.raw
  modified_base (178)..(178): a, c, t, g, unknown or other
  misc_feature (178)..(178): n is a, c, g, or t
  modified_base (680)..(680): a, c, t, g, unknown or other
  misc_feature (680)..(680): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtgcagcagcccacgaggacgcccactctcgaggtncagctgatgcagtcgtgggctgaggtgaggacgccgtgggcctcgaggtagaagtcctcgtccgtagacgaacgtcttcgtagtactacgtacgttacaacgtaccttacgtactatacgtacggtcgggtacgaccgacgaccggtccccgtaggacgagggttacttaggtaggtaggaggtacggtagtacggtactaacccgtaaaccggtaaggtaggttacggtaacgtacgaccgtaccgtccgttacgtcggaactacgtaagggtaccggttaccggacgggtaccggtacggtacaccggtaagcggtagggtacggtaccgacgtacccgggaccgacgacgtacccggtaccgaaccgtacgacgttacggtaaacccgttgaacgttacgtaacggtaccgttagcggtaaccggtaccggttacccggtttaaccgtttgtaccgggttacggttcccggaaaccggtcccgggttaaacccccgggngggggtaaccccggggggtaccggggtaaccttacccgggtggttaccggtaccgggttaccgggg

SEQ ID NO: 121285 - DNA, 854 bp, Homo sapiens
  misc_feature: GYAE6OF01END3G.41.2.A02.1.454.CMB.1.raw
  modified_base (163)..(163): a, c, t, g, unknown or other
  misc_feature (163)..(163): n is a, c, g, or t
  modified_base (182)..(182): a, c, t, g, unknown or other
  misc_feature (182)..(182): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtgtcagcagccacgaggacnccctactcctacgaggtcncagtcgtagacgttgacgtggtcggtggggcgttgggtagggtggaacggaaccggtccggttccggggtcctacgaggtacggtacgtccttacccgtccgtacggaccttaaacgtaccgtttacggtacggtaaacctttaacggtacgttaaccgtaaccggtttaaccttttacgtaaacttaacgttaaccggtcggttagggggtaccgggtaccggaaccggtaccccggtaccccgggtagggtaaaccggttagggtaaccgtttggtaagggtaggtacggtaagggtcggtacgtaaacccgtaaccgttaaaacccggtaggggtaacgtacggggttaccaaaccggtacctacgtacccgttcgtacgaaccggtaacgtacgggttacccggttaacggacgggtacccggtacgtaccgtaacggtacgacggtacggttaggaccggtaacgccggaaccgaacgacggtacgacccgtacgtacgtacgtaaccgtaaccgtacgtacgtaacggtacgtacgtacgacggtacgtaacccgttacggttacctttagtcgtacggaccgtacggaccccggttaccgggacgggttaacccggggggtaccgttacccgtagggtacccggtccggtaacggtacccggggg

SEQ ID NO: 121286 - DNA, 835 bp, Homo sapiens
  misc_feature: GYAE6OF01E2DVZ.41.2.A02.1.454.CMB.1.raw
tcagtctatactatcacgaccggtgctcgatttagactcatctacagggggagcatcacccagcaaccacatctgtcctctagagagtcccctgagagcctccgttcctcaccagtggactggacctggaggtacttcctctttcgttggtcggcagcacgccaacgaggacgccctactctcgaggtcgcgagtcgtgagtcgacgtagtcggtgggcgtggaggtaggaacggtacggtccggtcgggtcctacgagtacgacgtcctccgtaccgtgactaacgtacgttcgtagtaactacgtacgtacgtaacgttacttactactacgtacgtacggtcgggacgaccgtaccgtaccggtcccggtaggtacggtacgggtacgtaggtacggtaggtaggtaggtagtacggtaacgtaaccgtaacgtaaggtcgtacggacgacgacgtacgtaccgtcgacgacgtaacggtacggtacggtacggacgggtacgtacgaccgtaacgtagggtacggtacggtacggaccgaacggcccggaaccgtaccggccgtaacccggtaccggtacccaacggttaccgtaaaccggtaccttacgggtaccttacggtacgtaaccgtcgggtaacggtacccgggtaaccggttttaccggtttaccccgtttcggtttacgggtacgggtaacccgggaaccccggggttccccccgggaacccgggggtttaacgggggggtaacccccggggggttaaacccggggtttaccccttaaacccggggttcggtttaacccggggtacggggttcccccggggg

SEQ ID NO: 121287 - DNA, 822 bp, Homo sapiens
  misc_feature: GYAE6OF01AIP0H.41.2.A02.1.454.CMB.1.raw
  modified_base (180)..(180): a, c, t, g, unknown or other
  misc_feature (180)..(180): n is a, c, g, or t
tcagtctatactatcacgaccggtgctcgatttagactcatctacaggggagcatcacccagcaaccacatctgtcctctagagagtcccctgagagctccgttcctcaccatggactggacctggaggatcctcgttcgttggtgcgagcagccacgaggacgcccactcgtcgaggtncgacgctgcgtgccgtagtcggtcgggtcgttaggaggtggaacggtaacggccgttcggggccttacgaggttacgacgtctccgcgttacgacgtaagtaccgttcggtaggtaacgtaccgtaggttaaccgaacgttaccgttactaagtaacgtaaccggtagtacggggtaccgaccggttaacccgccgggtacccgttaacgggaccggtaacgggtacgttacgggtaacggtacgggttagtaaccggggtaagtacggtaacccggtttaaacccgaaacccgggttaacgggttaagggtacggtaaccgtaaaacccgccggttacggtaccgtttcccgaagtacccgtaaacgtacgggtaaccggttaccggaacgggtacggacggtaaccgtaccgtaaggtacgagggtttacgaacgggtaccgaccggtaacggtaccggacgtccgtacccgggaacgtaaccggaccgttacggtaacgtacccggtagttaccgttaggtaaaccgtcgtacggacggttcgtacggttccgttagtcggtcgtacgtacggtacccgggtaccggtagggtacccgggtaccgggacgttaccggtacgtacgggttacgtaccggg

SEQ ID NO: 121288 - DNA, 690 bp, Homo sapiens
  misc_feature: GYAE6OF01B7R8A.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggagcccactctcaggtgcagctgatgcagtcgtggggctggaggtgaggaacgccgtggggcctcgagtgaagctactcctgacaagtacttcgtaggtatacgtaggttacgaaacgtacctttactagtaactacgtacgttggggtcgaccgtaccgaccgggccccgtagggaccgtagggtacgtttaggaggttaggacgtggggatacggtataccgtaaaccgtaaggtaggtagggtaacgtacgaacgtacgtcccgtcgtagaccacgtaggtacggttaccggacgggacggtaacgggtaccaacgtagtaggtagtcgggtacgacgaccggacgacggacgtacgaccgtaccaacgtacgtacggtaaaccttaccgtacgttacgtaggtacgtcgtaggaacggtaccgtaccggttccgtttacgttcggtggtcggaccggtacccggacccggtagggtaccggggtaccgggggtacccttaaccgggtcggttccggtacggtaccggg

SEQ ID NO: 121289 - DNA, 672 bp, Homo sapiens
  misc_feature: GYAE6OF01AGDGK.41.2.A02.1.454.CMB.1.raw
  modified_base (249)..(249): a, c, t, g, unknown or other
  misc_feature (249)..(249): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcagccacgaggacgcccactctcaggtgcagctgatgcagtcgtgggctggaggtgacggacgccgtgggcctcgagtgacgctctctgacaagtcttcgngtactacgtagttacaacgtacttcgtaatactacgacggtgggtcgaccgtaccgaccggtccccgtagggaaccgtacgggtacttagggaggtagggtacggttagggtaacgtacgggaaactttaacccgaaaaccggttaagggtaacggtacggtacgaaaccgtaacgtaaccggtcccttagacgtaccgtaacgtacggtaccggttaccggacgggtaccgtacgggtaccacgtagtacggtaggtacggacgaccggtaccggaccgtacggacgaccggtacgtacacgtacgtacgtaactcgtagtcgtacgacgttagagacggacgtacgttccgttagtcgtcgacgtaccggccgacccgggtggacggggtacccgggtactaccggtcgtcgcgggtacgg

SEQ ID NO: 121290 - DNA, 699 bp, Homo sapiens
  misc_feature: GYAE6OF01AQLD2.41.2.A02.1.454.CMB.1.raw
  modified_base (191)..(191): a, c, t, g, unknown or other
  misc_feature (191)..(191): n is a, c, g, or t
  modified_base (289)..(289): a, c, t, g, unknown or other
  misc_feature (289)..(289): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacgaggagcccactctcaggtgcagctgatgcagtcnggggctgaggtggaggaagccgtggggcctcgagtgaagctctcctgcaagacttcgtgatacgaggttcaacgtacttctatataactacgtgggtntcgacgtacggccccgtgggtaaccgagggtaccttggacggtggagtgggacgtgggaactaccgaaacccgtaaggtaggttaggacgaacgaacgacggtacccttcgttacgaccgaacgtacggtaaccgggttcccggaacggggaccgaacgggggtcctaacccgtaagtcggtaacggtggggtacgacccgacccggaccgaccgggagtaccgaccgggttaccaaccgtagtaacggtaacccttacgacggttacgagtacgtcgtaggacgtacgtccgtaccgtttacgtcgttcggtaggaccggtaacccgcccgggtacccgtaacgggggggtaacccgggggttaccccgtaacccgggttaacggtttcccggtacggtaaccccgggg

SEQ ID NO: 121291 - DNA, 758 bp, Homo sapiens
  misc_feature: GYAE6OF01EG2NX.41.2.A02.1.454.CMB.1.raw
tcagtctatactatcacgaccggtgctcgatttagactcatctacagggggagcatcacccagcaaccacatctgtcctctagagagtcccctgagagctccgttcctcaccagtggactggacctgggaggactcctcttcgttggtggcagcagccacgaggacgcccactctcgaggtgcagctagatgcgtaggtcggtgggctggagggtaggaaggacgtccggtcgggcctcgtaggtagaacgtccttcctccgtagacgaacgtacgttcgtacgtaagtaccgtacggttaacgtaaccgttaacgttacttaagtaactaacgtacggtaggggtcggtaccggaccggaccggttttttacccggacggaccggtacgggttacggttaggtagggtaggtagggtagggtacggtacggtaacgtaaccgtaaaccggtaacggtaggtacggtacgacgtacgacgtaccgtcgtacgaccgacggtacgggtacgggttaccggacgggaccggtacgggtaccgtaacgtacggtacgggtagggtcggtacggacggaccgaccggaccggacgaccggaccggtacacgtacgtacgtaaccgtacgtacgtacgtagtacgtacgtacggtacggtaccgtaccggttaccgttacgttcgtcggtacggaccggacccggtacccggtcgggtaccggggtaccgggtacggtaccggtacggtcggcggtaccgggg

SEQ ID NO: 121292 - DNA, 809 bp, Homo sapiens
  misc_feature: GYAE6OF01A8HHE.41.2.A02.1.454.CMB.1.raw
tcagtctatactatcacgaccggtgctcgatttagactcatctacagggggagcatcacccagcaaccacatctgtcctctagagagtcccctgagacgctccgttcctcaccatggactggacctggaggactcctcttcttgggtggcagcgagcccagaggacgcccactctcaggtcgcagctgatgcgtaggtcgtcggggactggagggtggaggaacggccggtcggggcctacgaggtacgtaacggcttaccgtccgtacggacgtaacggtaccgtttacgacggtaacgtaaccggtaaggttacctaaacgttactttaacctaagttaacgtaaccgacggttacggggtacgaccggtaaccgaccgggttaccccgtaggaacgggtacgggtaccgttagggtagggtaggtaggtgggtagtacggaaaccgttaccgtaaacccgttaaggaggttgggtaacaacgtacgacgtaccgttcgtacgacgtaacggaacggttaccgggttacgagggtaccggacgtaccgtaaccgtaaggtacgggtaaggtacgggacgaaccggtaacgggacccgaacgggtaccggaccccgtaacggtaccgaacgttacggtaacgggttaacctaaccggtaggttaccgtaggtaccggtactacgggacggtaaccggttccggttacgtttcccgtacggtacgtacggaccggtaccccggacggtacgggtaacccgggggaccggggtacccttaaacgggccggttacggtacgggtacccggg

SEQ ID NO: 121293 - DNA, 723 bp, Homo sapiens
  misc_feature: GYAE6OF01BN1JM.41.2.A02.1.454.CMB.1.raw
  modified_base (136)..(136): a, c, t, g, unknown or other
  misc_feature (136)..(136): n is a, c, g, or t
tcagtctatactatcacgaccggtgctcgatttagactcatctacagggggagcatcacccagcaaccacatctgtcctctagagagttccctgagagctccgttcctcaccatggactggacctggaggatcctnttcttggtggcagcagccacgaggacgcccactctcaggtgacagctgatcgcagtcgtggggctggaggtagaggacgtccggtcgggcctacgaggtagaacgctcctctcgatacgtacttcgtaggtactacgtacggttacaacgtacttactaacttacacgttacggtacgggtacgacggacccgaccgggtaccccgtagggaccgtaacgggttacgttacggtaagggtcgggtacggtagggtaacgttacggggtaaacttaacccggtaaacccgtaagggtaggtaacggttaacgaacccgtacgtaacgtcccgtactacggaccaacggtaccgggtacgggttaccgacggggtaccggtacgggtacctacgtaaggtcggacggttacgtacggacgtaccggaccgacggtacgccgtaccggaccagtacgtaacgtaactccgatcgagtacgtcgtacggacggtaccttccggttacggttccttacggtcgtaccgtacggacccgtcccggacgggtacgggacggggtaccttaccgggtacgtcgtcgggtaccggg

SEQ ID NO: 121294 - DNA, 745 bp, Homo sapiens
  misc_feature: GYAE6OF01C0PJX.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatccttcttcgttggtggcagcaggccaacgaggacgccccactctcgagggtgacgagtctggatcggctaggtcggtggggctgggagggtaggagggaacggccggtggggcctgaggtagagtcctctctagacagtaccttgtaggtatacgtacggtaccaacgttacttactataactactacgggttggacgacgtaccgacggtcccgtaggacggacggtacgttagggaggtaggggtacgtaggggtacgtacggtaacgtaaaccgtaaaccggtaaggggtacgggtttacggggaacaaaccggtacgaccgttcccgtacgtaccgacggtaacggtacgggtacgggtaccgggacgggtacggttacggacccgtaaggacggtggtacggtacgggtacgacgtacccggacgaccggtacgacgtaaccgacacgcgtaaccgtaacgtcgagtacgtagtacgtagtacggacgtacggttccgttacccgttagttccggtacgtaccggaccgtaaccggggcccggttacggggaacccggggggacccggtttacggaccggttacccgggtggtaacccggtccggggg

SEQ ID NO: 121295 - DNA, 636 bp, Homo sapiens
  misc_feature: GYAE6OF01AILNO.41.2.A02.1.454.CMB.1.raw
  modified_base (163)..(163): a, c, t, g, unknown or other
  misc_feature (163)..(163): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccagaggacnccccactctcgaggtgcagctgatgcagtcgtgggctaggaggtgaggacgcgtgggcctgagtagacgtctctcgtagactaacgtcttcgaggtactacgtaggttaccaacgtacgttctaagtactacgacggttcgggtacaccgaaccgaccgggcccgttagggacgtaacgggtcgttggacggttggacgtgggtatcggaactaacccgtaaaccgtaaggagtggacctaccgacgtacggcctcgtacggactaggacgggtaccggtcgacgggtaccgtacgggtccacgagtacggtagtcggtacgacgccgacgacgtacgccgaccgtcaacgacgtacgtaaccttacgactacgagtactcgagaacggtccgacggttcttcgacggtcgtacgccgtaccggtccgacgggtacgggtacccggtaccttaacggcggtagtcggtacggg

SEQ ID NO: 121296 - DNA, 883 bp, Homo sapiens
  misc_feature: GYAE6OF01CUJV9.41.2.A02.1.454.CMB.1.raw
  modified_base (163)..(163): a, c, t, g, unknown or other
  misc_feature (163)..(163): n is a, c, g, or t
  modified_base (178)..(178): a, c, t, g, unknown or other
  misc_feature (178)..(178): n is a, c, g, or t
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
tcagtctatactatcacgaccggtgctcgatttagactcatctacagggggagcatcacccagcaaccacatctgtcctctagagagtcccctgagagctccgttcctcaccatggactggacctggacggatcctcttcttggtggcagcaggcccacaggngcccactctcaggtnacagctgatgcngtcgngggctgngtgaggagcgtgggctnagtgacgtctctctgacaagtaccttcgnggtaactacgtacggtaccaacggtacctttagtattactaccgacgttcgggtgaccgacgaccggtccctagggacgagggtaccgttgagggtgaggttacgggatagggactaccgaacccttagggacgttacggtcgtaaccgaacgtcgtaccgtacgtacggccgaccgtaacgggtaacggtttcccggaacggggtaccggtaaccgggggttacccaaaccggtacggttaaggaccgggtttaacgggttaccggaacccgggtaacccggggtacccgtaaaccggggaacggttacccggtaaaccccgggtaccccggttaaaccgtaaccgggtttaaccgggtaaaaccccgttttaccccggtaaacgggtttacccggtacggttaaaacccggggttccgttaaacggggtaacccggggttaaccggtaaaccccggggtttaaaccccgttttcccgggtttaaccgtttacccgggtacgggtaaccccggtcccggggttaaacccccggtaccgggggttaccccggggggtaaacccgggggggttaccccttaaacccgggggttttaacccggggttacccgttaccggggtttaaacccccggggg

SEQ ID NO: 121297 - DNA, 770 bp, Homo sapiens
  misc_feature: GYAE6OF01A44F9.41.2.A02.1.454.CMB.1.raw
  modified_base (448)..(448): a, c, t, g, unknown or other
  misc_feature (448)..(448): n is a, c, g, or t
tcagtctatactatcacgaccggtgctcgatttagactcatctacgagggggagcatcacccagcaaccacatctgtcctctagagacgtcccctgagagcctcccgttcctcaccagtggactggaccgtggaggactccttctttcgttgggtggcaggcacgacccacgaggacgccccacttctcgtaggtcgcagctagatcggactacggtcggtaggggcctagggacgggtaggaacgggtacggtccgggttcggggaccctacgtagggtacggaacgtccgttccgtaccgtacgaccgtaagtaccttcggaggtaactagtacggtacctacgtactttactaatatcgtaggtggcgacgacgccgcccggaggacggtagtgtaggtcggtagtagtggtagtcggaacctacgtaacgtaggtcgtacgganaaccgacgtagacccgtgtacgacgacggtacgtacgggtaccgagggtacgtacggactacgtagtggaacggttacgacgtaccgaccgtaccgcggaccgtccgaacccggtacgtaaccgtacggtaaccggttaacctcgggtacgtactacggtaaagcccggtaagtacccggtaccggttacggtttacccgttacggttcggacgggttcccgacccgggtaaccgggtacccgggggttagggaaaccccgggggttaccccgggttacgacccggggtttaaccggtcccggttaacccggggtcccgggg

SEQ ID NO: 121298 - DNA, 827 bp, Homo sapiens
  misc_feature: GYAE6OF01BUJRP.41.2.A02.1.454.CMB.1.raw
  modified_base (243)..(243): a, c, t, g, unknown or other
  misc_feature (243)..(243): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (388)..(388): a, c, t, g, unknown or other
  misc_feature (388)..(388): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcttggtggcagcagccacgaggagccccactctcgaggtgcagctgatgcagtcgtggggctggacggtggaaggagccgtgggcctcgagtgaagtctcgtccgngacaagtccttcgtaggactacgtaggttaccaacgtactttccgtaatactaacncggtgggtcncgacgtaccggccgtggacgtagggacttggacggtggagtggactacgacgtaacccgaaaccgtaggtagtggaacncgactaccgtctacgtcggaccaagtaccggtacggttccggaacggggtaccgtacgggtaacctaccgtaagtacgggtacgggtacgggtaaccggaccggtaacccgggacccgaaacggtacccggtaccccggtaaaccggtaccccgtaagtaaccgggtaaacggtttaaacccccggtttaaccgacccggttttaccggacggtttaaaaacccgggtcgtttaaaccggggaaccgggtaaccccgtacccggggttttttaacccgttttaaacctacccggggtttaggtacccgggtaacccgggtacccccccgggttaaccccgggtccggggggggttaaaccccgggggtaaccccgggggttaaccggtttaacccgtacccggggggtttaaccttaacccggggttaaccccgggggg

SEQ ID NO: 121299 - DNA, 817 bp, Homo sapiens
  misc_feature: GYAE6OF01EPVLG.41.2.A02.1.454.CMB.1.raw
tcagtctatactatcacgaccggtgctcgatttagactcatctacagggggagcatcacccagcaaccacatctgtcctctagagacgtcccctgagagctccgttcctcaccatggactggacctggaggatcctctttcttgggtggcagcacgccacgaggacgcccactctcgaggtgcagctgatgcgagtcggtgggctggacggtaggacggagtccggtcgggcctacgaggtgaacgtctaccgtcgacgagaacgtaccttcggtaggtaactaacggttaacggttaaccgtaaccgttacttacttaacttacgttaaccgtacgggtcggggtacgaccggaaccggtcccgggtcccggtaacggacgggtaacggttacggttacgggtagggtaggtaacgggtaggggtaggtacggtaaacctaccgaaaaccggtaggtagggtacggtacgaacccgaacgtacgtccctacgtacgtaaccggtacgacgggttacgggtaccgggtacgggtaccggtaacggcctacgtggtacggtacgggtcgtaacccggaccgtacccgggacgaaccggtcgacccgggtaccgtaacgacggtaacgttaccgggtaacctaaccggtagttaacggacggtaacgttacgggacgggtaacccgtacggttaaccgtttccgttacccggtggttaccggtaccgggaccgtccccgggacccggggttacgggaccccggggggtaccgggtttaacccgtaggttaaacccggggcggttacgggtacccggggg

SEQ ID NO: 121300 - DNA, 634 bp, Homo sapiens
  misc_feature: GYAE6OF01BU1PS.41.2.A02.1.454.CMB.1.raw
  modified_base (362)..(362): a, c, t, g, unknown or other
  misc_feature (362)..(362): n is a, c, g, or t
tcagtctatactatcacgaccggtgctcgatttagactcatctacagggggagcatcacccagcaaccacatctgtcctctagagagtccccctgagagctccgttcctcaccatggactggacctggaggatcctcttcttgggtggcagcagccacaggacgcccactctcgaggtgcagctaggatgcgagtcggtggggctaggagggtgaaggaacgccggtcggggcctcgagtgaacgtcctctcctgacacgacttcgtggaatacgtacgttacgaacgtacttactataactatacggtgggtcgaccgtacgccggtacccgtaggacggaggtacgttggaggtggtagnggtagtggactaccgtaacgtaaggtgaggtacgacgacgacgtccctagtcacgacacgggttacggtaccgagggcgtacgggacctacgagtaggtaggtgtacggaccgaccggcgacgcgaccgacgtacagtacgacgtaacctacgtagtacgagtcgtagacgacggccggtacgtttacgttacctgtcggtaccggacggacccgacccgggtggtaccgggggtaccggtccgttaacgggtccgtcggtcggtacccggg

SEQ ID NO: 121301 - DNA, 763 bp, Homo sapiens
  misc_feature: GYAE6OF01DG0EK.41.2.A02.1.454.CMB.1.raw
  modified_base (188)..(188): a, c, t, g, unknown or other
  misc_feature (188)..(188): n is a, c, g, or t
  modified_base (389)..(389): a, c, t, g, unknown or other
  misc_feature (389)..(389): n is a, c, g, or t
tcagtctatactatcacgaccggtgctcgatttagactcatctacagggggagcatcacccagcaaccacatctgtcctctagagagtcccctgagagctccgttcctcaccatggactggacctggagtatcctcttcttggtggcagcagccacaggacgcccactctcgaggtgcagctgatgcngtcgtgggctggagggtgaggaacgccgtcggggcctcgaggtgacgctctccgtgacgacgtacttcgtaggtatactaggttacaacgtacttactatactacagtggtcgacgtacgacggtcccgtaggacgaggtactaggacggtggagtacgggataggactacgtaaacccggtaaggtaggtggtaacgacncgtaacgtcctacgtagactacggtaacggtcgggtaccgtacgggaccgtacgggtaccaacggtagttcgggaacggttgggaacgacccggaccgggtaccccggaacggccggaacccgtacgggtaacccgtaaccgtaaacgggttaacccggttaacccgttaacccggtacggttacgtaagggttaacgtacggttacgggaaacgggtccccgttaaccggggtccttttttaaccgggtccgtagggttaccccggtacgggtcccccgggtaaccccgggtaacggggttaccccgggggggaacccgggttaacccttcccggttaaaccgggttccggttaagggtacccccccgggggg

SEQ ID NO: 121302 - DNA, 720 bp, Homo sapiens
  misc_feature: GYAE6OF01CB05Q.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcgaggtgcagctgatgacagtcgtgggctggaggtgaggaacgccgtagggcctgagtgaagctcgtccgtagacgtaaacgtcttcgaggtaataacgtacgggtttaacaaaccggttactttaccgttaatactaaccgtaacggtgggtacgaccgaccgtaccggtcccctagggaacgacgggtacttaggaggtggaagtgggagtacggaactaccgaaaccgtaaggtagtggacgacgtaacacgtctacgtacggacaacgacggtacgggtaccgagggtacgacgggttaccacgtagtcggagggtacggtacgaaccgtaccgggaaccgacggaggacccgtaccggtacaacgacgtacggtaacctcgacgttcgtaggacgttaccgagggaaccgtaccgtaccgggttcccgtttaagttccggtacggtcgggacccggtaaccccgggtacccccggtagggtaacccggggggtacccggggtaccctttaaccgggaccggttccggtaaccgggttaacccggg

SEQ ID NO: 121303 - DNA, 732 bp, Homo sapiens
  misc_feature: GYAE6OF01ED38A.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggacgcccactctcaggtgcagctgatgcgagtcgtggggactggaggtaggaggaagccgtcggggcctcagtgagcctctctgacaagtaccttcgtaggaatacgtaggttacaacgtacttctaattactacgacggttgggtcgacgacgaccggtcccgtaggacgtagggtactggagtggtagtagggatgtacgtaccaaaccgtaaggtcggtaggtacgaccgaacgtaccggtacccttacgcggacccgtaacgtacgggtaccggggttaccgaacggggtaccgtaaccggggtacaacccgtaggtacggaacgggtaggtaccgtaacggacccggtaccgaacggtacgaccggtaccggtaaccctagtaacgtaccggtaaccttaccgtacgttacgtacggtaacggtcgtagggaacggtaccgttaccggttcgttttaaccttacggtcggtaaccgggtaccggtaacccgggaccccgggtagggttaacccgggggggaccgggggttaccctaacgggttacccggttcggtaaccggtcccgggg

SEQ ID NO: 121304 - DNA, 731 bp, Homo sapiens
  misc_feature: GYAE6OF01BFFRF.41.2.A02.1.454.CMB.1.raw
  modified_base (161)..(161): a, c, t, g, unknown or other
  misc_feature (161)..(161): n is a, c, g, or t
  modified_base (650)..(650): a, c, t, g, unknown or other
  misc_feature (650)..(650): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagccacaggancccactctcaggtgcagctgatgcagtcgtgggctgaggtgaggagccgtggggcctcgaggtgaacgctcctccgtgacgtaagtacttcgtaggactacgtaggttacaacgtaccttactaatacttaccgtacgtggggtcgaccggacgaccgggtccccgtacgggaaccggtacgggtacgttagggtaggttacgggtaggtggggtagtacgggtaactaacccgtaaacccgtaagggtacggtgggtacgactacgacgtcctacgtcgacgacgtacggtacggttaccgagggtacggaccgggtaccaaccgtagtaggtacgggttacgggtaccgaaccgggacccggacccgaaccgggtacgacccggtaacccggtaaccctaacgtaacggtaccggtaacccgttaccggtacgttacgtaaggtacgtacgaggacggtaccggtaccggtttccgttacggttcgngttaccggacggaaccggccccggtacgggtacgggggtaacccgggtaccgttaacggttccggtggtaccggtaccggg

SEQ ID NO: 121305 - DNA, 711 bp, Homo sapiens
  misc_feature: GYAE6OF01BJNYV.41.2.A02.1.454.CMB.1.raw
  modified_base (136)..(136): a, c, t, g, unknown or other
  misc_feature (136)..(136): n is a, c, g, or t
  modified_base (381)..(381): a, c, t, g, unknown or other
  misc_feature (381)..(381): n is a, c, g, or t
  modified_base (396)..(396): a, c, t, g, unknown or other
  misc_feature (396)..(396): n is a, c, g, or t
tcagtctatactatcacgaccggtgctcgatttagactcatctacagggggagcatcacccagcaaccacatctgtcctctagagagtcccctgagagctccgttcctcaccatggactggacctggaggatcctntttcgttggtggcagcacgccagaggacgccccactcgtcgagggtgcgagcgtagagtgctaggtcgtgggggtctggagggtggacgggtacggcccggttcggggcccttcgaaggtcgaacgtcccgttctccgtaggaccttaaacgtacttacggtaggtaactacgtaacggttaccaacgtacttatatacgtaccgtacggtgggtcacgaccgtccggtacccggtggaaccggnggtacgtggtaaggnggtagtgggacgtgaactacgtaacgtagggtacggtgacgactacgacgtctacgtcgcaaggtaccggtacggtccggaggacggtacggacacgtaggtagtcgggtcgaccgtaccggcgacgacgtacgcggtaccgtacaacgtacggtacggtaacctacggtagtaccgtagtaacggtcggtacgaccgggtacccggttcggtttaccgttgtaccggtcgtaccggaccgggttccggaccggttaccgggtacggggtaccccggggttactaccgggtaccggtcggttaaccgggccgggg

SEQ ID NO: 121306 - DNA, 826 bp, Homo sapiens
  misc_feature: GYAE6OF01BGWW7.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggagactcctcttcttggtggcagcagccaagaggacgcccactcctcgtaggtgccagcgtagagtacgcacggttccggtggggacttgggtacgggtaggaagggaacgcccgggttacggggccttacgaggtagaacgtccttaccgtaccgtgaccaacgtacttcgagtactacgtagtacaacgtacttatactactactcggtggcgaccgacgaccggtcccggtaggaacggtacggtacggttaggtaacgggtgggtaaggtagggagtacggaacgtaaccgtaaacgtaagggttaggtacggtacgaactaacggtaccgtacctcggactacggaacgtacggttacgggtaccgggaacgggtaacggaccggtacaaccggtagggttaggtaccggtacggtaaccggacccggtaacggacccggtaaccggtacggacccgtaaccgggtaacacccgttaacggttaacggtaacccgtttacggtccgttaacggtacggttaacgttacccggaagggtaaccccgggtacgttaaacccgggtttccgtttaacggttccggtacggttaccggaccccgggtaacccgggaccccgggggtaggggttaaccccggggggtaccgggttacccttaaacggggttccggtaggttaccggggttaccccggggg

SEQ ID NO: 121307 - DNA, 801 bp, Homo sapiens
  misc_feature: GYAE6OF01AQ3XA.41.2.A02.1.454.CMB.1.raw
  modified_base (80)..(80): a, c, t, g, unknown or other
  misc_feature (80)..(80): n is a, c, g, or t
  modified_base (265)..(265): a, c, t, g, unknown or other
  misc_feature (265)..(265): n is a, c, g, or t
tcagtctatactatcacgaccggtgctcgatttagactcatctacagggggagcatcacccagcaaccacatctgtcctntagagagtcccctgagagcctccgttcctcaccatggactgggaccctggaggacggtcctcttcgttggtggcagcagccacgaggacgccccaacttctcagggtgcagtctgactgcgtagtccgtgggactggaggtgaggtacgccgtcggggcctcaggtacgaacgtccttctaccgngaccgaaacggtacctttacgtaggaacttacgtaaggtttaaccaacggtaccttacttaattaaactacgtacggttagggtacggaccgtaccgacccgggtccccgtaggtaaccggaacgggtacgttggtaggtaggagttgggacgtggaactaaccgtaaacccgtaaaggtacgggtaggtacgaaccgtaacgtaccgtacctaccgtggtaacccacgtaacgggttacgttaacccgggacgggtaccggaccgggtaaccacggtaacgtagggtacggtcggtacgaacccgacgggacccgaacggtacgcccggtaacccggaccgtaacgaacgtaaccggtaaacgtaccgtaacgttcgtaacgtaacgttacggtacgaacgggttaaccaccgggtttacccgtttaccgtcgggtcggtaccgaccgggtaccccgtacccgggtacgggaacccggggttaaccgggggtaccccgttagggtaacccgggttaacgtcgggttaacccgggg

SEQ ID NO: 121308 - DNA, 714 bp, Homo sapiens
  misc_feature: GYAE6OF01B2CO7.41.2.A02.1.454.CMB.1.raw
tcagtctatactatcacgaccggtgctcgatttagactcatctacagggggagcatcacccagcaaccacatctgtcctctagagagtcccctgagagctccgttcctcaccatggactggacctggaggatcctcttcttggtggcagcagcccacgaggacgcccactctcaggtgcagctgatgcagtcgtgggctgaggtggaggagtcgtcggggctcgagtgagctctctgcaagacttcgtggatacgaggttacaacgtacttactatactacacgttgggtcgaccgacgaccggccccgtaggacgtagggacttggaggtggagtgggagtggactaccgaaaccgtaagggacgttaggtacgaacgacgacgtcccgttacgacgaccaacgtacgggtacggttaccggaggggccgtaacgggtccctacgagttggacgggtaggaccgaaccggaccggcccggaacggtacggaccgtaacccggtccaacgtacgttaaccggtaacttacccgacggttaccgtaggtaacgttcgtacgggaaccgggtaccgttacccgggtttaccttttaaccggttcgtacggtaccggacccgggttaacccggcccccgggttacggggtaaccgggggggtaccggggttaccccgttaaccgggttaccggttcggttaccggggtaacccgggg

SEQ ID NO: 121309 - DNA, 754 bp, Homo sapiens
  misc_feature: GYAE6OF01B4L9U.41.2.A02.1.454.CMB.1.raw
  modified_base (161)..(161): a, c, t, g, unknown or other
  misc_feature (161)..(161): n is a, c, g, or t
  modified_base (175)..(175): a, c, t, g, unknown or other
  misc_feature (175)..(175): n is a, c, g, or t
  modified_base (506)..(506): a, c, t, g, unknown or other
  misc_feature (506)..(506): n is a, c, g, or t
tcagtctatactatcacgaccggtgctcgatttagactcatctacagggggagcatcacccagcaaccacatctgtcctctagagagtcccctgagagctccgttcctcaccatggactggacctggagatcctcttcgttggtggcagcagccacaggancccactctcaggtncagctagatgctagtcggtgggctaggaggtaggacggaacggtccgtcggggacccttacggaaggtcggaaacgtccttccgttccgtagaccgtaaagtcctttccggtaaggactaacgtacggtttaccgtaaacgttaccgtttaaccttaagtacgtaacgacggtttacggggtacgaccggaaccgtccgggacccccgtagggacggtaacgggttcttcgggaaggttacgggaggttacgggaagtacgggtaactacccgtaaaacccggttaagggtacggtagggtaccgaaacgtacccgtaggtcccgtttacncggacctaacgggtaggtaaccggttccggacgggacgttaccgggacaaccgtagcggtaagttcggaacgtaccgaccggtacgaacccggtacgaacccgtaggtaccccgagtacgtaacgtaacctaccggacgttacgacggtaagtcgaggacgtcgtacccggttacgttccgttagcgttacgaccgtaccggcccgtaggtacgggggaccggttcgaagtccgtggtacgtcccggg

SEQ ID NO: 121310 - DNA, 780 bp, Homo sapiens
  misc_feature: GYAE6OF01EVTMB.41.2.A02.1.454.CMB.1.raw
  modified_base (390)..(390): a, c, t, g, unknown or other
  misc_feature (390)..(390): n is a, c, g, or t
tcagtctatactatcacgaccggtgctcgatttagactcatctacagggggggcatcacccagcaaccacatctgtcctctagagagtcccctgagagctccgttcctcaccatggactggacctggaggatcctcttcgttggtggcagcagccacaggagcccactctcaggtgcagctgatgcagtcgtggggctggaggtggaggacgccgtggggcctcgagtagagctctcctgcaagtcttcgtggactaacgtaggttaccaacgtactttactaatactacgtacgtgggtcgcgacgcggcccgtaggacgacgggtacttgaggtggagtgggatcggataccgaaccgtaagtggtagtacgacgacacgtcctacgngacgacgaggtaccggttaccgagggccgtaggtccaacgtaggtacggtacggtacgggtacgaaccggaccggtaccgaacggtacgggtacccgtaccggtaccctaacgtaggtaacccggttaaaccgtttacccggaaggtttccgtaacgggttaacggttacccggtacgggtaaaccgggtaaccccgggttacccggggtttaaccgtttttaacccggttaccggttaccggggttaccggtaaccccggggaaccccggttaacccccccggggtacgggggttaaacccggggggacccccggggggttaacccgtttacccgggttaaacccgggggtttccgtaaaccccgggggttccgggtaccccggggggg
